United States Patent 7,482,117 (GENETIC POLYMORPHISMS ASSOCIATED WITH MYOCARDIAL INFARCTION, METHODS OF DETECTION AND USES THEREOF) - sequence listing, part 6

SEQ ID NO: 17676 - DNA, 1980090 bp, Homo sapiens
  misc_feature (1)...(1980090): n = A,T,C or G, or insertion/deletion polymorphism (see Tables 1-2)
ttttgtatgttctacaaggaatttttgttagattttttcttttggtacaatttttctgactaaaatgcagcataattgtctttattataggattgctaaggagtaatagtacggagacatctttgtggttttatacacacacacatatatatatttaacataagctgtctaaaataagtcacaaaacttgcagattagaaaaggaagcacattttggctgttttggtgtcagcatcttaattaagtagaaaatattatggacctataaattgaacttgcgactgttcactcactagagagaacaatttccagggagttagaatagtttttcctgaaggagagtcaaataaatttgggaaataaggttgctcttgtaaaacagtaatagatttagcttttattttttaatgataagaacattaaatgtcttctaagtcagaatcagagtatatctttgttaactgagctcaccaagacaaagtgataataacacaaaactgtggtttttggtagtctaatcaatttagaatgttttattgtcatgttagttgattttctgtctttatttgtattttttcttatcctggttatagagacttttaaaatctatgatttaaataagttgtgtttttcccccctaggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctggaaataacatagcatgccgtgtgacttgttctttatatcagttcactttggtccagatatctagacttgatttctagctccacatgtcattccctttttttctactcttcgccttttgctcttgagtcctttggttcttaacagactgatttctatgataccttctaaaatgattactcctcttttggcacataggtgagcactattcaatggattttcccctgtcctttttaatcacacttttatctgtccatgctgaatagttgttgctgtactttttaatctctgaagaaatgcaaactttttaaaaatttcaccctgaacatcatagagtgtacttacacctatatggtacagcctactatacacctgggctatgtggtatagcttactgcttgtaagctactatcctgtagagcatgtgaatactgtagacaattgcaacgcaatggcaactatcttattaaaatttaatggccggacacggtagctcatgcctgcaatcccaacactttgggaggctgaggcgggcagatcatttgaggtcaggagttcaagaccagcctggcctggaaaccctgtctctactaagaatacaaaaaattagtggggcatggtagcgggcacctgtaattccagctacttgggaagctgaggcagaatcccttgagcccgggaggcagaggttgcagtgagccaagaacacaccactgcactccagcctgggcgacagagtgagactccgtcaccaaaaaaaaaaaaaaaaaaagcatgatgctgggcatggtggcctacgcctgtaatccagcactttgggaggcccaggtgagcagattgcttgaggtcaaagagttcgagaccagcctgaccaacatggtgaaaccctatctatctctactaaaaattatatatataaaaatcagccaggcatggtggcgcataatctcagctactcaggaggctgaggcaggagaatcgcttgaaaagccttagctgggcatggtgcctcacgcctgtgatgccaacactggtaggttgaggtgggcggctcacttgagcccaggagttcaagaccagcctgggcaacatggtaaaatccggtgtctacaaaaaaatgagcccagcgtggtggtgcacacttgtcccagctactcaggaggctgaggtggcaggatcacctgagcccaggagatcgaggctgcagtgagccatgatcatgccattgcactgcagcctgggtaacagagtaagaccctgtctcaaaaaaaaacactttgattatcatcatttaacaagtttattgttaaagcatgcatggtagtgtcaccttggatcctccaaaaggcagacaccaaggtggagtcagatacactagagctgtactgagggaaatgcctgtgagggatacaagggagagggatcagtaggcagggaaggccttcagaatgcaatgtgcatgtgacagaagagagagaagagaactcaaacctcagctgctctgagagtctcccagcctgatgaggaatctcagagcagattacctattaagagcagtcccagattgggcagagatggcctgactactagtccagagcagcctggggagaacacatggttttcatgtgagtgctgtaacagatcaggaggactagcagctggtggctgtcagatttgttacttgcatccagttttcttgagaactgagtggcacaattccactccttaacactgcacagatccactttacacctttgggtagcccctccacagttccatgagcttctgatataaactccacatcacattgcatcttttcctgccactgataccctcttatactataaagtttatcagatcatgtggtccagtttgtagggctgcttgcatcatagcctgaatcttaattttcaacagccctttcttgctccaaggccctactcaagcctaacatttttttcatgtcatttactatatgggttggagtagtgtttctaggtggaatgtcttgctttctgaatctagagaaccccagagttacagtgcttgcttccttgtagcaggtgatgcaaaatgtagtgtgtctttttactttgtagagtattccagcatgcccatgtcccctggtctcctagaacccttaaaggaatggcagatcctggccgggagcattggctcacccggtggctctgggattacaaagcctgtaatcccagcactttgggaggccgaggcgggtggatcatgaggtcaggagtttgagaccagcctggccaagatggtgaaaccctgtctctactaaaaatacaaaaattagccaggcgtggtggcgcgcacctgtagtcccagctacttgggaggctgaggcaggagaattgcttgaacccaggaggcggaggttgcagtgagccgagatcgtaccattgcactccagcctgggcgacaagagcaaaactccatcttaaaataaaaaaaaaaaaaaaggaattgcagatccccaaatctatgtagagtttctctctcacctgggacacatagcaaggcttccggtgtgctagctaccttacattcattttgcttatttagcatgatgtcattgatgtaatgttctatggaatgcccagatggcccacgtattaggccattcttgcattgctataaagaaatacctgagactggttaatttacaagaaaagaattggctcatgttcctacaggaagcatagcagcatcttccttcctgaggggaggcctcaggaagcttgcatttcatggcggaagccaaagacagagcaggtacatcacatggtgaaagcaggagccaatgggggaagatgccacacacatgaccagatctccagagaactcactgtcatgaagacagcagcaagctacgcaggatctgcgcctacggcccaaacacctcccacgaggccccacctttagcattggggattacagttcaacatgagatttgggcagagacaaatatgcaaactatatcattccatcccagcccctcccaaatctcgtcctcacattacgaagtacaattacgccttcccaacagtccccgcaaagtcttaactcattccagcattcattcaaaagttccaagtttcaaatccaaattcttatgtggaaatgagttccttctacctatgagcctgtaaaatcaaaacaagttatttactttgaagatacaatgggggtttgggtattggctaaacatttttgttccaagtgggacaaataggccaaaagaagggttacagagcccatccaagttcaaaacctagcagggcagtcattaaatcttagactccatattccatatccagggcacactgctggcagggatggactcccaaggccttgggcagttctgcccctgtgtctttgcagggttcacccctctcaggtgctctcacaggttgttgagtgcctgtggccttttcaggctcagggtgcaagctgcaggtgcatctaccattcttgggtctggaggatggtggccctcttctcacagctccacaaggcaatgccccagaagggactccatgtggggcctccaatcccacatttcccctccgcactaccctagtagaggttctttatgtgggctccactgctgcagcaggtttctgcctgaacacccaggcttttccatacatcctctgaaatctaggcagaggctgccaagaacccaccactcttgcactctttgtacttgcaggcttaacaccatgtggaagccatttacaacttgtattatccaaagtggtagcttaagctgtacttcggcccctttgaaccctggctggagctggagcttccgagaggtagggagcagtgtcccaaggctgtgcagggcagtggagctctgggcctggcccatgaaatcattctcccctcctaggtctcagggcctgcaatagaaggggctgctgcataggtctctgaaatgtattcaaggccttttttcattgtcttgactgttagtgagaggtgacagcatgttggtggtcctcacagccctcgctccctcttggcgcctcctctgcctgggctcccaatttggtggcacttgaggagcccttcaacccaccgctgcactgtgggagcccctttctgggccggccaaggccagagccggctccctcagcttgcagggaggtgtggagggagaggcgcgagcgggaaccggggctacgcgcggcgcttgtgggccagctggagttccgggcgggcgtgggcttggcgggccctgcactcggagcagccggccggccctgcgggccctgggcaatgaggggcttagcacctgggccagcagctgcggagggtgtactaggtcccccagcagtgccagccctctggcactgtgctcgatttctcgctgggccttagctgccttcccgtggggcagggctccggacctgcagcccgccacgcctgagcctcccaccccctccatgggctcctgtgcagcccgagtctcctcgacgagggccaccccctgctccacggcacccagtcccatcgaccacccaagggctgaggagtgcgggcgcacgcaggggactggcaggcagctccacctgcagccccggtgcgggattcaccgggtgaagccagctgggctcctgaatctggtggggctttggagaacctttacaatccctgagctagacataaatacaccaatcggcactctgtatctagctcaaggtttgtaaacacaccagtcagcaccctgtgtctagctcagggtttgtgagtgcaccaattgacactctgtatctagctgctctggtggggccgtgaagaacctttatgtctagctcagggattgtaaatacaccaatcggcactctgtatctagctcaaggtttgtaaacacaccaatcagcaccctgtgtctagctcagggtttgtgagtgcaccaatggacactctgtatctatctgctctggtggggccttggagaacctttgtgtggatactctgtatctaatctgatggggacgtggagaacctttgtatccagctcagggattgtaaacgcaccaatcagcgccctgtcaaaacagaccactgggctctaccaatcagccggacgtgggtggggccagataagagaatgaaaccaggctgccccagccagcagtggcaacccgcttgggtccccttccacactgtggaagctttgttcttttgctctttgcaataaatcttgctactgctcactctttgggtccatgctgcttttatgagctgtaacactcaccacgaaggcctgcagcttcactcctgaagccagcgagaccatgagcccgccgggaggaacgaacaactccagatgtgccgccttaagagctgtaacactcaccgcaaaggtctgcagcttcactcctgagccagcgagaccacgaacccaccagaaggaagaaactccgaacacatccraacatcagaaggaacaaactccagacgcaccaccttaagagctgtaacactcaccgcaagggtccgcagtttcattcttgaagtcagtgagaccaagaacccaccaattccggacacattttggcgacccagatgggactttcgcctatcaccaagcggtgagaccatcacctatagctgagcggcgagaccatcacctatcaccaagcagtgagtaccacggacccctttcacttgctattctgtcctatctttccttagaattcgggggctaaataccgggcacctgtcggccagttaaaagtgactagcacggctgccggactaaagacatgggtgtcaggctttctgggaaagggctaacaaccccaactcttcagagttgggaccattggtttgcctagcaccagcttccacttttcctgtacttctgggctgagccaagggtcgacagagaggaaagccatgcagctccagggtcccgacaacaagttggttgaccctgcggccatgagtggaactctcaaaggcctgtcgcccaagtgagactcgcccatctatcctatctatcctgacccttgccccctgggtcctaatgcctgccagacaaacttcctctcgcctctcttctctgaggttagtcctgcttctaaaaattgctacctgtctctggtgcttttctagtttctcctataagaatgatttctagtataaactccaggtctctgctactttctgtaggcacccgggctcaccaatcagaaagacacaatttttgcccaaagccccattgtagtggggactacctggaattttaggatccctcctcagactaacaggcctaacaaaagctattcctgaagctaggatatggggagcctcagaaattgtatccttcctattcatgtaagcgaggacaaaaggtgtcactcttccaatcctgaagatcccttccctccctcagggcatggccctccacttcatttttggggcataacatctttataggaaaggggtaaagtaccaatactgacaggagaatgcttaggactctgacaggtttttgagaatgtgtcggtaagggccaccaaatccgatttttctcggtcagtcctccttgtggtctaggaggacaggcaagggtgcaggttttcaagactgcatcagtaaggaccactaaatccaacgttccttggtcctccatgtggtctgggaggaaaactagtgtttctgttgctgcatcggtgagcgcaactattccgatcagcagggtcctgggactgttgctggttcttgggcaggggttgtttctgctgctgcgtcggtgagcgcaactattccgatcagcagggtccagggacctttgtgggttcttgggcagggggagaaacaaaccaaaactgtgggcggttttgtctttcagatgggaaacactcaggcatcaacaggctcacccttgaaatgcatcctaagccattgggaccaatttgatccacaaaccttgaaaaagaggcggctcatttttttctgcactatggcttgggcccaatattctctctctgatgaggaaaaatggccacctgagggaagtacaaattacaatactatcctgcagcttgaccttttctgtaagagggaaggcaaatggagtgaaataccttatgtccaagctttcttttcattgaaggtgaatacacaactatgcaaagcttgcaatttacatcccacaggaggacctttcagcttacccccatatcctagcctccctatagctccccttcctatgaatgataatcctcctctaatctcccctgcccagaaggaaataagcaaagaaatctccaaaggtccacaaaaacccccaggctatcggttatgtccccttaagctgtagggggaggggaatttggcccaacccagctacatgtccccttctccctctctgatttaaagcagrtcaaggcagacctggggaagttttcagatgatcctgataggtacatagatttcctacagggtctagggcaaaccttttacctcatttggagagatgtcatgctactgttagataaaaccctggcctttaaggaaaagaatgtggctttagctgcagcccgagagtttggagatacctggtatcttagtcaagtaaatgatagaatgacagccgaagaaagggacaaattccctaccggtcagcaagccatccccagtatggatccccactgggaccttgactcagatcatggggactggagttgtaaacatctgttgacctgtgttctagaaggactaaggagaattagaaaaagcccatgaattattccatgatatccaccataactcagggaaaagaagaaaatcctcctgccttccttgagtggctacgagaggccttaagaaaatatactcccctgtcacccgaatcactcgagggtcaattgattctgaaagataagtttattacccaatcagcctcagatatcaggagaaagctccaaaagcaagccctgggccctgaacaaaacctagagtcattattaaacctggcaacctcagtgttctataatagggaccaagaggaacaggcccaaaaggaaaagcgagatcagagaaaggctgcagccttagtcatggccctcagacaagcaaaccttggtggttcagagaggacagaaaatggagcaggccaatcacctggtagggcttgttatcagtgtggtttactaggacactttaaaaaagattgtccaatgagaaacaagctgcccccttgtccatgtccactatgctgaggcaatcactggaaggtgcactgccccagaggacgaaggttccctgggtcagaagcccccaaccagatgatccaacaacaggactgagggggcccagggcaagtgccagctcatgtcatcaccctcactgatccccaggtatgttcaactattgagggccaggaaattgacttcctcctggacactggcgccgccttctcagtgttaatctcctgtcctggacgactgtcctcaaggtccgttaccatccgaggaatcctgggacagcctgtaaccaggtatttctcccacctcctcagttgtaattgggagacttggctcttttcacatgcctttcttgttatgcctgaaagtcccacacccttattagggagggatatattagccaaggctggagctattatctacatgaatatggggaacaagttacccatttgttgtcccctacatgaggagggaatcaaccctgaagtctgggaattagaaggacagtttggaagggcaaaaaaatgcctgcccagtccaaatcaagttaaaagatcccaccacttttccttatcaaaggcaatatcccttaaggcctgaagttcataaaggattacagaatattgttaaacatttgaaagctccaggcttagtaaggaaatgcagcagtcactgcaacaccccaattctaggagtacaaaaaccgaacggtcagtggagactagtgcaagatcttagactcattaatgaggcagtagttccactatatccagttgtacccaacccctataccctgctctctcaaacaccagaggaagcagaatggttcatggttctggacctcaaggatgccttcttctgtattcccctgcactctgactcccagttcctctttgcttttgaggatcccacagaccacacgtcccaaattacgtggatggtcttgccccaagggtttagggatagcccttatctgtttggtcaggcactggcccaagatctaggccacttctcaagtcgaggcactctggtccttcaatatgcagatgatttacttttcgctaccagttcagaagcctcatgccagcaggctactctagacctcttgaactttctagctaatcaaaggtacaaggtgtctaggtcgaaggcccagctttccctacagcaggtcaaatatctaggcctaatcttagccagagggaccagggccctcagcaaggaacaaatacagcctatactggcttattctcaccctaagactttaaaacagttgagggggttccttggaattaccggctttgccaactatggatccccggatacagtgagatagccaggcccctctatactccaatcaaggaaacccagagagcaaatactcatctagtagaatgggaaccagaggcagaaacagccttcaaaaccttaaagccggccctagtacaagctccagctttaagccttcccacaggacagaacttctctttatacgtcacagagagagccaggatagctcttggagtccttactcagactcgtgggacaaccccacaaccagtggcatacctaagtaaggaaattgatgtagtagcaaaaggctggcctcactgtttaagggtagttgcagcagtggccgtcttagcgtcagaggctatcaaaataatacaaggaaagcatctcactgtctggactactcatgatgtaaatggcatactaggtgccaaaggaagtttatggctatcagacaaccacctacttagataccaggtactactccttgagggaccggtgcttcaaatacacatgtgtgtggccctcaaccctgccacttttctcccagaggatggggaaccaattgagcatgactgccaacaaattatagtccagacttatgccgcccgagatgatctcttagaagtccccttaactaatcctgaccttaacctatataccaatggaagttcagttgtggagaatgggacacgaagggcaggttacgccatagttagtgatgtaaccatacttgaaagtaagcctcttgccccagggatcagtacccagttagcagaactagtggcacttacccaagccttaaaactgggaaagggaaaaagaataaatgtgtatacagatagcaagtatgcttatctaatcctacatgcctatgctgcaatatggaaatagggagttcctaacctctggggaaacccccattaaataccacaaggaaattatagagttattgcacacaatgcaaaaacacaaagaggtgggaatcttacactgacaaagccatcaaaatgggaaggagagggragaacagcaacataagcagctggcagaggcagcagaaaggaaggaagagacaggaagtcaaagaaagagacagagagtaagaaacaaagagaagcagtcagagtgaaagagagacagaaagacaaagtcaaggagagaaaaagagatggaagtagtaaagaaaaaacagtgtaccctattcctttaaaagccrgggtaaayktctatctacccagccaaggcatattctacttatgtggatcttcaacccatatctrcctctcaracagtttgcaagaaataacgaaatctatccttactttacaatcccaaatagactctttggcagcagtgactctccaaaactaccgaggcctagacctcctcactgctgagaaaggaggactctgcaccttcttaggggaagagtgttgtttttacactaaccagtcagggatagtacaagatgctgcccagcgtttacaggaaaaggcttctgaaatcagacaacgcctttcaaattcttataccaacctctggagttgggcaacatggcttctcccctttctaggtcccgtggtagccatcttgctgttactcgcctttaggccctgtatttttaaccttcttgtcaaatttgtttcctctagaatcaaggccatcaagctacagatgggcttacaaatggaacccaaaatgagttcaactaacaacttctaccaagggcccctggaccgacccactggcacttcccctggcctagagttcccctctgaaggacactacaactgcaaggccccttcttcaccccatccagcaggaagtagctagagcggtcatcggccaaattcccaacagcagttggggtgtcctgtttagaggggggattgagaggtgacagcrtgctggcagtcctcagccctcactcactcttggcacctcctctgcccgggctcccactttggtggcacttgaggagcgcttcagcccaccgctgcactgtgggagcccctttctgggctggccaaggccagagccggctccctcagcttccagggaggtgtggagggagaggctcaagcgggaactggggctgcgtgcggcgcttgcgggccagctggagttccgggcgggcgtgggcttggcgggccctgcactcagagcagccagccggccctgccggccccgggcagtgaggggcttagtacctgggccagcagctgtggagggtgtactgggtcccccagcagtgccagcccaccggcgctgcactcgatttctcaccgggccttagccgccttcccatggggcagggcttgggacctgcagcccgccatgcctgagcctcccacaccccctccatgggctcctgtgcggcccgagcctcctcgacgagcgccaccccctgctccacggcacccagtcccatcgaccacccaagggctgaggagtgcgggygcacgcaggggactggcaggcagctccacctgcagccccggtgcgggattcaccgggtgaagccagctgggctcctgaatctggtggggctttggagaacctttacaatccctgagctagacataaatacaccaatcggcactctgtatctagctcaaggtttgtaaacacaccagtcagcaccctgtgtctagctcagggtttgtgagtgcaccaattgacactctgtatctagctgctctggtggggccgtgaagaacctttatgtctagctcagggattgtaaatacaccaatcggcactctgtatctagctcaaggtttgtaaacacaccaatcagcaccctgtgtctagctcagggtttgtgagtgcaccaatggacactctgtatctatctgctctggtggggccttggagaacctttgtgtggatactctgtatctaatctgatggggacgtggagaacctttgtatccagctcagggattgtaaacgcaccaatcagcgccctgtcaaaacagaccactgggctctaccaatcagccggacgtgggtggggccagataagagaatgaaaccaggctgccccagccagcagtggcaacccgcttgggtccccttccacactgtggaagctttgttcttttgctctttgcaataaatcttgctactgctcactctttgggtccatgctgcttttatgagctgtaacactcaccacgaaggcctgcagcttcactcctgaagccagcgagaccacgagcccgccgggaggaacgaacaactccagatgtgccgccttaagagctgtaacactcaccgcaaaggtctgcagcttcactcctgagccagcgagaccacgaacccaccagaaggaagaaactccgaacacatccgaacatcagaaggaacaaactccagacacaccaccttaagagctgtaacactcaccgcaagggtccgcagtttcattcttgaagtcagtgtgaccaagaacccaccaattccagacacattagcactggctccttttttttttagacggagtctcgctcttttgcccaggccggagtgcagtggcgcgatctcggctcactgcaagctccgcctcccaggttcatgccattctcctgccccagactcccgagtagctgggactacaggcacccgccactgaacctggttaattttttgtatttttagtagagatggggtttcaccgtgttagccaggatggtcgctatctcctgacctcatgatccgccagcctcggcctcccaaagtgctgggattacaggggtgaaccaccgcgcccggcctcactcctttttaattacgcaaatatctctagcaagtggttgctccacagcctgcttgtatccctcttttgagaaagctttttctttctttgccacatgggcagactacaaaatttccaaacttttatattctgcttcccttttaaatgtaagctccaactttcttcatcatttccatctgagactcagcagcttggatctcgctgtccatatcactatcagcattttggtcacaacaatttaaccagtctctaagaagttttaaaccttccctcatcttcctgtctttttctgagccttccaaactctttcagcctctgcctgttacatagttccaaaatgacttccacattttcaggtatctttatagtaattccccaccccggtgccaattttctcttagattgctatacagaaatagctgagactgggtaatttataagaaaagaggtttaattggctcatggttctacaggctgtacaggaagcatagcagcatctgcttctggggaggcctcaggaaacttccaatcgtggcagaaggcaaaggggaagcaggcacatcacatggtgaaagcaggaacaaggtcagggggcagatgctacacacttttaaatgactagatctcgagagaactgaaaagacagtaccaagctatgagggatccacccccatgatccaaacacctctgggcaggccccacattcagcactggggattacaattcaacatgagatgtgggtggggacaaatatccaaactataacagcctataattcacattttatcatcaaaggagcaaatattattcttggggcaaaactgagtaaatattgtcgtcccacatggatgtgaactatttctagtctctttcctgatagaagtaggggaaaaaatgcatttactaaatcagtggctgtgtattatgtacctcacacttagtacccctactgtgtgcagtcattgagtggaagtaaaccagaaagtggcctcagtgtgagaactgaggtggatccaaaaatggcagctggctgggcatgatggctcacacctgtaatcctagcactttgagagcccaaggcaggcaaatcacttgaggtcaggagtttgaaaccagactagccaacatggtgaaaccctttctctactaaaaatacaaaaaattagccaggcgtggccgggcacagtggctcatgcctgtaatcccagcactttgggaggccgatgcaggcagatcacctgaggtcaggagttcgagaccagcctgaccaacacagtgaaaccccgtctctactaaaaatacaaaaactagctgggcatggtggctcgccactgtagtcccagctactcaggaggctgaggcaggagaatcacttgaacctgggagacggaggttgtaatgagccaagattgcaccactgcactctagctcgggctacggagyaagaatctgtctcaaaaaaaaaagaaagaaagaaagaaagaaagaaaaagaaaaaattagccaaacatggtggttcatgcttgtaaccccagctactcaggaggctgaagcaggagaatcgcttgaacctggcaggcagaggttgcagtgagctgagattgtaccactgcacttcaacctgggcaacagagtgagactccatccccactcccccayaaaaaaaacagcagctagaggctggccagggaactatgtttctcatagaggcctgcctgcctgcctgccttccttccttccttctttccttccttctctgtttttctttgacatgaattaaaaaataattttcattatgtatgcattaacattgttttactgtggcaagaacacctaacatgagttctactcaatggcattttaagcgcacaatgcagtattgtcatctacaggcacaatattgtatagcagagctctagaattcaccttgcataattgaaatgttatatccattgattagcaacttcccatttcctgcaaccaccattctactctctgtttctataagtttgagtattttagagacctcatataagtggagtcatggagtatttatccttctgggactggcttattctcttagcataatgtcctcaagttcattatgttgttgcatattgcaggatttccttttttaaagctgaataatattccatgtgtgtatatactacattttttaaatccattcattggtcaatagactttaggttgtttccagtccttggctaagaatagtgctgcaaatgaacacggaagggcagacatccaagatctcgatttcaagttttgtgtgtgtatttgtttgtttgtttgtttgttttttgataaatacccagaagtagtattgctgaatcatatcgtagttgtatttttggagaaacttccatgctgttttccatagcagctgcaccattttacagcaggttttcttaagggaggtctgggtggcatacctctatggctgtcaaagctcacaatgtacaaatagttctcaagaagagaataaatgaaggtaaaatccactgacacccctcccgttctggtgaccttactccctacagaaatcattgttaatatttacttgcatatacttccaaaatttgtatatccatttataaacatttcttaacccagtgggatcatgatataagcagtattccctaacttaacattacatcttgactgtcttgccatacaagcaggtatactgctgtctcaattttttaaacagcaacataaaattttattatttgtttctacrataatttatttccttggcttagttaaatgaaataactcagtattcttccaataaattctcactcccccctcccccgccaccattttttgagacagggtctcactctgtcacccaggctagagtgcaatgatgtgatcaaagctcactgcagcctcaacctcctgggctcaagagattctcctgcttcaccttcctgagtagctgggactataggcatgcaccaccacacgtggctaattttgaaaattttatttttatagaggtagggtcttgctatgttgcccagactgatctcaaactcctggcctcaagcaatcctcccacctcagtctcccaaagtactgggattacagatgtgagccactatgcctgatggatttttctcctttgcttacatttgtaacatgcagccacaaaattctaatacaagaaaagagaataggagacaggcacagtggcrtatttctatagtcccagctatttgcgaggctgagacaggagggtcacttgagttcaggagtttgaggctagcctgtgcaacacagccatactgcccatggtaatttatagattcaatgtcatccccatcaagctaccagtgactttcttcacagaattggaaaaaactactttaaagttcatatggaaccaaaaaaagagcccacatcgccaagtcaatcctaagctgaaagaacaaagctggaggcatcacactacgtgatttaaaactatactacaaggatacagtaaccaaaacagcatggtactggcaccaaaacagagatatagaccaatggaacagaatagagtcctcagaaataataccacacatctacgactgtctgatctttgacaaacctgacaaaaacaagaaatggggaaaggattccctatttaataaatggtgctgggaaaactggctagccatacgtagaaagctgaaactggaccctttccttacaccttgtacaaaaattaattcaagatggattaaagacttaaatattagacctaaaaccataaaaaccctcgaagaaaacctaggcaatacatgcaggccataggcatgggcaaggacttcatgactaaaacaccaaaaacaatggcaacaaaagccaaaattaaccaatgggatctaattaaactaaagagcttctgcacagcaaaagaaactaccatcagagtgaacaggcatcctacagaatgagagaaaatgtttacaataataatgtcagatattagcccatctgacaaagggctaatatccagaatctacaaagaacttaaacaaatttacaagaaaaaatcaaacaaccccatcaaaaagtgggcaaaggatatcaacagacagttctcaaaggaagacatttatgcagccaacagacacatgaaaaaatgctcatcatcactggtcatcagagaaatacaaatcaaaaccacaatgagataccatctcacaccagttagaatggcgatcattaaaaagtcaggaaacaacaggtgctggagaggatgtggagaaataggaacacttttacactgttggtgggactgtaaactaattcaacaattgtggaagacagtgtgacaattcctcaaggatctagaactagaaataccatttgacccagccatcccattactgggcatgtacccaaaggactataaatcatgtggctataaagacacatgcacgcatatgtttattgcagcactattcacaatagcaaagacttggaaccaatccaaatgtccatcaatgatagaatggattaagaaaatgtggcacatatacaccatggaatactatgcagccataaaaagatgagttcatgtcctttgtagggacatggatgaagctggaaaccatcattctcagcaaactattgcaaggacagaaaaccaaacactgcatgttctcactcataggtgggaattgaacaatgagaacacttgggcacagggtggggaacatcacacaccggggcctgtcgtggggtggggaaggggggagggatagcattaggagatatacctaatgtaaatgacgagttaatgggtgcagcacaccaacatggcacatgtgtacacatgtaacaaacctgcacgttgtgcacatgtgccctagaactgaaagtataataataaaaaaagaaaatttggcacatatataccatggactactatgcagccatgaaaaaggatgagttcatgtcccttgcagggacatggatgaagctggaaaccatcattctaaccaaactatcacaaggacagaaaaccaaacaccatgtgttctcactcataggtgggaattgaacaatgagaacacatggatacagggcggggaacatcacacactggggcctgttgtggggtggttggctgggggagggatagcattaggagaaatacctaatgtaaatgamgagttgatgggtgcagcaaaccaacatggcacatgtatacctatgtaacaaatccgcacattgtgtacatgtaccctagaacttaaagtataataaaataataataataataataataataataataataatgccttgctttcacaaaccagtagaagttatggattgacctgagtgacactagatctagtgaaggatagttgcaccatcgtagggatgtagtaggattaaagaattgccaaatctaattaacgtctagggagtataacgtatcaaaaagaaaagtcatttgtaccagttcaataaaaatcaattgaatatttgaacacacacttggggactgtaatcaaaatccatttttggtataattagaatatgagatcataacggaagcataaagtctgccaattcaatatttccaaagcaatttttatttcattatattccccactttatacctaattctacaggaaaacccattcaagtgaaaatacacaccaagatcagccagtcaaaaacaatatgtatttattgggcacagatcataaatatttcataaatatttatatattcagtgtatgtgggccaggcacagtggctcatgcctgtaatcccagcactttgggaggccgaggcaggtggatcgcctgaggtcaggagttcgagaccagcctggccaacatagtaaaaccctgtctctactaaaaatacaaaaaattagctgggcatggttgggcacctgtaatcccagctactaaggaggctgaggcaggagaatcgcttgaacctatgaggcggaggttgctgtgagctgagatcatgccattgcactccagcctgggcaacaagagcaaaactgtctcaaaaaaaaaaaaaaattcagtgtttgtgtaagcagagtaattctagatcacttcatgtaaagcatctctgccagaaagcatgaaatataatgctcctagtctgggttgaacagaactaactcttgataacataaacatattatgttatccccagagcagatttcccagttaagggcatttgccatgaagtcaagcaataagtaagacccaccaagtctattatttgcacaatagtctttaataaccctaggccatggagcactttgggtccaggaatggcaagaccagcaagaagatcactgactgtggacaactctaattaaagtttgactttttttttttatcttaatcaccggagcattccttctgccgctctggaaagcaccctccaccacatttggtcgcagtatcctagaatctttgtgctctcgctgcagttccctttgggttccatatgttccttattcccatccatgcctagctggattgctgccgagaccagcttggtcgtggagaccctaacccaacggtgctagaggaattaaagacacacacacacagaaatatagagtgtggagtgggaaatccgggatctcacagccttcagagccaagagccttaaacggagatttacccacatatttattgacagcaagccagtcataagatttactaaaagtattcctcatggaaaatgaagggatgggccgaaataaagggatgagcctggctagttatccacagcgtgaacatatgcttaaggcacagatctctcatgctattgttagtggtttaagaataccttaaacggttttccaccctgggtgggccaggtgttccttgccctcatcctggtaaactgatgactttccagcatgggtgtcaaggccatcacaagcatgtcacgacgctgcagagattttgtttatggccagttttggggccattttatggccagattttggggcctgttcccaacagattgcagagttaagtttatgattatgaaataaaaactaaataataaaacaaaaagataaattcaggagagaatatttgtaggatatagcaaaacctaaaaaacggagcacaggacttagatcacacctacaacaataatacatcattatgtcagtatcaagtgatgctgtttcctgtgctttcatagacattttcaagtagcctgcaaaagaaccctacattatatgaaattagtatttttggtattttcagaagagcacaagttatttgttttcctaaaaaagtacagagctgcatagcagaacatgtgtccatgtatcctgatttctagaaaagaaaaagaacattttgctgaaaaagccactgtgggccgggctcagtggctcatgcctgtaatcccagcactttgggaggccgaagcgggcagatcacgaggtcaggagatcgagaccatcctgggtaacacggtgaaaccccatctctactacaaaaaaaaaaaaaaatcagctgggggtggcagcaggcgcctgtagtcccagctactcaggaggctgaggcaggagaacggcgtgaacccgggaggcggagctttcagtgagctgagatcgcgccactgcactccagcctgggcgacacagcgagactctgtctcatttaaaaaaaaaaaaaagatttctctttctgaaacactttatactttacaggaagcacttccatctgttctactacttctcctcctctctcccatcccccaaaataataccatctaattcagaaaaatcagaaaaatggcttagtatagacaaggcagtgtctcakagargaaatgatatggctaggactaarggagaaggaccctgtccttcaaagaagaaagagagatttctgtttctttgaaagatttaaagttagaagagtcagaggatttaaagttagaagagtaagaagaataaaagcataagaaacatctggatgaaagagggtccctgaaacttctcagttgcttgctgatttacatgccattaaactttttctgacaactgtaacccagcttatagtctttgaaaatgagtcatatttatcatcagtagcacatattagggactcagtcatatgttattaagtagcatttctttagtattttgttactggacttttcatatgtgaatatcttacgttctgaaatgtttcccttgaagtcaaagaaaacaccttcacatatggttcctatagtgtctaacatgctgaaggtttgcacagtcaggtttcttctgataaaaaaacaagcaaactatatacacatatacaaactatatacatatatgtgtataatattatatgtatatagtattatatatattatatatatgtatatatatacaaactgtcaggcctctgagcccaagctaagctatcatatcccctgtgacctacacatccaggtggcttgttcctgccttaactgatgacattccaccacaaaagaagtgaaaatggcctgttcctgccttaactgataacattgtcttatgaaattccttctcctggctcaccctggctcaaaagctcccctactgagcaccttgtgacccccattatgcccgccagagaacaactcccctttgacagtaattttcctttacctacccaaatcctataaaacggccccacccctatctcccttcactgactctcttttcggactcagcccacctgcacccaggtgattaaaagctttattgctcacacaaagcctgtttggtggtctcttcacatggacgtgcatgaaatttggtgccgtgactcagatccggggacttcccttgggagaccaatcccctgtcctcctgctctttgctctgtgaaaaagatccacctacgacctcaggtcctcagaccaagcagcccaaggaacatctcaccaattttaaatcgggtaagcggcctcttcttactctcttctccaacctctctcactgtccctcaaccactttctcctttccactcttcaatctctcccttctcttaatttcaattcctttcattttctggtaaagacaaaggagacacgttttatccatggacacaaaactccggcgccggtcacggactagggaaggcagccttcccttggtgtttagtcattgcagggacacctctctgattatttacacacgtttcagaggtgtcaaygcaggagggacgcctgcattggtccttcacccttagcggcaagtcccgcttttctggggaaggggcaagtaccccaaccatttctctccgtgtctctaccccttctccacctttctggggggcaagaaacccccaaccccttctccttcactcttagtggcaagtcccgcttttgtagaggaggggcaagtaccccaaccttgtatctctgcgccccaatcccttatttccgtggcccaacctcttatatctctgcgccccaatcccttatttccgtgccccgacctcttatctctgtgccccaaccccttatttccatgccccgacctcttatctctgtgccccaccccttatttccatgccccaacctcttatctctgtgccccaaccccttatatctgtgccccaacccctttcccacttttctggaaggtaagaacccccgaaccccttccctccatgtctctactctcccttttctctaggcttgcttccttcactatgggcaaccttccaccctcctttcctccttcttctgccttggcctgtgttctcaaagacttaaaacctcttcaactcacacctgacctaaaacctaaatgccttattttcttctgcaatgctgcttgaccccaatacaaactcaatagtagttccaaacagccggaaaacggcactttcaatttttccatcctgcaagatctaaataattcttgtcataaaatgggcaaacggtctgaggtgcctgacaaccaggcattgttttacacatcagtccctccctagtctctgtgcccagtgcaacttgtcccaaatcttccttctttccctcctgcctgtcccctcagtaccaatcccaagtgtcgctgagtctttctaatcttccttttctacagacccatctgacctctcccttcctccccaggctgctcctcgccaggccgagctaggtcccaattcttgctcagcctctgctcctccaccctataatccttttatcacctcccctcctcacacctggtccggcttacagtttcgttccatgactagccctcccccacctgcccagaaatttactcttaaaaaggtggctggagctaaaggcatatagtcaaggttaatgcgccattttctttatcccaaatcagatagtgtttaggctctttttcatcaaatataaaaactcagcccagttcatggctcgttcagcagcaaccctgagacgctttacagccctagaccctaaaaggtcaaaaggccgtcttattctcaatatacattttattacccaatctgctcccgacattaaataaaactccaaaaattaaattccagccctcaaaccccacaacaggatttaattaaccttgccttcaaggtgtacaataatagaaaaaagttgcaattctttgcctccactgtgagacaaaccccagccacatctccagcacacaagaacttccaaatgcctgaaccacagtgtccaggcattcctccagaacctcctccggcaggagcttgtacaagtgccagaaatctgaccaccaggccaaggaatgcctgcagcccaggattcctcctaagccgtgtcccatctgtgcaggaccccattggaaatcagactgttcaactcacctggcagccgctcccagagcccctggaactctggcccaaggctgtctgactgactccttctcggcttagcagctgaagactgacgctgcccgattgcctcggaagctccgtagaccatcacggatgccgagcttcgggtaactctcacagtggaagttaagtctgtccccttagtcaatacggaggctacccactccacattaccttcttttcaagggcctgtttcccttgcctccataactgttgtgggtattgacggccaggcttctaaacccctgaaaactcccccactctggtgccaactaggacaacactcttatgcactcttttttagttatccccacctgcccagttcccttattaggccaagatattttaaccaaattatctgcttccctgactattcctgggctacagccacatctcattgctgcccctctccccaacccaaagcctccttcgcgtcttcctctcatatccccccaccttaacccacaagtatgggacatctctacttccctggcaaccgatcacatggccgttaccatctcattaaaacctaatcacccttaccccgctcaacgccaatatcccatcccacagcacgctttaaaaggattaaagcctgttatcactcgcctgctacagcatgggcttctaaaacctataaactctccttacaattcccccattttacctgtccgaaaactggacaagtcttacagattagttcaggatctgcgccttatcagccaaattgttttgcctatccaccctgtgctgcccaacccgtacactcttttgtcctcaataccttcctccacaactcactgttccgtgcttgatcttaaagatgcttttttcactattcccctgcacctctcgtcccagcctctcttcgctttcacttagactgaccctgacacccattaggctcagcaaattacctaggctgtactgctgcaaggcttagtagacagcccccattacttcagtcaagcccaaatttcatcctcatctgttacctatctcggcataattctcataaaaacacacgtgctctccctgctgatcatgtccgattaatctcccaaacctcaatcccttacaaaacaacaactcctttccttcctaggcatggttagcgcagtcagaattcttacacaagagacaggaccacaccctgtagcctttctgtccaaacaacttgaccttactgttttagcctagccctcatgtctgcatgcagcggctgctgctgctttaatacttttagaggccctcaaaatcacaaactatgctcaactcactctctacagctctcataatttccaaaatctattttctgacccacacctgacgcatatactttctgctcccgggctccttcagctgtgcttactctttgttaagtcccacaattaccattgttcctggcccggacttcagtccggcctcccacattattcctgataccacacctgacccccatgactgcatctctctgatccacctgacgttcaccccatttccccacatttccttcttccctgtttctcaccctgatcacacttagtttattgatggcggttccaccaggcttaatcgccacacaccagcaaaggcaggctatgctatagtacaagccactagcccgcctcttagaacctctcatttcctttccattgtggaaatctatcctcaaagaaataacttctcagtgttccatctgctattctactactcctcagggattattcaggccccctcccttccctacacatcaagctcaaggatttgcccccacccaggactggcaaattagctttactcaacatgccccgagtaagataactaaaatgcctcttagtctaggtagacactttcactggataagcagagtcctttcctacagggtctgagaaggccaccacagtcatttcttcccttctgtcagacataattcttcagtttagccttcccacctcwatacagtctgataacagacgagcctttattagtcaaatcagccaagccttttttcaggctcttagtatccagtgacagactaatggtctattaaaaacacacctcacgaagctcagccaccaactcaaaaaggactggacaatacttttaccactttcgcttctcagaattcaggcctgtcctcagaatgctacaagrtacagcccatttaagctcctgtatagacgctcctttttattaggccccagtctccttccagacaccagaccaacttagactgtgcccccaaaaacctgtcatccctactatcttctgtctagtcatactcttattcagcgttctcaactactcatacatgccctgctcttgtttacactgccagtttacactgtttctccaagccatcacagctgatatctcctggtgctatccccaaaccgccactcttaactcttaaagtaaataaataatctttgctggcaaggctatgctgaaccttcttaggcactctctaatgagatgtcctaggtcctcccaattcttagtcctttaatacctgtttttctccttcttttattccatttagtttttcaattcatacaaaactgtatccaggccatcaccaataattctaaatgacaaatgtttcttctaacaatcccacaatatcaccccttaccacaaaatctcccttcagcttaatcgctcccactttaggttcccacgccgccccaatcccgcacgaagcagccctgagaaacatcgcccattatctctccataccctcatccaaaattttcatcatcccaacactttaccactatttcgttttatttttcttattaatataagacaggaatgtcaggcctctgagcccaagctaagccaccgtatcccctgtggcctgcacgtacacatccagatgacgggttcctgctttaactgatgacattccaccacaaaagaaatgaaaatggcctgttcctgccttaactgatgacattgtcttgtgaaattccttctcctggctcatcctggctcaaaggctcccctactgagcaccttgtgacccccactctgcccgccagagaacaactgccctttgactgtaattttcctttacctacccaaatcctataaaacggccccacccctatctccctttgctgactctcttcggactcagcccacctgcacccaggtgattaaaagctttattgctcacacaaagcctgtttggtggtctcttcacacggacgcgcatgaaaggaatagtattttccaagtacacatctaaactcctgaaattcttctgttcgacatgtttgccctttgaaatcatgtttttggagtatttcaagctaaacttaatatcaggtcctgcttctcatagttcaagtcgcttgatccctatcttttttttttttcttgagacggagccttgctctgttgcccagactagagggcagtggcaccatctcggctcactgcaatctctgcctcccaggttcaaatgattctcctgcctcagcctcctgagtagctgggattacaggcgcctgcaccgtgcccagctaatttttgtattttttagtagagacggggtttcaccatcttggccaggctggtctcaaactcctgacctcgtgatcagtggctcacacctgtaatcctagcattttggaaggccgaggcagacagatcacctgaggtcgggtgttcgagaccagcctgaccaacatggagaaaccctgtctctattaaaaatacaaaattagccaggcatggtggttgtgcgcctgtaatcccagctactcaggaagctgaggcaggagaatcgcttgaacccaagaggcagaggttgcagtgagctgagattaaaccattgtaatcccaggtacttgagaggctgaggcaggagaatcgcttgaacctgggaggtggaggttgcagtgagctgagatcttgccattgcactccagcctgggtgacagggcaagactctgtctcaagaaaaaaaaaaaagaaagaaaaaaataaaataaaatatttgtctagtaaatctaacatcttattaccacaggaaaaagatagtgattggtgatattatgtagctttatctaaatatctagttttgaaaaatttatttcccacttattcttttaaggcagtcaacaaaaatgtattgaatgcttactatgtgccagatattgctgaattttaaggaaaccttttgttcctttctcccatcaaccctttcatagatttctttttctggctgggtgcggtggctcacgcctgtaatcccagcactttgggaggcccaggagggcggatcacaaggtcaggagatcaagaccatcctggctaacacggtgaaactccgtctgtactaaaaaatacaaaaaattagccgggcgcagtggcgggcgcctgtagtcccagctactcaggaggctgaggcaggaaaacccgggaggcggagctggcagtgagctgagatcccgccactgcactccagcctgggcgacacagcgagactctgtctcatttaaaaaaaaaaaagatttctttttctgaaacagtttatactttacaggaagcacttccatctgttctactacttctcctcctctctcccatcccccaaaataataccatctaattcagaaaaatcagaaaaatggcttagtatagacaaggcagtgtctcagagaggaaatgatayggctaggactaagggagaaggaccctgtccttcaaagaagaaagagagatttctgtttctttgaaagatttaaagttacaagagtaagaaggatttaaagttagaagagtaagaaggataaagmataagaaacatctggatgaaagagggtccctgaaacttctcagttgcttgctgatttacatgccattaaactttttctgacaactgtaacccagcttatagtctttgaaaatgagtcatatttatcatcagtagcacatattagggactcagtcatatgttattaagtagcatttctttagtattttgttactggacttttcatatgtgaatatcttacgttctgaaatgtttcccttgaagtcaaagaaaacaccttcacatatggttcctatagtgtctaacatgctgaaggtttgcacagtcaggtttcttccaataaaaaacaagcaaactgtatacacatatacaaactatatacatatatgtgtataatattatatgtatatagtattatatatgtagtatatattatgtattatataatacattacataatacatatataatgtattatataatacacatatataatacattatatatgtattatgtaatacattatatatgtattatataatacactatatattatataatacattgtataatacattatatattgtattatataatacattatatatgtgttatatatacatatataatacacatatattatatatatgtgtcatatattatatatattatatatgatgtgtattatacatatataatacacatatatgtattatacatatataatacatatatgtgtattatataatacattatataatacacatattttgtattatataaattatataatacatatattatgtattatatatatgtatatatatacaagctgtcaggcctctgagcccaagctaagccatcatatcccctgtggcctgcacgtacacatccagatggccggttcctgccttaactgatgacattgtcttgtgaaattccttctcctggctcatcctggctcaaaagctcccctactgagcaccttgtgacccccactctgcccgccagagaacaacccctctttgactgtaattttcctttacctacccgaatcctataaaacgaccccaccccatctcccttcactgactctcttttcggactcagcccacctgcacccaggtgattaaaagctttattgcttacacaaatcccgtttggtggtctcttcacacggacgcacatgaaacaaactatatatgtgtatgtatatagtttgtatatatgtayatactttgcttgtttatttttttttgagatggagttttgctcttgttgcccaggctggagtagtggcacgatctcggctcactgcaacctctgcctcccaggttcaagcgattctcctgcctcagcctccctagtagctgggattacaggcatgtgctaccacacccggctaattttgtatttttttagtagagacggggtttctccatgttggtcaggctggtctcaaactcccaacctcaggtgatccgcccacctcggcctcccaaaagtgctgggattacaggtgtgagctactgcacccggcttgtttatatatattattttttaaatctctcagggtgtggggcagggcctgccccacaccctgagagatttataattggctcacatgattgtggaggctggcaagtccaatatctccagggcaggctggaccctatttccaaattaagtcacacttggagatcctaggagttaggacttcaacatataaattttgagggggatacaatttatcccatagcagtgttcaataaatatttgttggaaaaaaaaggtttttccccctaggtataatctgagcatgtgatctccatgtttcttttttccctctttgaactttcagttttctgtcatttctgactttaggaagccaaatgttggtttatgtgctgtctaagcatgggtggggttgggtagcacccttattttccctgatgcattcatatgcaaactttggtacattgcatattcacttgaatacatttgaaaaaggaacagagtgaagcctataattagtaagaaggagggaggagacagtggcaagcaaggagtggccccagcttctgcttgttctttcttttcttttccttagtgttgtgtcttggtttgattagccccatgctctctggaggtagaacctcaaatcaacagtcctgggtggaacagaaacaggctcttctcctctggcctcccttgcagtgaggagagcagaaaactgacttgctgagaatagcatcccttagcagacaggactaagctgtctcctgggaggttaccaagtaaagtgggctaatagtttttggaaagcccttcgtggaaaagcaaaatagtcaaagaagatgttcacagatgtaagaccaaagactacctgtgaaaaatagaaataatatggaaatgcgaaaataatacccttgagcagaatggtgtgaaacaaagtataaaatacacagaaatgagtgaggaaggctgggataatataaagacagaagacttccaaatacaccagaatgaaaacattttctttagctgtactgattggcagttatcatcactaattttttggcaygaataaattggaaatttatgtcagcacccttggataataattaaaaaatatatattataggccgggcgtggtgtctcacacctgtaatcccagcactttgggaggccgaggtggatgattacctgatgtcaggaattcgagaccagcctgaccaacatggtgaaaccctgtctctactaaaaatacaaaaaaaattagccgggggtggtgggggggcgcctgtaatcccagctacttgggaggctgaggcaggataatcacttgaacccaggaggcggaggttgtcgtgagctgagatcgtgccattgaactccagcctgagcaacaagagtgaaactctgtctcaaaaaacaaacaaacaaaaamtatatatatatatatatatatatatatatatatatatatrttatgcctaatatgtagcataacatgataatatataaktgatgtaattcttactccagaaatacttctattatttacaataaaggtccaagtgtaagaagcctkcgaagtaacatattatggtgtctatctaagctaaaagtctcaagtcaggattctgatacccagagcaaatccaagcacgctaacccctttacagaatagccttccacacggctccgtttcgcccatatgcaccacatgagatgtcaacagtagggttttatgcagcctaactttgggagattattaaaccctggacatttcctcccaccaaattccagacaggttatcagactgatagctgcatttaaatagattttaaaatggatcagaagagataaaaatcactggtgggccgatttgactgatggaagtggtaaagggmgtcagcagctctagctggaggggcactcaccatctacggaggagtgggtgttcacagacctgggcgattgctcttagcaggaagagtgatgggaaccaaggaaaacaagaccgcagtggctcatgccggtcatcccaacactttgggaggccatggtgaaaccctgtctctactaaaaatacaaaaattaccccagcrtggtggcgcgcacctgtaatccctgctactcaggaggctgaggcaggagaatctcttgaacctgggaggtggaagttgcagtgagctgagatcacgccaccgtactccagggtgggtgacagagcgagatcctgtctcaaaaaaaaaaagtttatggagtttatgtagagtggtagagtgacccaaaactcaattgaatatactggttttccctgtgtccaaatcaaacagagcctccagagaccatcacaattttacaacctaaccaagagacggtgcgtgcatgtatgtatgtgcctagtgtgtgtgaattaggggaaacatggagaaattgtttataattcttgaatctattctttgatgtgtttcattatttttggaaaattctcatttcttgtctcttcaaacatgtcttctgcttgttctttctcgtttctccttctaagattctgayaatatgtatgctaagccatttgatattgttttatagcacttgaagataattcaagtgctataaaaattcaaattatttgaaaagaattcaaatgattttcactcttttttcttgttgtgtttgtttgggtaatttctattgacctaacttcaaggcaatcgattatttcctcagctatattcgtattgtcaaggttattaatgagcctgaagaaggagctgctcatctctgatacagcattttctttttttttttttttttttttttgagacaggattttgttctgttgcccaggctggagtgtagtggtgcgatctcagcttgcttgcgaccttggcctcctgggctcaagtaattctcccacctcagcctcccaagtagctgggactacagatataagtcaccacacctagctaatgtctttatcttacatagacacaaagtctcctcactatgttacctaggctggtctcacactcctgggctcaagtgatctttttgccttggcctcccaaagtgctgggattaataggcttcagctactgttcctggcctgatattgcatatcttatttttgaaacttctataaagtctgtcatgtttagtatttcaggaagtcgatcacttccacctttcttttgaaatccacccctgacaccatctcctcatgtctgttgtccttttttttttttttcatgagctcctttgacatatgactcctgggcattttaaagtctctctcttttattataacatggagggcagctctgagcctggttccattgattactttgtatcttcacaggatgttgttgtcatcttcttcttcttttgatacaacttgtaatttttcattgattgccaaacatcttgtgtagaacaggagagatttaaataaatagtatttgtgactagaaatggacacacctcttctcaggcagttagcttggtggattgagttaatctagttaaaaggtgaactgtgcaggttttgtaattgccaagtttactttcggtacatcataggcttcaaattccttttgtgatgccttatgcttagggtggcatctggagtgctggctatttctcagtgtttgtgccccaccctcagctctcgttctcctctgtacaccacacagcagaccccacagaggtcgtctctctgcacgttcatgccctctgccagtggcggactgcttagttacttggtgctcttgctcgggtaatggtgaggggacagggtgcttctctgttgccctcttcatcttctatcttaggtaggtttatatgcctgggccctgggggatgagtatttctgccccactccttatgccaggctgccaaaccctgctttgaatttgtggctggtcttgggtgggaaagatttttttgtgctcctccttcagtttcaggagacctctaaaagtattagcttagaactctgggctcacaattgctccttgtccctccctcggactagggtcctccctgctcttcccttggtaacacctgtgccctgggagcaacagtatttgccagtcctccccagggtcttaaggctttcgagagaggagcatgggcagctggggccttttctgcaatgatagcaaatacggtccttgatgcccatagtactgagggggctctttgtagtctcccacttggcccccagtatttcctgtgaacacctggtagaggtcatggaaaggagcctgtgggtaagtaaagccctccttgcttctgtgacacccagaggctccttatagtcactctagtctgcactaggcctctagcaatttatgaaaaatgtagctgctttcttcttgcatgcttgtatgatggccyaaatacctcccatactctggcactgatgagacactccacccatctggtctctgctcatgaggattgcatgtccttgaatttcaggctacttagcttacctgcaacctcagctcagctgttttgttttcttttgttttgttttgtgatggagtcttgctctgtcactcaggctggagtgcaatggcgtgatctcagctcactgcaacctccacctcctgggttcaagcaattctcctgcctcagcctcccgagtagctgggattacaggcatgcaccaccatgcctggctaatttttttgtatttttagtaaagacagggtttcaccatattggccaggcgggtctcgaactcctgaccttgtgatctgcttgcctcagcctcccaaagtgctgggattacagacgtgagccaccgcccccggcccagctcagcatttaggttcaacttttggtttaagaaaagtgattttgcagtttgtctggctttttcatattgtcagagagggggcaatgcactttccagcttatttttattttttattcttagagacagggtcttgctctgttgcccaggctggagtgcagtggcacaatcatggctcactgcagacttgaagtcctgggctctagtgatcttcctgcctcagcctcccaagtagctgggcatgtgacaccacacctagctaacttttaatttttttttttggtagagatggggtcttactatactgcccaggttgatctcgaactcctggcctcaaacaaccctcccaccttgccttcccaaagtgttgagatcacaggctcgagccaccaagccacactctttctagcctttcaaattccaagttaaagtggaacttgccacatgtcgttttgtatcactttccccaacccctttcttttcttttttttttttttttttgagacggaatttcrctcttgttgcccaggctggagtgcaatgttatgctctcagctcactgcagcctccacctccccagttcaagtgattttcctgcctcagcctcccgagtagctgagattataggcgcccaccaccatgcctggctaatttttgtatttttggkagagacagggtttcgccatgttgactaggctggtctcgagctcctacggatcggcctcccaaagtgctgggattacaggtgtgagccgctgcaccagccccaacccctttcaattagcattgcaaataattccccttatcatgaaaacattatttttaatggcagcagagtattgctttatattaacatgacagtttattcaaccgaactctttatggggcattgyaatagacttaatgttttatgtttgcagctctttacaccaacacttttcctactgtagtgatttctttgaacaatttcccctccccaactccctgtggttctaaaggggtggccaatcacagtaccccatcaccctggcctttaggtgggagaatgacccaggccctgcctatcataccctcctgactacagtgactgattcagaggtgagccagcgagagagggaggaacacagtccttcttcgggaatttctataacataggtgaaaaattttgtcagttggggtcgtggagctgaacgaatatggcttgagggctcccagctgccgtcctccctacgacttgaagaaaagcttgtgtgcagtaggagaaaatgaaccaatcagagacaagtacacaagagagaaggactgggaggagtcggccctggctgcaccacgtctccactcctgggctgtcaagtttttcaaggtgctctggttccataagctcattcttcctgttggatccattccagttaccaaaaacacttttttgtttaggctggtttgatataggatgatcattggtcccagagagcatcctggctaatctattttattattttattttatgagacaagttctcactgttgcccaggctggagtgcagtggtgctatcatggctcattgcagccttgaacccctgggctcaagcaaatcctaccatctcagcctccagagtagctgggactacaggcgtgcaccaccacactcagctaattttaaagaaatgttttatacagactgaaactgcctttgcaaaattgtaacaggaaattatgacagtgcaagaagtcagacctaaccgactctatcttgcttctaacccttaagctgtccttgtttattcctgggcataggccgaagtaactttgggaaggaattcagttcatggtttgactctgaaacaaaattgataacagccctttcccaaaaagacccccttcttgcccggggtccagtctgcctttgtaggactaacagattagctacaagattagaaattacagtttagaggccgggtgcagtggctcgcgcctgtaatcccagcactttgggaggccaaggcgggcggatcacgaggtcaggagatcgagaccatcctggctgacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccattgcactycagcctgggcggtagagccagactctgtctcaaaaaaaaaaaaaaagaaattacagtttagaggtcatgcagcctctggctccaagagtctgaacctccccaaattgctcctggggataacatcactgctgtaaaacctaagatcagtaattgagttattttgcaggccctgcactccatgggatcagctgacaccacacagaccagtcatctggcccaaccagttctgccatctcacccaggaacagaagacattaagaaaatctaacttcgaccctctatgattccatctccaacctgagcaatcagcactccccacttcccaagcccctacctgccaaattatctttaaaaactctgatccacgaaggctcaaggatttaagtaataataaaactccagtctcccrcacagccggctctgcgtgaattactcttttgccattgcagttcccctgtcttgataaatcggctctgtctaggcagcaagcaaggtgaatccattgggtggttacaaaacggggtctcactatgttgcccaggctggtctcaaactcttgggctcaagcaatcctccagcttctgactcccaaaagctgggattataggcatgagccactgcacttagactaatttatattttaggtgacttctaagtattaccatcataaagaacactgtgggctgggcacggtggctcatacctgtaatcccagcactttgggaggctgaggtggtccctggagctcaggagttcgagactagcctgggcaacatggtgaaaccctgtctctattaaaaatacaaaacaattagccaggagtgttggtgcctacctgtggtcccagctactcaggaggtggaggtgggaggatcgcttgagcccaggaggtcaaagctgcagtgggctgagattgtgccactgcactccagcctgggtgataaagtgagactctacttcaaaaaaataaaaaataaagaaaagaaaaaaaagaaagaacagtgtgaaaaaactcagtgttacacttgtgcatacatgcatgctgtcctttttttcctcattaagaaacatttccagagtaggagttgctgagtgaaagaatatgcaaatctcaaaggctttggtgtgtattacaaaattgccatgagaaagttatccacattctattttctctaggactgtgtgtgtccctatttccatacagtcacaacaatactgagtagtattaattttttttttttttttgagacagagtctcgttgtgtcacccacgctggagtaaagtggcatgatctcggctcactgcaacctccacctcccgggttcaagcgattctcctgcctcagcctcccaagtagctgggactataggcacccaccactatgcccagctgatttttttttctttgtatttttagtagagacagggtttcactatgttggccaggctggtcttgaactcctgacctggtgatctgcccacctcaaccccccaaagtgctgggattacaggcgtgagccactgtgaccggccaagtttaccgcttttctattgaaactgttctcatacccgtgttcccaactacaccttaattgaataataaaagaaaataaggacattaaatgagaacaggaattggaatgagaccagaaaaaaagggaggagttcaaaatatgttctgagagctttaccattatgaatactcagctctggttttccyccaaaactggctgaaccagtatggatgttccaggcagaaacaactttaaagaagtgaatagtggccctaccctggtccaccacctaacctggtggttacagaaggaggaacacagtcctcctgtgttccaggtgccaggaggtgactgactatagcatcagtcatcactgcacaccctacctggaattagtatataaagctacgcggagcgatctctgcccctgaccctggaaaaatctgtctcacccacaaagatgtgggctcagctccttctaggaatgttggccctatcaccagccattgcagaagaacttccgtgagtgcttggtgtcagaattggtttattagggcagcggcttcttcgcctaactttctcaaacatttatatggagatggggagatcaactttggtttatcttaatttcctcctccttttttctcttctttggttccactgatcctttacccagagagggaggctgacgcatgaagaggaagctttaaaaaagataaatattaaaatgtgccctgttttctgaaataggcctaatttcctccttggtgctctaggcatgtgtgctcggtgagggcctcctgatggcggaagttgargactgtgcactgagtcgttgcccctctgcttcttgtagaaaatgaggtgcataaggaaggcaggggcttggtctgtctaattcactgctacttgctgagcgcttaggagagtgctggatttttcgagtgaatgaatcattattgccctgaaatccttctgctcctttaatagaaactacctggtgacattaccagcccggctaaatttcccctccgttcagaaggtttgtttggacctgagccctgggtacagtgatgttaaattcacggttactctggagaccaaggacaagacycagaagttgctagaatactctggactgaagaagaggcacttacattgtatctcctttcttgtaagcacagactcagccctcactcgaatcccttacttgcctattctcctccctaggctcactataatctactttaagtataatttctgttatcttttgccacggcctctaaacctattttttctcaacttaacctcaatccccggctataactcacccacggtttcctcgacctaggatttctccctttagttcctgaccttaattcttcctcgtggtaatttgttttatgtctctatccttgctacccccatctaactcagctctttcctttaactcactgttgggttgagaccagttgattctgttcccccaatcccttacccctccccagaagtcccctttcttggtcaggtaccacctcctgctggtggcacagaagaagtggccacaatccgggtgtcgggagttggaaataacatcagctttgaggagaagaaaaaggttctaattcagaggcaggggaacggcacctttgtacagactgacaaacctctctacaccccagggcagcaaggtaagagtcacatatttggggttcgactaaaacctggggaaaccgctgtgcacaggggtaaagaggggatttgtggtttgacagtaggctttggaaaaaaaggagtgcagaggagaggaaaatctggggggattaagtagtgcaagtgttgaatacatgctgcgctacacaagcaagagaagtaggtgggggttgctactgagtttgtgtatctaaaacaaaagtacacatttcttctggaatagaatttggcaagtataactgggttgctgggccttacaacaaactgcttgtaaatggctaagaaagcactgagggcatttggcttgagctactggggttttttttttttttttttttttttttggatttgttcattcgtccttacaggggcacttcattctgagatttcaaagtcaggcaccctgaaaagaaactatgtttgggttttttttatttttttatttaaaatttttgtgggtacatagctggtgtatatatatttatggggtagatgagatatttttatacacacacacaatgtgtaatcattacatcagggtacatgtgtatccatcacytcaagcatttatcatttccttgtattacaaacaatccaattatactctcttagtaatttttaaatgtgcaataaattattgttgactgtagtcactctttgtgctaaaaactacaagatccctagatcttattcattctagctaaatatatttttgtacccattaaccattcccaccccacccctcatcctgcccaccattacccttcccagcatctggtaaccatcattctgttctctctctctctttcaaaaaaatttttttccttttaccttatttttttccacacacttaaaaattattattctattctctatctccacgacttcaattgttttaatttttagctcccacaaataaatgagaacatggaaagtttgtctttctgtgtctggtttattttacttaacataatgacctcctgttccattcaggctgttgcaaaggatggggtctcattcttttttatggctgaatagtactccattatgtatgtgtaccacattttttaatccattttttatcatctgttcatagacacttaggttgcttccatatcttggctattgtgaatactgatgccataaacatggcagcacagatagtctttgatatactgatttcctttcttttgtatatatacttagcagtgggcttgcaggattatatggaagctctatttttagtttttttcagaaacctccaaactgttctccatagtggttgtactaatttacattcccaccaacagtgtatgagggttctcttttctccrcatcctcaccagcatttattattgtttgtcttttggaaaaaagccattttaactggggtgagataatatctcattgtagttttgatttacatttctctgacagtcaatgatttgagcaccttttttatatacctgtttgccatttgtatgtcttcttttgagaaatgtctattcagatctttttgcccgttctttaatctgattactagatgttttcctatacagctgtctgagctccttatatattctggttattaatcccttgtcagatgggtagtttgcaaatattttctttcattctgtgggttgtctctttgttgattgtttcctttgctgtgcagaagctttttaacttgatgtgatcctgtttgtccatttttgctttggtttcttgtgctccttgggtattactcaagaaatctttgcccagaccaatgttctggagagtttccccaaagttttcttatatataatagtttcatagattgaggtattagatttaaatctttcatccattttgacttgatttttctatatggagagagatgagggtctagtttcattcttctgcatatggatatccaattttcccagaaccatttattgaagagcctgtgctttctccagtgtatacacttgtcacctttgtcaaaaatgagttcaccctagacatgtttctgggttctctattctgttccattggtctatgtatttgtttttatgacagtaccatgctgttttggttactatagctttgcagtataatttgaagtcatgtaatgtgattcttccagctttgttctttttgttcagaatagatttggctattttaggtcttttatggttccataaaaattttatgattttttttacaaaagtcctaagatttaggatgtagaatttctgtgaagaatgtcattagtattctgatagggattgcaatgaacctgtagattgccttaggtagtacggaattttaacaatatcaattcttccaatccagaaacatgaaatctcttttcatgtttttgtgtgtcctcttcaatttctttcatcagtattttatagtttttattgttgagatctttcacttctttggtaaagtttattcctaggtattttatattatttatagctattgtaaatggaattatctttcttaatttctttttcagattgttccctgttggcatatagaaatgttactgaattttttttgtttttgagacagagtctccctctgttgcccaggctgtggagtgcagtggcgggatcactgcttactgcaacctctgcctcctgggttcaagtgattcttgtgcttcagcatcccaagtagctgggagtacaggcatgcgccaccatgcccagctaatttttgtttttgtttttttgttttttgagatggagtctcattctgccgcgcaggctggaatgcaataaatggttgctcattgcagcctctgcctcctgggttcaagtgattctcctgcctcagcctcccgagtagctgggtttacaggtgagcgccaccacccctggctaatttttgtatttttggtagagatggagtttcgccatgttggccaggctggtctccaactcctgacctcaagttatcctccccactcagcctcccaaagtgctggggttacacgcgtaagccaccacgtctgtcttcttgcacttttaggattcttttttgttttttattccttgatgtttgggagtttgattattaaatgtcttgaggtagactcatttgggctaaatctgcttggtgttctataatcttgtaattaatattgatatctttctcagctgggctcagtggctcatgcttgtaatcccagcactttgggaggctgaggtgggcaaatcacctgagatgagtatttcgagaccagcctggccaacatggcaaaaccctgtctctactaaaaataccaaattagccaagcaaggtggcctgtgcctgtaatcccagctactggggaggctgaggcaggagaatcacttgaaccagggaggcggaggtcacatgagccaagatcacattactgcactccagcctgggcaacagagcgagactgtctcaaataataataatattgatatctttctctaggtttggaaagttctctgttattttcactttgaataaactttccatctcattttctctctcaacctcctctttaaagtcaatacctctttttttttctctttgttaaatttatctgataagattctgmattctttctctgtgttatctaaaattttgttgagtttcctcaaaacagctattttgaattctcgatctgaaagatcactatctttgtttctgggagattggttgctggtgccttatttagttcatctggtgaggtaattttttccaacatggtcttgatgtggatgttcattggtgtctgggcattgaagagttaggtatttattgtagtcttggcattctggacttgtttgtacctgtcctccttgggcagactttccaggtatttgaagggacttgggtgtcgtaatctaagtgtttggactctgcagttcatctgcattagggaggaccccatgctcagtatctctgtggctcttgaagcctcatagaggtacctccttgatggtcttggataagatctggaagaattccagattaccaggaggagactcctgttctcttcccttactttctccaaaacaaacagagtttctctctttgtgctgagctgcctggagagaggggtgacacaagcacccctgtggccaccagcattgggactgcactgggtcagatctgaagccagcaccgtactgtgtctcacccaaggcctgtggtaaccagtacctggctactgcccatgtttgctcaaggccctagggctctacagtcagcaggtgacaaagccagccaggcttgtgtcctccccttcagggtggtgagttccccatgaccctggaaggtccagagatgtaatctgcgagccagggcctggagtcagaaaccttaggaatctacctggtgttctgttctactgcagctgagttggcacccaagccataagacaaagtccttcccactcttccttccccttttcacagaggagtctctctctgtggccaccactactccaggcccagaggagtactgcctggatacttccagtattctctcgaggcccaaagtctcctttcaccagcttgtggtgaatggtgcctggcctgggactctcttttcagggcagtgagctctcctctgacaaacagcaggtccagaaatggcatccaagagccacagcccataactggggaccccaagggcctgcttggtgctgtaccccactgtggctgagctggtacctaagctgcaagacaaagtccccttgactcttccctctccttttctcaagtagaaggagtctctccccatagtcaccacagctgggaatgtgctgaatcactggaagccagcatgtctctgagtctcacccaaggcccacgacaagtactgcccagctatcactgctgagtatttagagccccaggggctaatcggaactcagcttccaaccgctgggatgggcagttcacccctggctaacgctggtctaaatgctccctccatgggcactggctgagttctgccctgtgtgctttcccctgtgattgggcagcaytgcrttctaaagccaagtcccacagtcactgtgctctcccgccctcaagctcatcgattctgtctctgtaccacagtcactgctgggggatggcggggagggggtgaatcagcaattsaagtgtgtcttttctaccctcttcagtgcctctttcagtgatataaagttaaaaccaggcactgtgatcactcttctgatttttggttcttatgacagtgctgttttgcgtgggcagttgttcagtttggtgttactgtgggggatgaggagggtggtcaatggaggcttctattctgcctcttgctctgcctcctgagctccaggcctgygtttggactttaccttactctcagagcaggttttgtaaaaaagtaaaacctgttggggttttgctgactcagmgcatgtgtgaggaaggaggagggatagaggaaagattctgagcaggaggcsgagcgcggtggctcacgcctataatcccagcactttgggaggscaaggcaggtggatcacctgaggtcaggagttcatagaccagcctggccaacatggtgaaaccctgtctctacaaaaattagccaagtgtggtggcacctgcctgtggtcccagctactccggaggctggggtgggagaatcacttgagcccaggagtttgaggctgaagtgagccacggttgtgccactgcactccaacctgggtgacagagtgagaccctgtatcaaaaaaaaaaaaaaaaaaaaaattctgagccaggaaacatcccctttgctaatgatgcctgttcctttccagtgtatttccgcattgtcaccatggatagcaacttcgttccagtgaatgacaaggtgagttgggaggaggaraaggagtggcgcagggagaacagggaaaaggatgagagattctctagggtggaagtcctctcagcctgggcgtggcaaggcgaggccctctgggttggagactgctgtgtgcgtgggactggaagtgctgggcgagcttcagggagctagcctaaatcagcctaggaacaagcagaggtaaccagttctcagcttcagtatctacacattcatcaggttcttgagagatggttatgctccttgtcattttattttatttatttgtttatttagagacagagtctcgctctgtggcccaggctggagtgcaatggtgtgacctcagctcactacaacctctgcctcctgggtttaagcaattctcctgcctcggcctcccaaatagttggaattacaggcgcgcaccatcacgcctggctaatttttgtatttttagtaaaaacagggttacatcatgttggccaagctggtctcaaactcctgacctcaagtgttccacccacctcggcctcccaaagtgctgggattacagacaagagccaccatgctcagccccctttcattttaagagttttcgcaaacttcaagaccttttcttcaggactgacaaaagcattttttttttaaggcagaaaggagaatgtccgcttccactctgtttctatgaggcaaaataatttacaaagtaggtaattctcttagggcaacattaaataaatacatgccaaagcttaaaatgtagcaacattttgcgaatatttgatttttccttggactccccatccctagaatcataagccttaccacaggtttgatttcaagttggagcatgtgtcatttctacatgcttctgagacacttacctcccggacacccctgctttcttcctcttccgtctgtcccagcctgtgtattcaaatgaaacttttagagataaacatagagaaagcatgatttccattttccatctccgtgttctcagagctgctgtttcctttccctatgtgcaggggagttattagcttgttatgattggtaatgccctacccgctactctctttcccaatatagatttccttttacttcctccttcccatcacctatggcttttctttggtaggtataacgttgagtacttcttactttttttttttttttttaacattttaagacaaggtctcattctgtcacctaggctggagtgcagtggcagtcatggctcactgcagctttgaccctgccccgggctcaagtaatcttcccatctcagtctccccagtagctgggaccacaggtgtgcactaccacacctggctaattattttatttttttgtagagttgtggggggcgggggtctcaccttgttgcgcaggccggtcttgagatcctggcctctctcgctttggtctcccaaagtgttgggattataggcctgagccactgcacccggcctgagtgcttacttcttaacagactgttttctctagagctgcaacaaggaagtgctgggttcaaagcgtggcccgcagcagcactattttagactcacttaccctcagggttgatctcattaactacccctgttacgattcaaatgaagcgggattacttccaggtgttctgttttctgcagttaggctctttctcttgtgaaattactccttcctccccactctatttctccagccaaactctccctccaaattcagttgaaacactgagattaacaaaaggaattttaccaagaaagctaggataaaaattgtgtttatgtaaccacccaatgggttcaccttgcctgctgcttagacagggttgatttatcgagacaggggaattgcaatgaagaaagagtaactcacccagagccggctgtgtgggagactggagttttactgttactcaaatcagtctccctgagcatttggaaatcgagtttttttttgtttttgtttttgtttttttttgagacggagtttcattcttgttgcccaggctggagtgcaatggcgcgatctcggctcgccgcaacctctgcctcccaggttcaagtgattctcctgcctcagcctcccaagtagctgggattacaggcatgcgccaacacgcccggctaattttggtacttttagtagagacggggtttcttcatgttggtcaggctgttcttgaactcccgacctcaagtgatccgcccgcctcggcctcccaaagtgctgggattacaggcgtgagccaccgcgcctggccaggaaatcgagtttttaaagataatttggcaggtaggggcttgggaagtggggagtgctgattggtcaggttggagatggagtcatagatggtcaaagtgaggttttcttgctgttttcctcctcctgggtgggatggcagaactggttgagccagattactggtctgggtggtgtcagctgatccactgaatgcagggtctgcagaacatctcaggcgctgatcttgggttttacaacagtgatgttctccccaggagcaatttgaagaggttcagactcttggagtcagaggctgcatgacccctaaagtgtaatttctaatcttgtagctaatttgttagtcctgcaaaggcagactggtccccgggcaagaagggggtctttttgggaaagggctgttatcaattttgtttcagagtcaaaccatgaactgaattccttcccaaagttagtctggcttacacccaggaatccacaaggacagcttacaagttagaagcaagatggagtcggttaggtctgacatctttcactttcatagtttcctcagttataattttgcaaaggcggcttcagtccctccctttgggttttataacaccttaatcttcaggtgtgggctaggaagatgggaaaaggctgtcgattgttctggcttcttcctgctgagagggggcgtagtgagggtacctaaggtgagaggagtggaactgcttagaagcaagatagcgttggttaggtctgatttctttcactgtcatcgtttcctcagttttaattttgcaaagtcagtttcatttacacagcacaatatttaatccccaaacaagtaaagtaagcctgatattaactgaccctgtctaacttgattgctatactcagttattcagaaactccaggcaacttccagtcggaaatgctactttccttttttttttttttttttgagacggagtttcgctgcgttgcccaggttggagtgcagtagcgggatctcagctcactgcaacctccccctcctgggttcaaaggattctcccgcctcagcctcccgagtagttgggtttacaggaatgtaccaccacatctggctaattttgtatttttagtagaaatgtggttttaccatgttggtcaggctggtctcaaactcctgacctcaggtgatctgcccacctcagcctcccaaagtgctgggattatgggcgtgagccaccatgcctggcctcagcaatgctactttcctagtgaaacacttattttcttccagagcctatttctggccaactgatgtctttcctgattcttgatccctgtgtgagaaaagtactttgttatcgaagtgttttttgttgttgttgttttgtattttgtttttgagttactttgtcacccaggctggagtgcagtggcatgatcccggctcaagcaacctccgctgtccgggttcaagtgattcttctgcctcagcctccggagtagctggggttacaggcatgtgccaccatgtccggctaatttttgtatttttagtagagaggggtttcaccatgttggccaggctggtcttgaactcctaacctcaggtgatccaaccgccgcagcctcccaaagtgctgggattacaggtgtgagccaccgtgtctggcctaaagaagtgtttgtttgttttgttttgttttgactttatggaaatttatagcaatcttagtgatattctcctcctgatgtttatatrgcccaggtttgtggaagtcctagctcatcgtgatccttagatctccttattttttgctttttttgaagaattgccattatccctactatcaaggctgatatttgtatttagtggttcagcttcttcactggttggcatcacatgacacttggcccaagaataaaaaaatcaagcactgtcttgatttcattttcttctttccaagttagatccaaactggtcttctcttttgaatacctttgcagtctctctgagcccctctcctgctattcactgaattccagctttcaatctcatctagttgcaagcacaatgacctgttcctcacaaacttaatggtttcacatctatttagcaactactgtcttgaggaaagtgatacatgattctccaatggaactatttcaaacaattttaaaaataattatttgcaatgcttgaaagtaagcttcctgcccacaagcattcagatggtaaaggaagaagccaggagatggttggctaccaagaagaggtttaaacattgaggaaccccctggtgctaatacttcttttagggcatgtttcttgtgcaagagctcagtcacagggtactgagactggtctgacgctccagttcttcaaatcttttggagactggcaattcctttgagattcctgcccccactcttaccctcctcctgccttgtttccctcccaagaagtctgtgcccccattgttattcttttcagggcacaaaagagccatttagaaaggaagaaatgaagaaatgggcaagagggaaaggaagaattctttgtgaacttttgctttcagcaaacttattcttattgctgtcaaccttctttaacccgcattatctggttttscttttcagtactccatggtggaactacaggtaagcggaagtttctttctcttctctgtcagttgtggaagaggaagaatgagaatttggtggtacaccttgaagacagaagcaactctgagatcttggcccagagccccatgactctgcccagcaccgagcgcccacatccacctaagctgtgcctgctttcttgcctctgccctcctagtctctcacacctacatttcagtagacaaggacaccagcctctgtaatgactacaccgctctctcattcccctaacttctctgtgcccagaygacttaaccaggcttggttccatactccccttagtgtaaggtaatagcccttgccataggcattctcaacaggtacgtgataacataaacacctgtgagaagtattttaaaggaaaggctctagaaggtgatttctccacaatatcttctccatttttccattaaatcacccatgttttaggtatcttacaatcaatctcctcagccttgtcccctaatagtgaccagaaacagagtaaacattctttgtaaatgacatcctgggtcctactttctaaaactggagataacactttagagggctcagtctgatcattaaaatccacaagatttcctaccaaatgggggctggatctatagaaatatttacctcattccgccataaagaaagttataaataacacagggagctgctcttcctggacacagaccacaggggtcatgaacaatgggtggggttttttacctgccttttgcttctttacctgctttttgcaatgcagagtgggaagcaaacgggcaggcacatcatgcagtttctctattggacaggatccaaatagcaacaggattgcacagtggctggaagtggtacctgagcaaggcattgtagacctgtccttccaactggcaccagaggcaatgctgggcacctacaytgtggcagtggctgagggcaagacctttsgtactttcagtgtggaggaatatggtaggkggggaaatggacaggccaaagtattgggcataatctcatcttaaaatcagcaaaggtggagccgggcgcagtggctcacgcctgtaatcccaggactttgggaggccgaggcgggcagatcatgaggtcaggagmtcgagaccaccctggctaacacagtgaaaccctgtctccactaacaawacaaaaaattagccgggcrtggtggcaggtgcctgtagtctcagctactcgggaggctgaggcaggagaatggcgtgaacctgggaggtgsagcttgcagtgagctgacatcacgccactgcactccagcctgggtgacagagcaagactccgtctcaaaaaaaaaaaaaaaaaaaaaatcagcaaaggtggagtaaaatgtactctgggaaaggattatttactcatttttgaatcgatgctgaaccagctaattacttcaggaacatgctacctaaataatgcctccttcattagatccattaatttaattctcactgtttatrcccctctgctcactgcctgtctgactgattcctcctccagtgctttctccatttctccttttactctcttcagtgctgccgaagtttaaggtggaagtggtggaacccaaggagttatcaacggtgcaggaatctttcttagtaaaaatttgttgtaggtaagagcagaagcttgggatctggtggagattaaagatgcatcgagagacatgatgaggggatgacatgggatgtgggattatgggtgggccaaaacttggggcattttatgtaattcagagtcatggcttatccaagacctttttttttttttttttttgagacaaagtctcactcttgtttcccaggctggagtgcaatcacgtgatctcggctcactgcaacctccgcctcatgggttcaagcgattctcctgcctcaacctctagagtagctgggatcacaggcgcgcgccaccatgcctggctaatgtttgtatttttagtagagatggggtttcgccgtgttggccaggctggtctcggactcctgacctcaggtgatccgcccaccttggcctcccaaagtgttggattacagacgtgagccaccgcgcccagccaagaacatattttatagttgtgtttctgctgtttttttccattgctcactcagatagtattattgatttagtctttacaagacacaatattgaatcccatagataaatatggatcaggagaaagaaagatrctgtttccgtccttagtatggtgctaattgtggaaktgggtctactctaagactctgagtaaagtagggaaggggaagagagctagagaaaggtaggattgtcagagcttgctttcttcttttttttgagacagagtctctgtcacgcaggctggggtgcagtggggagatctcagctcactgcaacctctgtctcccaggttcaagcgattctcctgcctcttcctcccggagaagctgggattacaggtgtgagccaccatgcccagcaaatttttgtatttttagtagagacaggatcttgccatgttgcctaggctggtcttgaacccctggcctcaagtaatacacctgtctcggcctcccaaagtgctgggattacaggcgtgagccactgcactggcccrgattgtcagagctttctttcagaggctggagtgtgagagggaagaagtggtgtttgagggaagagttggatctcaagtggaatttcccaactctgactccttatgcttttcttggttaggtacacctatggaaagcccatgctaggggcagtgcaggtatctgtgtgtcagaaggcaaatacttactggtatcgagaggtggaacgggaacagcttcctgacaaatgcaggaacctctctggacaggtgagtaaatgacaggttaaaaaggaacctatcggccaggcacggtggctcacgcctgtcatccyagcactttgggaggccgagatgggcggatcacgaggtcaggagtttgagaccagcctgaccaatatggggaaaccccgtctctattaaaaattcaaaaaattggctgggcatggtggtgtgcacctgaaatcccagctacttggaggctgagacaggagaatcacttgaacycgggaggcggaggttgcaatgagccgagatggtgccactgcactccagcgtgggtgacagagcaacactcagtccccctcccccaccgaaaaaaaaaaaaaaaagaacgtatccacatgtcctaaagcgtaaggaagcaacaatctagaaaagagctaaacagcccaaagtagaaagcatttcccagaattatcatcccagttccaaagaacaaagcagggatctttatcctaaacagggagtgttttagagtctgccttggaaccaagaaattgacctaaaccccagtaaggtacaattttccagttttgaaggcatttctttttccctttcccaaatcttggagcttcaaagtcatttcatgattatctatgtgcaagtgtatacttcatgttgtaggagagtttttctrtattagaaactgaagtgtggagatgagaaattatttccttctacagaacattataaaatggatgtagagattagattcctcatctgctctctatctctgtctctgatcacctcactagactgacaaaacaggatgtttctcagcacctgtggacatggccacctttgacctcattggatatgcgtacagccatcaaatcaatattgtggctactgttgtggaggaagggwcaggtaagtagggtgctccttggctcattaagaaaagagaaagaaaaagggctggtcccagggacagatttactccaagtatacaagacctaccctcttgagtgtttggatggtaccttgttcctagttcatagtcaaggggaaataccagatcccatcttgccatctataagaaatactacgggccgggcatggtggctcatgcctgtaatgccagcactttgggaggccgagacgggcagatcacgaggtcaggagatcgagaccatcctggctaacacggtgaaaccctgtctctactaaaaatacaaaaaattagccgggcatggtgacgggggcgcctgtagtcccagctactcggggaggctgaggcaggagaatggcgtgaacccaggaggtggagcttgcagtgagccgagatcgtgccactgcactccagcctgggcaacagagcgagactccatcttaaaaaaaaaaaaaaaaaaaaaagaagaaatactacatacttctccaaaagattggggaggtgaggttggtttggatctttggccagaaatacattcaacttcatccctctgccaccattctctcagagacttgacattaaacgtgaagatgagaatatcaggtgcctagatctttatacatctggtttccctctgcaggtgtggaggccaatgccactcagaatatctacatttctccacaaatgggatcaatgacctttgaagacaccagcaatttttaccatccaaatttccccttcagtgggaaggtatgttaaaacttttctctgcatagacaaaaaaatgcataaccatctactttgcctccttcctgcagccatagccacatagctaacttagtgctgttccaagtactttatgtgtattcattttaatctttagaataatgcaatgaggcagacactgtattggccccattttatggatamtgagacaggcaacagaggctaagtgatttttccaaggtgatcacaaatagatgggaactatgaccaaatccaggaagcctgcctcccgggtatacactctccactccctgtactctgctgcccctaatcccatagaagtgccttgaatattaatgacaccttaggggtctttctaatgccaggggctgatcttctaatgtctaaatcttcatatttaagagctgcagggtttctagagaaatcatccagcctggtctcctgcatctaggcaaggttaatatgaaactttccttgacagccatgtatagctctgtaagcaattttgtttttctttctgtttttgttttgttttgttttgttttgagacagtctcgctcttgttgcccagcctgaagtgcaatggcgcgatctctgttcaccgcaacctccacctcccaggttcaagcgattctcctgtctcagcctcctgagtagctgggattacagacatgtgtccccatgcctggctaattttgtatttttagtagagatggggtttctccatgttggtcaggctggtcttgaactcccgacctcaggtgatccgtccacctgggcctcccaaagtgctgggattacaggagtgagccactgtgcctgactagcaattttctttagagattttaaaatttccggcagggcgtggtggctcacgtctgcagtcctagcactttgggaggctgaggtgggcagatcacttgaggccaagagttcgagaccagcctggccaacatggcgaaaacttgtctctgctaaaaatacaaaaattagccaggcatggtggcgcatgcctataatcccagctactcgggagtctgaggcacgagagtggcttgaacacaggaggcagggggtgcagtgagctaagatcatgccactgcactccagcctgggcgatagagcgagactgtctcaaaaaaaaaaaaaaagataaatacataattaaattttctttgctagtgttttctttctgatatctaactgaatttctctcttgttcagcttatctttctttacttcttgtacagctggtccacacaataatattgcacacatagagatgcatttattcctcagttatcatttctctagaccaagggtgggtgcaaattatttttagagcctaaggattacacartttgggagggtaggggattcgctttaagaaaaagaaagcaaaataggctgggcacaatggctcatgcctgtaatctcagcactttgggaggctgaggcgggcgaatcacgaggtcaggagttcgaaaccagcctgaccaacatggtgaaaacccgtccctgctaaaaatacaaaaattagccaggtatggtggcacgggcctatagtcccactacttgggaggctgaggcaggagaatcgcttgaacccaggaggtagaggttgcagtgagctgagctcgtcccactgcactccagcctgggcgacagactgagactccatctcaaaaaaaaaaagaaagaaaggaaggaagaaaggaaggaaagaaggaaggaaggaaggaaagaaggaaggaaagaaggaaggaaggaaggaaggaaggaaggaaggaaggamggaacggaaggaaggaaggaaagaaaaaagaaagcaaaacaacgtgcagaacctttgaaggagcctgtgcatatgaagagccctgaagcttcattagccaccgggcaaatctagctctgctctgggctgttacttctgtttgtttttcggttcctcacagatcctagttcaaaagcttgaatcacatttatctttttcaggactctttcctgaaatgtattcttagaaattctgttattacttttagtgccaaaaaccacaattagtttgcaccaacctaatatttcactttacctcatactcaagcttactccaaacctaattctaatccgtaatgatctttgtccttcagataagagttaggggccatgaygactcctycctcaagaaccatctagtgtttctggtgatttatggcacaaatggaaccttcaaccagaccctggttactgataacaatggcctagctccctttaccttggagacatccggttggaatgggacagacgtttctctggaggtaagcatggacggaggaccagcttcctagaaaggaaggcttccctgaaggaaaacttcagaattttcctgtttcctatyctcccctctgcttggaattacatctttctcactcacaagtcctgctctcccgttgacaaaaagttttccttagatgctttctgtttttaatatcaatcaaataaatagtccttacttggatgaaaactactatttctactaatacatcttttaacttacccccatctctatctgatcctatctatatatgaagttagagcagggaggaataggtgactcagagtctttttctttctctttccccttcccatcccctcattacttaataaaaacagcaaacaagagaactctagattctagataacttataagtatcaattatcaactgccacaacaatgcttcttatcaaacagctacaaacttcagtatcgtgcagcagaaagcattcactgcttgtgcatctggggcattcagtcaggcagctctgctgatttcgatttccagaactgtctgcagatcggctggccataagctgctgctccgcatgcctctcatgcaggagccrgctagcccaggtatattcttatggcagtgatgaggtgcaagtgcaaaagctgatgttcagggcttttcyaaacctctgtatattgcatatgtttttttcttttttttttttttgagacagagtctcactctgtcacccaggctggagtgcagtggcgtgatctcggctcactgcaagctccgcctccccggttcacgccattctcctgcctcagcctccccgagtagctgggactacaggcgcctgccaccacgcccggctaattttttgtattttttagtagagatggggtttcactgtgttrgccaggatggtctcgayctcctgacctcgtgatccgcccgccttggcctcccaaagtgctgggattacaggcgtgagccaccgcgcccggcccctgttgcatatgttaacaccccwttcccaacaaatcgaacagtgggcacagactaggagggtactggaagaccacatgctcaaggatgctgatctyggagggggcrgggtgcgtgtgaggaattggagccattaatgagatcgttcaacctcaggacttaagcaaacacatactacttgccttgtggctaatttgactatttctttactctaggcatgactcagttactcagaaataattatttttcaatcttagtgtcttctgtgcctagttttcttatccctgaaatataatctttgatttctatataatctaagtcacgttcatctatcccaggaatatctgtgaagatacatcacccacaatttcctctcatttagtaactataattcagcccttctgtcgctstcctacataccaaaatattgctgtacacagctacgtttatggattctttatccatccttggctggaccgctaatgaaatacccacatgccattctcaggcagtgaagatttgagagaaagagctctatttgaaaaccgtaacaagtccgtggggtttccatggttggagcrcatgctaaaattctctctctctcttttattctcagggaaagtttcaaatggaagacttagtrtataatccggaacaagtgccacgttactaccaaaatgcctacctgcacctgcgacccttctacagcacaacccgcagcttccttggcatccaccggctaaacggccccttgaaatgtggccagccccaggaagtgctggtggattattacatcgacccggccgatgcaagccctgaccaagagatcagcttctcctactatgtgagaccrggaaacggggacgggtgagagtatgctgggaaggaaagagaatgagaagagtcagccagagggtgcacctaggctatctgaattgcagatgcacatctaattaaaaacaattttaaagccacactaaaaaagtaaaagaacagttgacattaattttaaatgtattttttatttaacccattatatccaaaatattaacattttaacacgaaagccatataaaaagttttaatagatattttacattcttgtttcaacggtgtctttgaaactcagtatgtattttacacttaaagcgtatctcagtttggactgagcacatttcaagtattcaatattcctttttttttctttttttttttttttgagacacagtctcgctcagttgcccaggctggagtgcagtggtgtgttcttggctcactgcaagctccacctcccaggttcacgccattctcctgtctcagcctcccaagtagctgggactacaggcgcccgccaccacgcccagctaattttttttgtatttttagtagagacggggtttcaccatgttaactaggatggtctcgatctcctgacctcgtgatccacctgcctcagtctcccagagtgctgggattacaggcatgagccaccgcgcccggcctcaagtattcaatattcctatgtggctatgagatactgcatggcccagtataggtgtaagagatggaaaacattgggggaagaaagagattctgagcaggaacacaggaaaattgtgtgggaaaataaaatgaggaattacctgagaaaatagtgctggccaggaccaaaaaaaacaaaaacaaaaacaaaaccagctgggtggttgggagggagagtggggagggatgggactcaggatactttttttttttttttaatttatatgagacagggtttcgccatgttggccaggctggtcttgaactcctgacctcaggtgatctgcccaccttggcctcccaaagtgctgggactgcaggcatgagccaccgagcccagccaggatacatttcattctgtgttccattggtcaatattatcaaatagatgatatggggttaaattcacatcgatagcagcctcattggggaaataaaatcataacttggtagcctgaaagcaatgtataaggataagcagctttcctgtcaccttggtgacagtcaggaagtagaatggaaacctcaggtttgatggctcggagcctctttgttccgttatcctcctgtcagtctatgagagactttctcccctctggatcattgcagtagcttccatggtttcagtgttgtcgttaagtgaaaaaaaaaaaatcatcctaatacaacgaaaagagaaaagataggtggaaaataacaagtccagtgataaagcgggctctgtcttcaggaccgaagtgtggggaggtgtaggacaaaagtgaagttagggccgagccacgtggaatggctaatgctgggcaggcgtccaaggaaccgaccttggagccctgcaggagcgtgggatgagagcctgcttgcaaacaagatcaccgagttctgtttcaagtgagagtggacgggaagggggagttagaagaggagatttctcctctagagggttcaatgtcagaagggctcagggtggtttaggatgaaattatttccactgaattttaaattgagctgtaattaaaaaacacttatgaggatagattttcgctgactttctgttacaaagattataagaaaataaaatttggagatcttcaagaaatggcagacagttatctatggtgaggaacaatttctatgctgtcagactcctcccatccacctgcgtggttctcagccagacctccaactgcaggaggagccaccaggacccgttggcagcatcctgcatttgtcaagctagtggatgctgggtgaggtattgacccggactctgaactgtgaaaggaacctctcctcatgaagggatgcagagatgctctggaagttggtccaaggtgaaattactgtaacttctgtgcagttgattcttttcttttcttctttagttaatagggaaaggaagtttggtgatggaggggcagaaacacctgaactctaagaagaaaggtgagtgtacatgcttttcccggaagcaaacaggatatttttaaattccagaaaacaattcttggccaggcgcggtggctcatgcctgtaatcccagcactttgggaggccgaggtgggcggatcacgatgtcgggagatcgagaccatcttggctaacatggtgaaaccccgtctctactaaaaatacaaaaaaaaattagccggacgtcggggcgggcccctgtagtcccagctactcgggaggctgaggcaggagaatggcgtgaacccgggaggcggagcttgcagtgagccgagatcatgccactgcgctccagcctgggcgacagagcgagactccgtctcaaaaaaaaaaaaaaataaataaaataaaataaaataaaataaaataaaaaaattcttatccacagaagtaatggaattggagcactaacagttatcacaggagaagagaaaaatgagaagtaacttgcaccatggtgcctgcactggctcagtgaaaagtacatatggttagatgccgttggcaggtgaatgtgcattctgattttcctgtatattccctcttctctttcaggactgaaagcctccttctctctctcactgaccttcacttcgagactggcccctgatccttccctggtgatctatgccatttttcccagtggaggtgttgtagctgacaaaattcagttctcagtcgagatgtgctttgacaatcaggtaaaatgatagcggagaagggtgaagataaaagttgggcatagagaaagatcttgtgtgtgctgcggttggaaacaagacaagtcagggaaagaagatagtgttgacgttggatgttgtattatatttatatctttagtgtttggggtttgtgttgaaatccatctctctcctactttttattttaagaagtcatgctggctgaggtgcagtggctcactcctgtaatcccagtgctttgggaggccaaggcagagggatttctttaggtcaagggttcaagaccagcctggacaacatagcaagatcctgtctgtacaaaaaaatttttaattagctgggtgtgcagcactttgggaggccgaggtgggtggatcacctgatgccaggagttcaagaccagcctggtgaaaccgtgtctctactaaaaatacaaaaattagccaagcatggtggtggatgcctgcaatcccagctacttgggaggctgaggcaggagaattgcatgaacccaggagacggaggttgcagtgagcaaagaacacaccattacactccagcctgagtgacagagtgagactctgtctcaaaaaaaaaaaaaaaaattagttgagtgtggtgatgcatacctgtagtcccagctagtcggaaggctgaagcaggtgtatcgcttgagccccaggagttcaacggctgcagagcgagaccctgtctattttttttatttttaaaaaacagagttttctttttgttgccaaggttgaagcgcaatgggggaatttcggttaattgcagcctttgctttttgggttaaagggatttttttgcttaaaactcccgagtagctgggtttacaagtttgccccaccatgccgggtttttttttttttttttttttgggtttttaaaaagggggggggcttccccatgaaaccccggggggcttggaccctcgtcacagggataccccccggtttggcccccaaaggggggggaatacacgggaagcccctttttttttaaaaaaaaaaaaaaaaaaacccctttggggggaccccctgtttttatatttttttcccacggggtctccttttttttggttttaaaaattttttttttttttttgggggggggcggggttccccactttttttgggggaacccccctttggggagggggtgttttttaaaaaaagaatgttcccacggannnnnnnnnnnnnnnnnnnntacttggtgtaatccatcaccccccaaacccctatggggagtccagtcacttcataggattaaatcccttgcaattccaaagtttgattttcatatgtaggaggtatctcatgtgcctggccagaatattgtaaaacttaagtgtcataaaagggcaaacatttatctaacaggtttctatgggtcattaatctgggtgcagcttagctgggtgcctctggctcaaggtatctcatgaggttgcaatcaagctgtcagtcaggactctggtgtcatttgaagactcgactaggagaggattgatttttcaagctcatcccaaagtctctgatccttacaggctgctagactgaaggacacagttcttgacctcagcttttggctaggggcctcactcagtatctcatcacatgaatctctctggtggggtgcctcatcacacaacagctgtttttcccagagcaagcagtttgagaaaaggggtgcrcccaagatggaagctgcagtcttttagtagctgggattacaagtatgcccccccatgcctggcttttttttttttttttttttttgtatttttagtagagacggggtttcaccatgttaggccaggctggtcttgaactcctgacctcaggtcatccacctgccttggcctcccaatgtgctgggattacaggcatgaccctgtctctattaaaaaaaaaaaaaaaaaaaagccatactgggaagccacatgttctatatagttattccacatgttctctctactttttgtcttctaaactttctctatccttctactgtgctgctcacgtttcccaactctatcacggcatacacgtcctgaagagctagactttacaaagaaagataagtacaaaagtgaaagaatgggttggatgtcatagctggggcatatttgctgatgacccaaattatgttgtttcccttcctttccaggctgacctgatccccaagttatacctttcccttccccaggtktcccttggcttctccccctcccagcagcttccaggagcagaagtggagctgcagctgcaggcagctcccggatccctgtgtgcgctccgggcggtggatgagagtgtcttactgcttaggccagacagagagctgagcaaccgctctgtgagtaactgtctgctgacagagtgggaggagggagttgatggagaagacaattaagaggtaggtttcaggcaggggagagaaagtcttagggaaataatgcactgccataaggcggtaaaaaggctggtgtgaaaatgaagttagaaagtgtaagagggctgggcacggtggctcacgcctgtaatcccagtgctttgtgaggccgaggctggcagatcacctgaggtcgggagttcgagaccagcctgaccaacatggagaaactctgtctctactaaaaatccagaaaaaaaaaaaaaaaattaactgggcatgggcccatgcctgtaatcctggggaggctgaggcaggagaatcacttgaacctgggaggcggaggttgtatcattgccctccagcctgggcaacaagagcaaaactctgtctcaaaaacaaaaaaaaaaaaacaaaaacaaaaaaagaaaggataagagaaaggcatggttagtatgaatgcagagacaagaaaagagaatgagcctgtaatcccagaactttaggagaccaaggcaggcagatcacctgaggtctggggttcaagaccagcctgaccaacatggtgaaaccctgtctctactaaaaatacaaaaattagccaggcatggtggcgcatgcctgtaatcccaactactcaggaggctgaggcaggagaattgcgtgaacccgggaggcagaggttgcagtgagccgagatcgtcccactgcacttcaatctgggcgacagagcaagactccgtctcaaaaaaaaaacaagaaagagaacgaaataggggataggattatgaaaaaataggtgagatagaggttaaagttttagacagtgagaaaggtaattatgacagaatgaatataaaaataattctgaagtaataaagagaaatgatacaggagtagtgaactgagcaccagaatctgagagaagtttctcaactgatatcactatatcaatgctttatttcctctccccctcttgtcccaggtctatgggatgtttccattctggtatggtcactacccctatcaagtggctgagtatgatcagtgtccagtgtctggcccatgggactttcctcagcccctcattgacccaatgccccaagggcattcgagccagcgttccattatctggaggccctcgttctctgaaggcacggaccttttcagctttttccgggtaggtcttcttacccattttgttcttatgggaaagatggtggtgggaatgggcaaaggaaagttcatatctaagaaagcagagagactcatatgggcactgatgggaacaaaatcttgaaagaagcttctgacgtgtaaggtcgcctctgttggcccttatgcttgaagaagatgtccaacctagtcttcctctttttgttgtcctcaaacactgatttccatgagatcaatcaggagggaaaattagagaaggtagaccagaggtctcttatcattattataaaaaataatttgcacctattctatgagcaggatttgggatgctgtgtgacccaagtctgaccaggaggtccctgaggtcaggaactaggtcttgttcatctttgtattctctctaatgcctgacccttcataaggctcattgtatttttgttgaattgagtacgctgatatggtccctaccctcagcatgtttacagcgtaagtcaaatagtaaggacatagcgaataatatttggcagaaccattacatgtatgtaatgatgaaataagtttaactgaaagcctttcatgctagctggaacagaagccaaccagcctcagtggctgagtttcaggtaagaacacccaggttcaccattaattcaaaaagaatgttttgtttcaactctttgatggtggaattcctgggcagtagcccttgtagttggggaagggaccaccttaatacttatttctctgatgcctatcaggacgtgggcctgaaaatactgtccaatgccaaaatcaagaagccagtagattgcagtcacagatctccagaatacagcactgctatgggtggtaagccacctctgtggtctgtggattctctgagatgttaacagtcctggaactctgcagatttcctcttgcctcctgttcttgcactgagcctctagcccgagaatgctaatgggttgtgggtcacagatgcaggacagtttcccaagtgttctctctctggggagagcttttgaagcctgaagcttatgtatccattccccggccaaacctccttggctatcacttccctcgatggcctttgtgactagttagttcctctttggtccttcctccttgcctctgactggatgttctctgcttccctctaaatttctttctagtaatccctccatcccaatttatgtcacaacaagaagtctcctgtttcctaaagttttcgtattctcaatttcatcagcaggcggtggtcatccagaggcttttgagtcatcaactcctttacatcaagcagaggattctcaggtccgccagtacttcccagagacctggctctgggatctgtttcctattgggtaagtgatgactcaaaagtacagtaaagggccaggtgcatggctcacgcctgtaatcccarcactttgggaggcttaggagggaggatcacttgagaccaggagttcaagaccagcctgggcaacataatgagcttctgtctctacaaaagaaatwaaaaaaatagccagatggtagttgtgtcctacttggaaggcygaggtggaaggatcacttgagtctgggaggtggaggctgcagtgaagcaagatcacattgcttcactcctgcttgggtgacagagcaaaacccttctcaaaatcaacaacgacaacgacaacaacaaacccagaaaaaaaacagtaagattctgcaatgtagagcctgtagaaaactcagaatcagacgcattcctaatggatctaaatcttaagcaaagaaagcttgatggggtgtgggaatttatttattttccggaattctttttttctttttatttttaagacagagtcttgctctgtcacccaggctggagtgcagtggcatgattttggctcactgtaggcctcaacctcctaggttcaagcaattcttgtgcctcagcctcccaagtagctgggactataggcacatgccaccacacctggctaagttttgtatttttagtagaggcagggttttgctatgttggccaggctagtcttgaactcctggcctcaagtgatccacccgccttggcctcccaaagtgttgggattacaggtgtgagccactgcgcccggcctacctgaattcttcatgcattcatatacaaccactcaaaacaaatccacacaattccacactcacacattgcaggccctgtgttctcactacagaaccacacacatttaaaggtatatattgacatcaatttttgctcactgcttgcatatccattttgacaagccctgagaccacacatcctcagactcagagggcaccagcctctctgtcagatgtgcttgcacagagatgcccaccccgactccccaccatagtccccctcctccgtatgagtgcagcctcactcacactgagactcacctgttcagttgcctctttacttctccccatacaataacaataacaattttacttctgcagatgaatttgtagctttttttttttggacagggtcttgccctgtcacccaggctggagtgcagtggtgcaatcatagctcactgcagcctcaaactcctgggctcaagcaatcctcctgcctcagcctcctaagtagctgggactataggcatgcaccaccacacctggctaatttttaaatttttggtagaaatagggtcttgctatgtttcccaggctggcctcaaactgctgggctgaagctatctgctcacctcagcctctcaaagagctgggattacaagtgtaagccagcacaccccaccgaatttgtggcttaattcacaaatgttctccttgccccacgctacctctgcctcatgttggtccttgtgttttcacagtaactcggggaaggaggyggtccacgtcacagttcctgacgccatcaccgagtggaaggcgatgagtttctgcacttcccagtcaagaggcttcgggctttcacccactgttggactaactgctttcaagccrttctttgttgacctgactctcccttactcagtagtccgtggggaatcctttcgtcttactgccaccatcttcaattacctaaaggattgcatcagggtgagagctggggatacaggaatcaggtgtcagccctggaatcacacctcccccataastttgtctctaaattggaagcatcccaattttccctgggaaagagaggagatgtcggcgtctcagcccccaggtttccccaggcctctatgcactacctcctttgtttgtaccctttgtctcttaaacatcctccgtaggttcagactgacctggctaaatcgcatgagtaccagctagaatcatgggcagattctcagacctccagttgtctctgtgctgatgamgcaaaaacccaccactggaacatcacagctgtcaaattgggtaagagagggaagtggtagacgggcgaggaaagccagcagcagaagaccagtgactgagcactcagtcttttcctctgccacatctgctttgcttcctcctccattttccactatttttctccctcctaaggctgttataagtcaatacacaaacactctttgataggtgaccaaacaaatttgttcaaaccggaatattttgagtgtgaaagggagagcttttaatatttatagctggacaaggaatacatggtcatgtaactaatcaaggacttactataagagtccctgggccaggcactattctaactgctttacatatattaactcattaaattgattgactaattaatttttattttatttatttatttttgagaggaagtctcgctctgttgcgcaggctggagtgcagtggtgcaatctgtgcttactgcaacctccacctcctgggttcaagtgattctcctgccaagcctcccaagtagctaggattacagtcgcgtgccaccctacccggctaatttttgtacttttagtagaggtggggttttgccatgttggccaggctggtctcaaactcctgacctcaggtgacctgcctgcctcggcctcccaaagtgctgggattacaggcgtgagccgctgcgcctggccttttatttttttttagagagacaagatcttactctgtcacctaagctggagtacagtggtgtggtcattgctcactgcagcctcaacctcccaggctcaagcgatcctctcacctaggcctccggagtagctgggactataggctcatgccaccaccatgcctggctaattcagttggcagagaagcggtcttgctctgttgcccaggctgttctcaaactcctgggttcaagtgattctcccgcctcacccttccaaagtactgggattacaagaatgagtcacygcacctttaacttgtttaatcctcacccccaaccctatgggatgtcagtcactcatagattaaatccttgcaactcaaagtttgattttcatatgtatgagttatctcatgttgcttgacaaattattgtaaaacttaagtgtcataaaaggacaaacattatcaaacagattctatgggtcattaatctgggtgcagcttagctgggtacctctggctcaaggtatctcatgaggttgcaatcaagctgtcagtcaggactctggtttcatctgaagactcgactaggagaggattgatttttcaagctcatcccaaagtctctgatccttacaggctgctagactgaaggacacagttcttgacctcagcttttggctaggggcctcactcagtatctcatcacatgaatctctctgctgggctgcctcatcacacaacagctgtcttccccagagcaagcagtttgagaaaaggggtgcrcccaagatggaagctgcagtcttttttgtaacctaatcccagaagagtcattactttcaccctgttctctttaacagaagcgagtcactcaatccagctcacactcaatggatgtaaatatcaggatgcagggatctctgagggcccttagaggttacctaccacactggactagcctctctggcatcacctgggagcttgttagaaatgcagaatatgggccccaccccaggtctatggcagcagagtttgcactgttgcaagatccccattaaagtttcagaaatgctgatccaaatgggaatggacctcactggtacctctggcaatagggctaatggcttcccttcttctttctctcaggtcacattaactttactattagtacaaagattctggacagcaatgaaccatgtgggggccagaaggggtttgttccccaaaagggccgaagtgacacgctcatcaagccagttctcgtcaaagtgagttttcttcagaggtagagacagcaaccaaccgagggatgctcagcatctcgtcttgctgtgagttagtctctcacagcaaccatactccagtccaaccaggcagcttcaactttctccttccctggccccttgaacatttgcctaatccacacccacggcctatgaaagcacctaaaaccsggcacctcataggcactcaacaaatgttagtttacctaattaaaatgtctgtcttcatcaatagctgcctttttcgtcccatcatgaagcccattgtcaatcttgcctcttagaagttgcctaaatgtgkctttggctctagcacttgcccagaaagaactttacagaaagggcccatccttgggttgacgcagagttckkytgassywsagtgagaagctcttgtctgcagttctgagggaagccctgggggcacagcgaggggcctcccttccctttcctttagtgccatccctcctgatgttcatctttgttgtttttatctgtgtctctcttcatcgcagcctgagggagtcctggtggagaagacacacagctcattgctgtgcccaaaaggtgggtggactcagagcaggattggtggtgagaattcccttagagggcaggagattttcttttcattttttttttttttttgagacggagtctcgctccgtcgtccaggctggattgcagtggcacgatttcagctcattgcaacctctgcctcccgggttcaagtgattctactgccttagtctcctgagtagctgggactacaggtacatgccaccatgcctggctaatttttgtatttttagtagagatggggtttcaccatattggccaggctggtctcgaactcctgaccttgtgatcctcctgccttggcctcccaaagtgctgggattacaggcgtgagcyactgcacccggcagcaggagattttcataggcaaaaggaggaatgcatagtaccagaaggaataggagagtctgaagtgccattcctcatggggctgattaactgggaggcaggaggaagaagagaaagtgtgcagcacgatgatgactctctgtggaatttattttcagcaagatcactatgaatagtacccagtgctttctgcatcccagagaaagcaccgagtacagaaatccctggattatagaaagttcttctaaaattttgtcttgagaacccctgccattccccatcttctattgtgtcacctttttttctgcatctsacaggaaaggtggcatctgaatctgtctccctggagctcccagtggacattgttcctgactcgaccaaggcttatgttacggttctgggtaagcagttagagattcttgactcagaaaggaaaaggckaatggaggctgcaaaggtgtggagtggggcgggacatacggacctatccggagagtgtaactaataacaagtgatgaaggaaaaagagcstattttatataggagggaaatacagtgtaggcaacagtacagatgggattagacttgtactctagttaaaaatggaagagagtcagggtaggaagaaggtaaggtcgctgatgcttgattttaggtttagacagtctataaattgggtgaagggaaaacagaatatttgcagcaaccattttcaaaactgaggaatttgggtatagtttagggaagatacaaccatatttacaataggcagcacacttactgtttggggcaagggaggaagtgggttgaaaagcatgaacktagaaatcatatctaacctgtcatttaatagccatgtgaccctgaacaagttagtgaacagttctgggccttctttcctcttctgtaaaacagtgataataacctacctctcagactggtgtaaagattaaatgcaatataaagtccccagcacaatatctagcatgtagtaggagccctatgaatgttaggctctttctttactccctcaccctctattgagatcctttgcagtcacagtgtctctgttttgtctattttattcgtaagtctgacatagcacttatcttattgtattagagttcactgtctatatctgtcttccacactgtgttgggggctcctgaagaggaagggccacatctttttcttttgtgttcctagtacagttcctgcaacatagttgacattcaggacacatttatagattgaattgagcttgttggctacaatgcagatgttaatgagtcacttatgtcaggttcactggcttgggaagtatatgaaggggtcagtgacaacttggaaaagagtgtcagaactgtgttttagagaaacttggtgatttggagggtgaggaacgtacatgcagtggtagaggagcttaagagattgatcctaagtgttataagttttgtcacatcactcatcagctcagtgacatgtcttcttaaaagccctgaactctcttagatagcttatgtgcctctccgtgtcccctagcacctcgtacatatccagtatgacattgtagtactgtattaaaattgtttataatgaataaaaattgtaatgtgttgtaatggtttgctcctctgtgagtttttttgagggtagagaccgagtttgatttactgtggtcttcccaggacacacagtaggtactttttttttttttttttttgtatttttagtagagacagggtttgtccatgttggtcaggctggtctcgaactcctgacctcaggtgatccaccctcctcggcctcccatactgctggaattacaggcgtgagccaccacgcccggcccatagtaggtacttattaaatgatagctaatacgtgtttgttcagtgaatgatgataactcttagagggtcccttcttctctgtaccccyaccttctctctctccttttggatcccaggagacattatgggcacagcyctgcagaacctggatggtctggtgcagatgcccagtggctrtggcgagcagaacatggtcttgtttgctcccatcatctatgtcttgcagtacctggagaaggcagggctgctgacggaggagatcaggtctcgggcagtgggtttcctggaaataggtaagttggttcagtctttctttcttgaacactctcctccactaggccctatgacagattgatgatacagggaattccagcccctcaagtgtcccatatccttgaacggcatgggggtgttttctgaagttgtcgctgtgatctaaaaccacatttggcttcccagggtaccagaaggagctgatgtacaaacacagcaatggctcatacagtgcctttggggagcgagatggaaatggaaacacatggtaatatcacccaattcccaatgagttctgtactccagagcrtaattcctgagccctctggaactattccactacctctccccttaacccctttccttcttgcactcagtcttctacctctttaatactgtttatttcaccctcatggatggtcaagtccctcgatcttcctgagcttgtgcctcccctgttcttgtcctcattggtgcccattaatgcctctcttttctaggcctgctatggcatatgttccctcagctccccttctggaagtatacacccaaataaatgaagaaatgattgcaccctcacctggaaattcctcttcatgccatattttcctctttacccatgtaggctgacagcgtttgtcacaaaatgctttggccaagctcagaaattcatcttcattgatcccaagaacatccaggatgctctcaagtggatggcaggaaaccagctccccagtggctgctatgccaacgtrggaaatctccttcayacagctatgaaggtgcggatctgtccaggagcctgcagccaaccactgtctcgaaggaccccacacctctgaccgagtagaagcaaaagagcactggcctgggaatcagttttctcctgatctccactgtggctctgggtgaccgtgatcaaaatgcttagctggtctgggcctcagttttcatgtctgtagaatgagaatacagatgaagcctgggtgcagtggctcatgcctgtaatcccagcactttgggaggccgaggcgggcagatcgtttgggcccrggagtttgagaccaccctgggcaacatggtgaaaccccatctctacaaaaaaaatatgaaaaattaatcaggcttgttagtgcatgcctgtagtcccagctacttgggtggttgaggttggaggatcacttgaacccaggaggtcaagcctgcagtgagccgtgattgcaccactgcaccccaacctgggtgaccgagtgagaccctgcctcaaaaagaaaaagagaatgtggactggaacatggttctcaaagcatagttcccagatcaggagcattggcatcacatgggaacttgttggaaacgcagattctgactcccagcccacacctactgaatgagaaactctgggagggtgggccagaaatttgtgttttgacaagccctcctgattattctgatacacactgaaatttgatactactggactaaaagatctctgggcctcttactgtgtcaccaaatccatctgggaaagccatttcctgtggtgaggactagtaggcagcccaacgtcttttgtaagaagtttactctattggkcactattctaggcacgtggtttatttgatattatttcatgtttacaacaaatcaatgagctaggtattggtatgccattattaatcccattttacagatgaagaaactaagccatggagactaagtaaattgcccaaggtgcatgctaataagtggcaggactgagatttgaaccaggcagttgcactccagaggcactgctttcttctgttcactaccttgtctgtacctgtcccaagcagagggcgaggcgtagatcctgcaggataacttgttcaattcaggacacactcagtgcaagaaagacttgtataaacttttctagagagatcacttacattgctattccagggcaaggattaaaaatcttgagtgttaaaaaaaaaatctatttataggattcattagtcttcctctgcaggatcttattagtctcccctaagtttttgtcttcttcttctcttatacactgtatgaaatatgcgtgggggccaggcgcagtggctcatgcttgtaatcccagcattctgggaggctgaggcgagtggatcatgaggtcaggaattagagaccagtctgaaaccctgtctctactaagataaaggacttgactagagcaagatctcagaggtattcttccttctttcccttttttttcttttctttttttcttgagacaagagtcttactctgttgtacaggctggagtgtagttgcgcaatcccagctcactgcaacctctacctcctgggttcaagtgatctcagcctcctgagcagctgggactacaggcatgtgccaccatgcctggctactttttgtatttttagtagagatggggtttcaccatgtttggccaggctggtcttgaactcctggcctcaagtgatccacccgccttgacctcccaaagtgctgggattacaagcgtgacctatgcgtgcccagcctcttcctactttcttttgagagcaggccagtccattgagaaatccatcctctgtgtagmcaaggttagtggtgtggcacatgagctccagagttaaatgtcctgggttcaaattccagtcctgctgcagatgagccatgtaaccgtgagcaagctatttaatctttttatttatttacttattcatttttttgagacagggtctcactctgtcacccaggctgaagtgcagtggcacgatcatggctcactgcagccttgacctccccgggctcagatgatcctcctactttagcttcctgaatagctgggaccacggatccacgtgccacyacacctggctaatttttgcaggttttgtagagttggggttttaccgtgttgcccaggctggcctcaaactcctgagctcaagcgatcctccccaccgacttggcctcaagctgggataataggcataaaccactgtgcgtgaccacaagctatttaatcttgttaagtgtttgttttcttatttatagaatgaggataataatttgagtagatatttttaaaaatttgcttagctctttctgggaaaggcgataagcagggaaggtctcacctaatctctgctggagaagggctgggtattgtgctgcttgaggggagctgcatgtgaggaggctcagatgcggtgatgcggcagattctctccttattcctcccttctttaaagctcttacccttcctaactccttctcttgggtttcttaaatacccactcagctgaagtccacatgctgcctcctgcaggctgtttaaggctgtgcagttatgaagtccaaactgttccctctttgtgtgtcctggaggcttggagctgcaraaagcctgtggaaaaaagagctttcttttcttttttctttttaaaaattattcatctattcagaggggaggctgttttgcaatctgcacataattcttgcagctgctgcctgytgccctgactcactgcctccctgtttgcctctagggtggtgytgatgatgaggtctccttgactgcgtatgtcacagctgcattgctggagatgggaaaggatgtagatgtaagttctcctggctcctgctcttgataccctccttctcatgcgtattcctagagacattcacccatctttgtctctagtcacccttttaaggtcaagaaggataagatgatttcctgattacttgccatttttaaaggaatgccttataagttatagtcttcatcttcactttttaggacccaatggtgagtcagggtctayggtgtctcaagaattyggccacctccaygaccaacctctacacacaggccctgttggcttacattttctccctggctggggaaatggacatcagaaacattctccttaaacagttagatcaacaggctatcatctcaggtatgttggtcctgttgagagttctttgaaattgtgaacataagctgtgagttatctataatctccctagtaacctctgtcccacacatgtactctaggattcattttagtaacagttattaagtcatcaaattattgttgggaggtttgtgagaaacacacgcaagtgctcaaagggcatttttatacttttttttcttttctttttgagacggagtcttgctctgttgcccaggctggagtgcagtggcgtgatctcggctcactccaagttccgcctcccgggttcacgccattctcctgcctcagcctccccagtagctgggactacaggcgcccaccaccacgcccggcgaattttttgtatttttagtagagacggggtttcaccgtgttagccaggatggtctcgatctcctgacctcatgatccacccgcctcggcctcccaaagtgctggtattacaggcatgagccaccacgcccgagtttctctcttcttgcccaagctggagtgcaatggcgtgatctcagctcactgcaacctctgcctcccaggatcaagcaactctcctgcctcagcctcccgagtagatgggattacaggtgtgtgccatcatgcacagctaatttttgtatttttagtagagaaggggtttcgccctgttgaccagggtggtctcgaattcttgacctcaggtgatccacctgcctcggcctcccaaagtgctgggattacaggcgtgagccaccatgcctggccacatttttatacttttaatgtgaagagaaactacattgaagaagctagtcggaaaatatattggcattgtggaatcacccttttggagatctttgaaagtgctttgatgtaggaccactttaaatatttttaaaaatttttattttactttttatttttttgagacggtgtcttgctctgtcacccaggctggagtgcagtggtgcaatcttggctcactgcaacctttgcctcctgggttcaagtgattctcctgcctcagcctcccgagtagctgggattacaggtgcccgccaccacactggctaatctttgtatttttagtagagagggggtttcaccatgttggccaggctggtctcagaatcctgacctcaagtgatctgcccctcttggcctcccaaagtgctgaattacaagcgtgagccattgcacctggcctggaccactttaaatatatttagaatactatttgaagtatgacagatcttgtaaataaaatattaatgcatttcatttatctggctgtgtatttaaaattattcttccaggcagaagtgcagtctcagccttcatttatatgagcgtcatggctgagctgtcctctcacagggggtcaggtagttttttctcttgtgtctaagcaactccagtcatgaaatgttgtccgagacaatgggttaaatacacctgttccaccgtrtattggtttattgtgatgatctcttttccattatcttgtattgcaagctcacatgtttcctgttacgttcttccaattagattgcccttctgtggttacttattatctctaaaattctgtttaattagtcttctaacktacagtcttctcatttcttatttatttttcttcaagttatccattatctgtcatcttggctgtcacagaggtttcttttggtctcattctattggactgccttctaagcatgtttcatatagttrrcctcattagcatttcttcatggtttctcagaattctttcatatactctgccatttttattctacttaaaatgttaaatctttttttttttttgagactgggtttcgctcttgttttgttgcccaggttggagtgcattggygtgatctcagttcaccgcaacctccacctcccgggttcaaatgattctcctgcctcagcctcccaagtagctgggattagaggcacgcgccaccacgcctggctaattttgtatttttagtagagttagggtttctccatgttggtcaggctggtctcaaactcccgacctcaggtgatccacccgcctcggcctcccaaagtgctggattacaggtgtgagccaccgcacccggcctaaatctttgattaaatgaaataaatgctgaaaaattcataaaactgtaagcaaacaaaaattgcccccaaacacagagattcttataagaagcttctatttacctatttccattagcatcaaaactgataaattaacaagggtggttttcatgtaattgctggaggcaggaacatttatcgatgcttctagctttacacacaggcacgcacatgcatccttgcatttacatcaaggtcaattaatcagctaaatctaagaaattttttttctactctgtttaattctcagttggtacttactctgctctaagatgctgcatttacaaagtgaatgtgggaaagccagttccttctaaggacatcctagttatgtttctttttccataggagaatccatttactggagccagaaacctactccatcatcgaacgccagcccttggtctgagcctgcggctgtagatgtggaactcacagcatatgcattgttggcccagcttaccaagcccagcctgactcaaaaggagatagcgaaggccactagcatagtggcttggttggccaagcaacgcaatgcatatgggggcttctcttctactcaggtaaacagcctgttctcccactgccacttatcaggtagaattagatcttgtgtggagatagaggaaaacatattgtccttgccttctcggtccaggggcttagagagaggaaaagcctgtgaacaatatatggaagtattcataaaatgggttataagagcacattaatagtaccagatgtatttaattttctttttttgttgttgaatgtgaaacattggggccgggcatggtggctcatgcctgtaataccagtgctttgggaggccgaggcaggcggatcacctgaggtcgggagttcgagaccagcctgaccaacatggagaaaccccatctctactaaaaatacaaaattagccaggcgtggtggcgggtgcctgtaatcccagctacctgggaggctgaggcaggagaatcgcttgaacccgggaggcagaggttgcggtgagccgagatggcgccattgcactccagcctgggcaacaagagttaaaactccgtctcaacaacaacaacacaacaacaacaacaaaaattttaactttgtttcagaaagattaatcagccacttggtgtgtgagataatttagagaggagaaacattggacttgaagagatcaggagactgtttcctttatctaggttaggggtaaggggaaattgggaaattgaatgagtggtgtggcagtatggaaaaaacagaggggtagaattgtatgataaactcaaatcataaaaaattattttagattataatgaagagagtagtcattaatctatgtattctgaaaatattaaatatctaccatgtccaaatcactttgatgaggctacagaaataactaagaaaatgtatttcttgttctcatgaagattatattctgatttgttgaaattagccaatttcactgaagatataacatgtaaatcagacctgaaagaatgaacatcttttaataggttgcatgtttggtaaaaatgttaaaagcaccaagtttaggccaggtgtggtggctcacgcctgtaatcccagcactttgggaggccgaggcaggtggatcacgaggtcaggagatcgagaccacggtgaaaccccatctctactaaaaatacaaaaaattagccgggcacagtggtgggygcctgtagtcccagctactcgggaggctgaggcaggagaatggcgtgaacccaggaggcggagcttgcagtgagccaagatcgcgccactgcactccagcctgggagacagagcaagactccatctcaaaaaaaaaaaaaaaaaaaaaaaaaaagcaccaagtttaaatatggtaatgacttaattgaaacttaaaaaaattatatggtactatgcctccctgtttcagggaaattcttggccaaagatcacaaaatactccttcttgctcggtcctgaataattataatatataataatatttttggaaagcagtgggtgaaatgtttacaactctcagtgacaggtatatgtcagaatcctttttcaatgaaatccttggctatcacaagaagtcatatatcatatattacccacactggtttttcagctgacagtgaggtccctttctttgaattgtctccatatgttcaagcagtaaaaaacctccctggctccagtccacaaaaggtaaacaaaaattgtttgtagatggtgaagctgcacagatagaacttcttcacagcttcaccagggtgggtgacctgtcttcctgttttgtaggacagtgataatgtcgaaataagaatgtatttttcatttgtgagatgaagaaatcgggtttttttttgtaatagatattttttataatagatattttacacgagtgagatataacaattttgttgaacacttcattcatttttctttccccttgtaatttatatgaattatgttttcagaatgaaacagttcaaatatcactgtaccatgctcacttagtgacagtttatctgtcttattcccagagaaataaaagattgtcacatggtataatggctaagaagccagcctgcagggaaggactttcctagggtcccttatactccttccaactgtcatgtagaagatcattacacagttaaatgacttcatagactgcaatttctagggctatcaagttactactgtttctcccccaaataaggaagctgtaaaatatatactgaacaattatccacttgcttctagcaataactcattctgaaactgttggtttctgaacatgaattgattaggttaaccaagtaatctgtggatgttcagtagtaccttgttgatggtgattttctataaaagcatgctactggctgggtrtggtggctcatgcctgtcatcccagcattttgggaggccaaggcagccggaccacctgaggttgggagttcaagactagcctgaccaacatggagaaaccccttctctactaaaaatacaaaattagccggatgtggtggcacacgcctgtaatcccagctacttgggaggcttagggaggagaatcacttgaacccaggaagcggaggttgcaatgagctgagatcgtgccattgcactccagcctgggcaacaaaagcaaaactccatctgaaaaaaaaaaaaagcaagctactgtgatttctaggccagcttctccagaggaggtgggtatagttctctaaatacttaaagaagtcatcatccaagccaactaacaacaaccagatgtgtgggttatagagttgttcaaggttaattccaatggctcacaaaatggtaagtatacgtttggttgtttccctcaggatactgtagttgctctccaagctcttgccaaatatgccactaccgcctacrtgccatctgaggagatcaacctggttgtaaaatccactgagaatttccagcgcacattcaacatacagtcagtyaacagattggtatttcagcaggataccctgcccaatrtccctggaatgtacacgttggaggcctcaggccagggctgtgtctatgtgcaggtaagtagagatccatgagaatgagcrgacattgggaaggagagtcggagagcatcttccccttaggccttctctctctctttctttctcacttgtaagaaaagtagtttgaactgtacaatctttaaagttctttccaastytgatttggctacctatttcttcctaccagacggtgttgagatacaatattctccctcccacaaatatgaagacctttagtcttagtgtggaaataggaaaagctagatgtgagcarccgacttcacctcgatccttgactctcactattcacaccaggtgattaaagctggggtgctggtggccggcagagcacctggtcataggagctgagctgggacacttgygtgtgtgtgtgkctgtgtatgtgtgtgtgtacgtgtgtgtgtgtgtgtgtgtgttggggatgcagagtgcactgaagtaataggctcacatgtgttttcttcttcctgctctcagttatgtggggagccgtagctcttccaatrtggctattgtggaagtgaagatgctatctgggttcagtcccatggagggcaccaatcagttagtaagttacttctgttttcttcatttatctagytgtgaggggacctaacgttataatttaaaaaactggtaaaatgggcatcatggcgtgtatacacacacacacacaaggcatgtatatacatacatatatatgtatgtatatgtatgtacacttgtaagaaaagtagttttcatatatatatatggcatccatatacacagtatgtgattatatatatgtgtgtgtatacatatgtaggtatatatacatgtatatatgtgcatgtatgtacatatatgtgtgcatatatgtatatattmatacacacaaactcatgattggattatttaaatgggctgcaaggttgtagcagatatatgacatgcaacttgtaatagtcttggttcccttttcctaccttttccacagtatatattgtttccttgatcatggcagagctttggaagactaccccagggaaggctctggctcttagtatcttttttttctccctctcttattcagcttctccagcaacccctggtgaagaaggttgaatttggaactgacacacttaacatttacttggatgaggtaggtattcaggaaccagatcaaagagctggattgcttacggatcttcatgacttcccttctaatctgtatatacgggtgtcacacacatggggatgaggggcctgggagtgagtccacaccatgccatgagttctgcctccatgctggtataccgtaaaacaccccattgtgcctctagaggagccctgtccaacagacctataatgtgagccgtttacgacatttgaagatttctggtagacatttaaaaagtatagaaacagatgaaattaagtttaacggtatattttatgcaagcttatacaccccaaatatttccattttaccatacaattaatatacagacgtattaatgagatatctacattctttttttttttctgtaccacatctttgaaatccagtatgtactttacactgtcagtgcatctcaattctgactgacctcatttcaagtgctcaatagccacaagtgacattgcaactctagagtatgttatagtggttaatagcagaagctctgaagccagactgcctgggctgtgatcttggttctagcattgactgagtaactggacaagctgttgaaagttagctgtaaaatgtgtgtgggtaggggtcaaaatagttcttttagagttatagaaaaaactaaattatttaagacatgtaaaaatatttagaactgtacctggtatagagtaagccctcatcactttatagctattcctatcattttaacataatgttaatattacttaatattaatcagacattgtatgtaacctttcattttaacaaaacaagaagttctcaaggactaacaatgttctaaagattgttacaatgttccttttcatgatattccattccacacaaggaacaaagttatccttattgaatataaccaaaagacaagaatatcccaaatcaaaacatactgttgttagtaacatccatttccaaccccctgcccacccaccaaccccatcatctaactgtgtttcctgtcttccagggagccagggttttttatgttgtgtgagccgtgtatagtttcttttttyttttttttttgagacgcagtctcgctctgtcacccaggctggagtgcagtggcacaatctcagctcactgtaagctctgcctcccgggttcatgccattctcctgcctcagcctcccgagtagctgggaccacatgcgcccgccaccatgcccggctaattttttgtatttttactagagacagggtttcaccgtgttagccaggatggtctcgatctcctgacctcgtgatccacccacctcggcctcccaaagtgttaggattacaggcgtaagccaccgcacccagccgagttgtgtatagtttcttttgagacagctcgggttagcttatctggcactaccctgtaatcatgatgttgctgtttaaaactttgccaagtttatgatgctttcatacatgacttattcaagtcttacagccaccctccttagacataaggagacagagttggagagagagagtgggttgtccaagtcataccatctgtcagtgtctagggtgggagcagaacctggggagtctgatttccatgacaccatgcctgagactgcaatgaactgctcctcagtgtgtcctgccaaatctgccagttggcttctaatttgagttaacaggcctaatgatctaaaagccagtgctaatcattgtatctgtggttatttcctcttttctgtgtgtcttctcccttgtgttcttgatcaatttcaccagaggatgaccttattcacatatatagtcttccttattttttgatgaacttacactataagcgtccctctaggtacatgccatccctctcccacaatctcagacaagmaatgtttttactgtcattcagttctaactatttcttaatttgttgggaaacacatggaatttttaaagccatccttttgttcctgatgtctaattttgttgcattatggtctgagaatacagtcttcatgatcctgattgcctggaatgtgctgaagtttcttccatgacctaatccatgatctgtttttgcaggtgttcagtgtgcactccaaaagaacatctatttcttttctcttgggcttggattctgatctagaagtctgagatcattatttctgttgttcatgtgtttgataactctgcttatttttctgcttgatttaacaatttctgaaaagcatgtgttaaaatatccaattatgatggtttttgtttgtttgtttagtatttttttggtagagacagcgtttcaccatgttggccaggctggtcttgaacttctgacctcaagtgatctgcctgcctaggcctcccaaagtgctggagttataggtgtgagccaccacgcctggcctctaattatgatatttgatttatccatttatccatacatttctgccaattgtttcctgatatatttgagactacataattagatatatatgttatgaacatatcttcttattaaattttccttatattagtacatactatcctttccccattactatatatgtgtatatatttatatcatttacttttgccttagattcttacactcccccaccgccacacacacacacacaatttttttcccttgccttgggtgccatttagtcagatattaaaactgctacctggccgggcgcagtggctcatgcctgtaatcccagcactttgggaggctgagacgggcagatcatgaggtcaggagatcaagaccatcctggctaacacagtgaaaccccgtctgtactaaaggtacaaaaagttagctgggcgtggtggcaggagcctgtagtcccagctactcaggtggctgaggcacaagaatggcgtgaacctgggaggcagagcttgcagtgagccgagattgcgccactgcactccagcctgggcaacggtgcaagactccatctcrgaaaaaagaaaaaaaaaaaaaaactgctaccccagctttcttttggttcatattagtcatttgctttaattcattatggtgaccaaatgatagaaaagaacagtggttctaaaaattctttgtttcagtgtccctttatactcttaatttactgaggacctcaaacagctttcggtgaagtgggttttaactattggtctttatcatattagaaattaaaactgagacaatcttaaaatatttattaattaatttaaaaatgataataaactcactacatcttaatataaataaaatttttgtgaaaataactattttctggccaggcgtggtggctcatgcctgtaatcccagcactttgggaggccgaggcgggtggatcacgagatcaggagttcgagatcaacctggccaatatggtgaaaccccatccatctctactgaaaacacaaaaattagctgggcatggttgtgcgtgccggtagtcccagctacttgagaggctgaggcagaagaatcgcctgaacctggcaggcagaggttgcggtgagccgagatcatgccactatactctagcctgggcaacagagtgagactccatctcaaaaaaaaaaaaaaagaaaaagaaaaagaaaataactattttccaaaacaaaaaaataagaatggtgacattgttttgcatttttgctttaatatctggcttaatcaaagagaatgaaattttcctatttactcctacattcaaaccgttgcaatattacacataaagtagcctctgataactctcctgtatacttgttttgttttttatttttttaaatcactttccccagaaggaaacaatctcctgtatatttgtaagagaatgagagtggaaaaaaaaagtcttaatatcattctaaaaataattctgacctctcagatattctgatgcaatctcggggatccctggagtaggggaggtccctcgaccacactttgagaagcactatacctgaagaactttggaaatcccttccaattaggcgttaatagcgctatatctaaatttataatacgatttttttttttttttgagacagggtctcactctgttgcccaggctggacttcagtggcccgatcttggctcactataatctccacctcctgggttcaaatgatccttccacctcagcttcccaagtagctaggatttatttttttatattaaagtaacttatacaattgccttagattctccatttgctaatttattcaacaaatatttactgaacaaccaacatatgccagtcacttttctaagtgatggagacgtagcaatgaaaacaatagatatgatacctggcctaagagtgctgatattctagtggagagacaacaatattcaggtttttaaaaattacatgtatatgtgtatacacacacattttttttcagtagtaataagtgctatgcagcataaggggataaagagtgctggtggggcaggccagggatgtgactctttttaaataaggtgttcaaggaaagcctctttgaggaggtatcatttgctcagggaccagattgaagaaagcaaaccagtaaggggcatagaactgttggagtaaaatgcaagcctctgtttctctggccactttgactaatttagtggagaagccatgggtcagggtggaccatgaacaaagggaaccagttcacaagagggccagagagctgtaagatcctaagaagaaagagccaggaagtcagcaggaggcaatgtctttaagactcatagggcagtagcggtacatagagggtttcagagaatctttttttaattaaaaaaaaaatttttttttaatttgagatggagtctcgctctgtcgcccaggctggagtgcagtggcgccatctcggctcactgcaacatctgcctcccaggttcaagcgattcttctgcctcagcctcctgagtagctgggattacaggtgccagccaccatgcccgactaatttttgtatttttagtagagatggggtttcaccatgttggccaggctggtctggaactcctgacctctggtgattcacccacttcggcctcccaaagtgctgggattagaggcatgagccaccgtgcctggcggggcttcagaaaatctacatgaagacagcaagggtcttttattccacattgcatacagtgtaattttcattttacttctaaggtactgtttcatctgtcttccccacagctcattaagaacrctcagacttacaccttcaccatcagccaaagtgtgctggtcaccaacttgaaaccagcaaccatcaaggtctatgactactacctaccaggtgagagggctgagctgaaatgagakctgagatcttacctgcatctcccaacttacttctgcctcattcttcatggcttctctcttaattttacaaatactccttcccaagccaagtagcacataattaaattatctaatctcctaaaatattttaattcagttgtgtgccatttttaagttgcgtacactagagacattttatrtgatcggagaacaatgtgaaccattgttctcraagggctatttctattatttttggtatgattaatagtttgtcacaatgtacaaatattagtgattgaarctttcttgtaattctgaatatgctcataacctgtagagattctctggaaggggctcaagcagtagcttttctgaagcattttycctctgaatataggaggccctcaaagtaataatatgwcttatttcatttcacagatgaacaggcaacaattcagtattctgatccctgtgaatgaggtaagtccagcggagaaatgggtggagttatgggttagggtggcagaagttaagaggagcctcttttcgagttactgtcattgtctttttttgagatagagtctcgcggtgttgcccaggctggagggcagtggcggaggttgagtggctcacttcccagcttcaagcgattctcctgcctcagcctcctgagttgctgggattataggcgcccaccatgatgcctggctaatttttgtatttttagtagagacagagtttcaccatgttgaccaggctggtctcgaactcctgacttcaggtgatctgcccacctcggcctcccaaagtgctgagattacaagcatgagccaccacactcagccctgttattgtcttttggaagctattgttgatagaaagtgagctttccttttttgtcttaaactttttttttttttttaaacaggatctggctctgttgcccaggctgyagtgcagtggcgtgatctcagctcactgcagcctctgcctcccaagttcaagcgattcttgtgcctcagcctcctgagtagctgggatgacaggcacgtgccatcacgcccagctaattttttttgtatttttaatagagatggggtttcgccatgttggtcaggctggtctcaaactcctggcctcaggtgatccgcctacttcagcctcccaaagtgctgggattacaggtgtaagccactgtgcccggcctgtcctaaactcttgaaaatagtttacagaagaaaaagctaatgcttggtattaaaacaatacttttttctatcagattgaaaatggattgatttttcctgatatttttacatgatacatctttgttatatgaaaatactaagacaaaagtaaaggttacctgattctacacctgtgagataacactattaataatccaactgtgcatttgtgagatttttttgtatatatakagagaggtcaagtatcctctatgtatgtaatgagcttctgagtatcacagtgtcttctattttttgtttgattgttcgcttttcaggataggagctggaaactcaattagtcctctgtgacatttactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatggrcagggtcatagggggaagaaaggtggtttagctgttttatttagccattcagggggctctccagagaggagacggtggtagagggtgaactagagaagataagaatgtcttcctaggccggatgcggtggctcacgcctgtaatcccagcactttgggattgcgaggtgggcggatcacttgaggtcaggagttcaagaccagcctggccaacatggtaaaacccgtctctactaacaatacaaagattagcctggtgtggtggcacgggcctgtaatcgcagccccttggaaggccaaggcaggagaatcgcctcaacactggaggtggaggttgcagtgagctgagattgtgccactgcactccagcctgggcaatgaggcaagaccctgtctcaaaaaataataaataataataataataatgtttttctagagtttcagtctaagggaaaatgtgatttagggctttggaaattggctaaaaaaataaaaatggaaaagaaaatctgtgcatttagttctatgcatatttctttggaaaccaaaagttcttttaaagatgatgatcatcctttcccccaaaactcacaatttggtttcttccttaaaccttttaacccagacttctcaaagaatcatcttaaagatgtgasgacaggttagaatagagaattttaattatggggctctgctcaaccagcccgctactgcagggcaaacagtgatggattacaagaaaagtggctggccagaatgccgtttccatctctctcggtttctcttctgcatgattctcccaacctctccccacrtgggctatctatcacctatcaccgtgcaagcacttcctcagaggaatgcttttgttttggaaacaggtttggaggcaaagggataagggaagtaagatgaatgatatttaacagaaaagattctctaggcaattacacccttttatcctgggtatccactggatccattatgctccccttgattgcaaattctgactgaaaagtcagggaaaataagtacattctacaaaaataaaaaatgacagatgggacctacttaaactaaagagcttctgcacagcaaaagaaactatcaacagagtaaacagacagcctaaagaataggagaaaatattaacaaactgcctccagcaaagaactaatatccagaatctataaggaacttaaacaaatcaacaagaaaaaaacaaataatcccattaaaacgtgggcaaggggcatgagcagacacttctcaaaagaagagtacaagtggccaataaacatatgaaaaaatgctaaccatcactaatcatcagagaaatgcaaaatcaaaaccacaatgagataccatccacactagttagaatggctattattaaagtcagaaaataakagatgttggcgaggtagcagagaaaagggaatgctaacacactgttggtgggaaggtaaattagttcagccactgtggaaagcagtttggagttttctcaaagaattaaaaatagaattaacattcaacccagcaatctcactactgggtatatacacaaaggaaatacatctttctaccaaaaggacacatgcacctgtatgtttttcgcagcactattcacaatagcaaagacatggaatcagcctagatgttcatcaatggtagagtggataaagaaaatgtggtcyatgtataccatggaatgctatgtagccataaaaaagaatgcaatcggcccagtgcggtggctcatacctgtaaacccagcactttgggaggccgaggtgggtggatcacctgaggtcaggacttcaagaccaacctggccaacatggcaaaaccccatctctactaaaaatacaaaaacctagcagggtgtggtggcaggtgcctataatcccagctactggggaggctgaggcaggagaattgcttgaacctgggaggtggaggttgcaatgagccgagatcatgccatcgcacttcagcctgggcgacaagagcaaaactccgtatctaaataaataaataaataaatagaatgtaatcatgtcctttgcagcagcatggatgcagctggaggccattatcctaagtgaattaatgcagaaacagaaaaccaaatactgcatgttctaacttttaagtgggagctaaacctgttgtacacatagacacaaagatagaaacaataaacactggagattccaaaagggagaagggaggaaagagggcaagagttgaaacctacattcaggtactatgttcactatttgggtaacgggatcactaactcaaaccacagcatcacgcaatatacccatgtaacaaaacctgcatatttaccccctgaatctaaacctgcatatgtatctcctgaatttaaaattgaaaaggccaggcatggtggctcactcctgtaatcccagcactttggtagtccaaggtgggtggatcgcttgagctctgagttcgagatcaacctaggcaacatggcaaaactccatctctaccaaaaatacaaaaattagccaggcatggtggcgtgttcctgtagtcccagctactccggaggctgaggtgggagaatcgcttgaacccaggaggaggaggttgcagtgagcctagtttgcaccactgcactccaacctgggtgatagggtgagaccttgtctcaaaaaaatagaataaaataaaataaataaaagcgtatactgaagagaatattcccccaagcccagggtcacagttgcattaattgttctgtacctttctcctccatccttgtgtctgtcctggtccttctaggagttcctatagtgagggcagatgggggaagatatgcaaaggaggtcattcccaagcttgcctcttgggtatcaaaggaagagagcagagggaactctaaagaaaagaaggtagttgtcaggtgcagcagctcacacctgtaatcccagcagttttggaggcttaggcgggcggatcactagagatcgggcattcaagatcagcctggctaacatggtgaaaccctgtccctactaaatatacaaaattagctgggcgtggtggcatgcgcctgtaatcccagctactcgggaggctgaggcaggagaatygcttgaacccgggaggcggaggttgcagtgagctgggattgcaccactgcactccagcctgggggacagagtgagacttggtgtccaaaaaaaaaaagaaggtagtcatgatcatgaaagccccttccactcactaaaagctccatcccatgtacattttgggtctgcagcacttaccagagcatcccctcttttggaacgaaaggaaatggtgatcctcaagacttaagaggttatgcgggcagaatacatcttaaatgattaggaaaactctttattcttgtatctttgggatttcagataggataaaaagaatattcttatgcttaaattatcaactacgctgaataaaaggatgttaatgagaacatgtacattgtccaactcattgaaatataaatatttgtgcatatttgagaaggtgattgtgaggattaggtggcatttagcattcaagtgacacttggtattacagtacttacagtaaatactgatacatacatttattatatgtcaggtattacaccaggcctgggaatacaaagataaataaaatgaagtttctcttctcaaaaagctcacagactagtggagggaggaaggaaacaaacaaattaacagttataatacagtgtgaccaaaaaaatgatagaagaaagcacaaaaagctacggaaggccaggtgtggtggctcatgyctgtaatcccagcaccttgggaggccgaggcaggcagatcacctgagatcaggagttcgagaccagcctggccaatatggtgaaacctcgtctgtagtaaaaatacaaaaaatcagccgagtgtggtggcaggtgcctataatcccagctaattgggaggctgaggcatgagaattgcttgcatctgagaggtggaggttgcagtgagcggagattgtagcactgcactccaggagcctgggcaacagagcaagactgtctaaaaaaaagaggtggggagaaagcacggtatttcacccaagtaattcagtgtactcatggattatgtgtgtgtatgtgtggggcggggtgggggcgtgggtagtgtctcctcaaagttagactgggaaacagagattggataatgacttgcttttcagaaagatcattctagcagtaatgtgaagaatggggtggagaagaagaaagccgaagtccttgaaaccatttaggagactgctacagttatccaggtaaaagctggtgaacggggagtgggagggggaggaggggacactcagcagctactcagcttagctgatagaatcaggaagacttactgacatcaaagacaaaacgtaccagacaattacacaggtggttttattcgggccattgcaatcaagaacacatgttcattaattaataacatctcagagaaaaggaaggggacctgaggtttcatagaggcagcaaacaaaagagtcatacatggatcttatgggagccataatgaaggatggagatgaggctttttatggaatatgtgtgagcagagtgattctttgcagttagcttttttgttggaacacaaaaggttggagggttttggaaaacaacacgatgggtaaatttcttaactgacctgttttacagaagcacagggytcaggtggttcaccagtgtcagagactaagtgaatgcaagaaaggagagtaagggaagaggctgggaagactgccagaattctagactgtggattacatacaggagaaaaaccttttcctctacctgttaggtttagtatacggggcctgcaaatgaaaccgagaaaagacagatgaaagggaaaggcttatttcacaagcatgtgacaacttcacagggaagaagtgaaaataagagaagcaatkaggaatgggggcttatatgccattttaacaaaggacaagttgtggaaacattaacaagaccaaggaagtgagatctgggcatttggggcagtaagttatgggaaggtaaatatatcggaggcactaatggaagataatrrccattttagtaagatttgtttacgcagattcaagttggtgctgactttctgtctcttgtcatataagttattctccttctcctgatatgggagagggggagagagacactttccttcataaggggaaatttatatcctgcttttaagtgtttcttaattgccttccagcacaaaatcctacttatgccaaagtggcacaatttggactggcatattttgatcccttttaactgggtggatggtgccatccatgcaggtacagatatagaaagagagaaaatagtgtgttcagtttactacattaagtttgagtggctgggtgtggtggctcacacctgtaatcacagcactttgggaggcygaggcgggtggatcacgaggtcaggagatcgagaccatcctggctaacacggtgaaaccccgtctstactaaaaatacaaaaaattagctgggtgtggtggtgggtgcctgtagtcccagctactcgggaggctgaggcaggagaatggcgtgaacctgggaggtggagcttgcagtgagccgagattgcgccactgcactccagcctgggcgacagagcgagactctgtctcaaaaaaaaaaaagaaaaaagtttgagaatgtgtaagtcctgatggtgaagatgttgagatagtgggatataaagggtcatgtcaaccattaaagaaagaaatctgaagataaagactggcagttagcagcaaataagtagtgagaagccaagagtgttgaggactagctagggaacaggaaatgagaagaggagagactgaaagggagtgccaacatttcaacagcaaaggaagagaagggacttcagaacccaggatctcaccaatatttcttcccataacaatggcctcttgaaggctttcccttctcctacctcccccttgaatccccgccttcatcaaggatttggtaggaagtggaaaggaaccagtatcagaaaagaatcctacttttttttctttctaagaatcctaccttaataagcaaaatatgtcacatttggagcacagagaactttctatccttcttcctgtagccctgttgaaatatttatcatatctcatccagactgttgcaaaaacccagttgctgccccttctatgtcagaacattcctccacccctatgtctattattttattttacatattctctatacacaaggctgcctctattcaactaacccttagaattgtgtcaggtgatgtactgccagctatttaaaatctgggccaggtgcagtggctcccacctgtagtcccagcactttgggaagttgaggaaggaggatcacttgagcccagaagttcaagaccagcctggacaacatagcaagacccaatctcattctttttaaaaaataaaatcctaatctgattatgacattcatttgcttaaaacccttcaggggctgttaggggtaaagttctattcctgttcatggcatagcagactttcatgactattttcttcctgccccctccccgccagctccatcttcggcctttgaccctcacacttcaggaacacggaacatttggttcccaatttccactaaaatctccgataactttcaaagatgctttctatcatgcttgaaaagcttttctctcttctgcttggaggacttccactggtccttcaaggaatggcctccaaggtgtgtttcctactctggcaaggcttccttaagagctctttgctcctacagcacctgtgattccagcggaggatttaccaagctgggttcctgttttctgttgaccctcccatctcccccatcagagtgtaagatctctggaargctggaccctgtgctgggtgcttccaactccccaccaccacaccccattatctattctctttatcactgacaaaaagtacaattttatttggagcagccacgtgcccaactaaaatcgtcaccttctcagaatcgcttgcagttaggtttggccatgtggcagaattccagcctacaaaaagtaaccggaagtccctggaaagtatttccttcttcttcttctctctctctctttttttttgagatggagtttcactcttgttgcccaggctggagtgcaatggcacgatcttggctcactgcaacctccacctcccrggttcaagagattctcctgcctcagcctcccaagtagctgggattacaggtgcccaccaccacgcctggctaatttttgtatttttactagagacggtgtttcaccatgttggtcaggctggtctcaaactcctgacctcaggtgatctgcccacctcggcctcccaaagtgctgggattataggttgagccaccatacctggcctgttttttatttttatttttaatttttgagacagagtctcattctgtcacccaggctggagtgcagtggcacgatcttggctcactgcaacctctgcctcccaggttcaagcgattctcccgcctcagcctccccagtagctgagactacaggcgcccgccaacacgcctggctaatttttgtatgtttagtagaggcagggtttcgccatgttaatcaggctggtcttgaactcctggcctcaagttatctgcctgccttggcctcccaaagtgctgggattacaggcgtgacccaccacacctggccctgttttttgaattctagccatcttagtgtgtgtgaagtggtatctcattgtggttggatatcctctgatgaaaaaggatctgttcaaggcttttgtttatgattctggattgactttcttttgaaattcttttttttattttttkwttttttttgttttktttttttttaactattttccttttttttaacttttatttgaggtttggggctacctgtgcaggtttgttacataggtaaacacgtgtcgcgggggttggttgtacagattatttcatcacctaggtattaagcccagtacccaatagttatcttttctgctcctctccctcctcctactatcctccgtcgagtagactccagtgtctgtttttcccttctttgtgttcataagttcttaccatttagctcccacttataaatgagaatgtgtgggaattggttttctttttcttttttttctttttttaagacgaagtctcactctgttgcccaagctggagtgtagtagcgcgatcttggctcactgcaacctccacttcttgggttcaagtgattctcctgtctcaggctgccaagtagctgggacaacaggcatgtgccaccgtgcccatgcaccaccatgcctggctaatttttgtatttttagtagagacgaggtttcactatgttggccaggctggtgggatttggttttctgtttctgcattagtttgctgagtataatggcctccagcttcatccatgttcccatgaaaaacatggtctcattcctttttatggctgcatagtattccgtggtttatatgtaccacattttctttatccaatctctcattgatggacatttaggttgattccatatctttgctattgtgaatagtgctgcaatgaacatttgcatgcatgygtctttatggtagaatgatttatattcctctgggtatatatccagtaatgggattgctggcttgtgaaattctttatatgtctagatcagaggactttgtgagattttcagacttgcaaaaagttcagaataaacttcagtaccgcaaatatcttcttcagtctatgggttgccttctcactctttcaataatgtcttttggtgaacaaaagttcttaattttaatatagttcaagtgagtgattttattattctatttaagaatcttgcctgggtgtggtggctcacatctgtattcctagcactttgggaggttgaggtgggaggattacttgaggccaggagtttgaaggcagctgtctctacaaaatcaaaatcaaaataaagagaaagaaatctttacttcagggtcaaaaaatgctttccttatgttttcaaataaaagctttttattttattttattttttttagaaaacagggtctcactctctcactctgtcacccaggttggagtacagtggtgcaatctcagctcattgcaacttctgcttcccgggctcaagcaatcctcccacctcagcctcctgaatagctgggaccacaggaggcacatgccaccacaccccgctaattttttgtattgttttgatagagttggggtttcagcatgttgcccagactggtctcgaactcctgagctcaagcaatctgcctgcctcggcctcccaaagggttgacattacaggcrtgagccactgcacccagctaaaagctgtttttgttttaattttatctgaaattgctttttgcgcatggtatgagctaggtcaagagactttgttttcctacatggatatttaatatggctcagatcatctattgaaagaccatccttttcccactacattacagcatgttgcttttatcataaataaggtagccatacatgggagagtttattcctggattctgttttgtcycattgtttacttcgcctatccttcaacaatatctcacacacacacacacacacacacacacacacacamtatagttttattatagttcttgattttgggtagtataatcctctagattttgtgattcttcttcaagatagccctagctattcttggcattttgaatttccatataaatttaaatcagtttgttaatttcctcaaaaaacctgctgggaatttgggaggattgctttggagctatagagttgaagatgactgacatctttataatattaagtttctaatttatgaacatgctctatcccttaagtattaagtccatcctcaatttctctcagcagtgttttgtagttttcagtgtagtgggtgttgcacatcttatattaaattaattcctaggcagttggttcttttgatgttatgtaaacaatttcagtaataacatctaatttcctatttattttgtatttggaccttgaatccagcaaccttgctaaatttgcttattgtcttggttttttccttaggttcttttaaattatctcagtacacaattgtgtggtccatgaacaatgacagcatagtggactctgtggcacggcacccagaaccaccccctttcaagacagaagcatttattccttcacttcctgggagtgttaacaactgatagctaccagttgtgcccgctctggacttttgcccatagtggcctatcctctgtgattatgcatttgtaactgtgttcttcctcttctgaagacatcagtcacattggattagccacccttatggctgcatttcaccttgattaccactttaaaggccctgtctccaaatacagtcacattgggggttatggctccaacatactcatttggaagccaggtgtggtggctcatgcctgtaatcccagcactttcggaggccaaggcaggaggattgcttgagcccaggagctagagatcagcctgggcaacacagggagactcatctctacaaaaaaatataaataaataaacaaaaaaatttaactgggtgtggtggtgcatacctgtagtctcagaaacttgggggctgaagtgggaggatcacttaagcccaggaggtcgagccaagatcacgccactgcagcactcaagcctgggcaacagagcaagaccctgtctcaaacaaaacaaaacgaaacaaaaaaaacaaaaaaacccatataaattttggggaacacatttcagttcataataaagtggaaaaattaaaagaaattaaatttacagtttaaagttatgctagaatagacatgaagtagcccccctgaaataagagttaagaaagaatattaactgctcctctgtaaggtctgtgaagcattaaccatatctctcccccacatattttgtaagttctgtaagctcctgtttttcttgctgtgcagctgcaaagtcacaagatagataagcatgagtcgcaagacatgttttcccaagatgtaagctgagtcctaagaatgtcacctgataattaactgctttgttctcgcttttgtaaaccagcttcctgcatcatataattcccacctcaaagtgcataaaagacattcattttctttgtttgctgctcagactttcaagatgcatgtccgctgagctagtgtacacttaaaataytccctcctgaactccgcttagtctctccagtctctgatttcccactacaataacacatccctgaagagattttggtttgaccaatcaaaaataataattgtgttttctgtgacgcaaacataaggaaacctatagactcaaacattttttattgcctacctcctaaaataattttttaaaataatttttaaaaagcatacattcttttgcatatttttggtcaacatttaatttttttttttttaagacagtgtctctgtcacccacgctggagtgcaatggtgcaatcatggctcagtgtagcctcaacatcccaggctcaagctatcctcctgcctcagactcccgagtacttgaaactacaggtgtttgccaccacaccaggctaatttttgcattttttgtagagacaaggtttcrccatgttgcccaggctggtctcaaactcctgggctcaagcaatcatcccatgtcagcctcccaaagtgctggaattactggtgtgagccaccatgcctagccttcatccacttttatcagagaattttatttaatatgtttttatgcttaaaagttttattgatcatcttatcagagtttctgccataaaaatatgtctataacttcagatatcaaaacatttttattttataaggctcaaatatattcaaggcttcttgtggattgagttaacatcacaattagacatattggatcaaaacagcacacatttttaaaataagaagttaaaaaatatcacttcttttgttttgagacggagtcttgctctgttgcccaggttggagtgcagtggtgtaatctcrgctcactgcaayctccgcctccggggttcaagcaattatcctgcctcagcctctctagtagttgggattacaggtgcgtgccaccacacccagttaatttttgtatttttagcagagagggggtttcactacattggccaggctggtctcaaactcctgacctcaagtgatcctcccgccttgccttccaaaatgctgggattacaggcatgagccactgcacctggccaaaaaatattacacataataaaaagtaaaaactagaagcacattttctaatgacatgaatgtggttgggatttttttcaattatccaataatatattagtgcatacattcacagatgattattgcttatttctttttttctttttttgacatggagtctcactctgtcccccaggctggagtgcagtggcacaatctcagctcactgccacctccacctcctgggttcaagtgattctcctgcctctgcctcctgagtagctgggactacaggcgcctgccaccacgcctggctaatttttgtatttttaatagagatggggtttcaccatgttggccaggctggtctcgaactcctgacctcaagtgatctgcccaccaaagtgccgggattacaggtgtgggccaccatgcctggcccataatttgcttatttctagaatgagacaagaatcaagattaattgtattccaatttttaatttcttcaggtatattatttgagaaatctcactcatataaataagagtagaaggcatttagctttagcaatgccagtgaattttgtgaactctttcaagttatataccaaaaccttataataatctttcatcaaaaactgattyatcagcactcaacttgattagatgctcctttaatttggttgaaagaattataaatcttgacttccaaaaagatttttcatgaaagtactttatctacacaaagtgacaatatttcaaattatctttggtggtcaagagggggtatgtgtgtgtgtgtgtgtatgtgtgtgccctagaacagcataccatggaaggaatgagagttgcagtaaccttttgtaaagtgagcagggagaggggaaagaagatgctttgacacgtagagaacattcttggtgaagtgtcaagatggagactgcatctggaagtcaaaatctggaaatttcagccctgtccatgttggaaaggctttgtacaccccagagatacatgtactccagtttgaaaattgctgatgtagtgtgtatctagtgtcaatcagcckgtgttcaaataacagctctacatcttgctagctgaatgactttgggcaatttatttagcctaactatacctcagtttcctccttggtaaaatgggagtgataatacctcaaagagtggtagtgaagataaaattatctacgtaaagtacttaaaactgatagggaggaagggagggattgcaaattagcacaagaaagctttgggggtgatatgttccattatcttgattatggtgatagtttcatggttgaatacatgttaatattcatcagattgtacactaaatatgtgctgttattgtataccaattttaccttaggaatgctgtattaaacctgggcacagtggctcacgcctgtaatcccagcactttgggaggctgatgcaggcggatcactttgagctcaggagttcgagaccagtctggccaacatgatgaaaccccatctctactaaaaatataaaaattagcctggagtggtggtgcacacctgtaatctcagctacttgggaggcaggagatttgcttgaacctgggaggcgggggttgcagtgagctgagatcacgccactgcactccagcctaggtaaaaaagcaagactccgtctcaaaaaaaaaaaaaaaagaaaagaaaaaaagaagaatgctgttttaaaatctttcattttttatttttaaaaaatagggacagggtttcaccgtgttgcccaggcttttctcaaactcctagacttaagctgtccactggctgcagccttccaaagtcctcggattacaggcttgagactctgtgcccggcctgttttaaaaatcttaattggcatttaatatatattcaataaatattagctattattgtgaagagagattctggacctttcttgccaggaggtaaaatttccactctcaatgtaggcccctgttgtttcactgggacctttctcccctctctacagctttccccttccccagccccaggaaaggtggaggcgccaccttctggtcakaaakgagattacacaatggtgtcctgcttttaaactttttgttttgttttagcatttattttcgaatagacaatacacgcccacgtaaaaattcaaaggtcctaagagacaccttccacatttcttctctcagttccctcctcggatgtaacctatactattacttttgccaaatgtcagcgccctgaaatacaccacccgaaatctcacagataggcaaagctggagtttattcatgtcttagcaagggagcacaccgccttgcggaaacttgagcagcatctgggaggggagggcaaagggaggatatttatgaggytctaggttggattaaggtgggtctttcagtgaagggctctgattaagtttgggtacggatcatgatttagcaaggtgagggcttaaaaaagttttggagcatgaataatcatttgataactgtactggaaagctaagcaatttaaaatacgttgtctggatattcctgaaatgaacaataacattatttaaaagttttattttaaaaagttttttcagttaaaaaaaattaaaggcataagtatgatacaaaggactttggggacttgggcggaaagggtgggaagggagagaggaataaaaaactacaaattgggttcagtgtayastgctcgggtgatgggtgcaccaaaatctcacaaatcaccactaaagaacttactcatgtaaccaaataccacctgtgccccaataacctatggaaataaaaagtttttaaaaatttcattttgtgagtgcagagtaggtatatgggatacatgagatrttttgatacaggcgtgtgatgtgtaataatcacatccgggtaaatgggatatctatgacctcaagcatttatcctttgtgttacaaacaatacaattaggccaggtacagtggctcacgcctgtaatcccaggacttttgggaggctgaagtgggtagatcacttgaggtcaggagttggagaccagcctggccaacatggcaaaaccccatctctgctgaacatacaaaaagtaggcgggcgtggtggcgggcgcctgtaattccagctactcaggaggctgaggcaggagaattgcttgaacctgggaggcagaggttgcagtgagccaagactgagccactgcactccagcctgggtgacagagtgagactctgtttcaagaaaaaataataatacaattgtacttttagttattttaaaatgcacactaaattattattgattagagtcactctgttgtgctatcaaatactacattttattcattctatttttttgtacccattacccattcccattacagcttttatttttggggcaagggcttcctgaaatactaaagtcttgttggtaaagacagtagaatagcaaagtcaagctaatgtaggcagtaaagtgtgtgggtggggcttggctaattctcagtttctggtatatcttttcagagatattctgtgcttattcaactatacatgtataaatttcttttattattatttttatctttttatttttttttgagacagagtcttgctctgtcacccaggctggagtgcagtggcacgatctcggctcagtgcaacctccgcctcccaggttcaagtgattcttctatctcagcctcccaagtagttgggattataggctcccaccaccaagcccagacaacttttttgtatttttagtagagacagggtttcaccatgttggccaggctggtctcaaactcctgacctcaagtgatcctcccctctcggcctcccaaagtgctgggattacaggtgtgagccaccgtgcccagcctatacatgtataaatttaagaaatgtgatattttcccctttaccagttgttgcagaaatccagaaactgagtatgagatattccttaaataatggcgatccaacagcgtttgctctgtggtgatatgtgatgtactttcccaaagtacgtatatttacgtattttgtgttgaatggaattaccgtttgaggtattctagtgttttccctctcagcaatttatctaacagattatggttttggcaaaatctgtggggcacattttcttattcctggtttcctcttttccatcacaaagcagagtacagggctgagtggcaggggacagaaataattattccataagcactgaaatctgaaggccagcagaggggccttcattaagtgcgaatctgttgggcacccactgagtagtgaacaggatgaatgtgacaaccacactccctgcccttcccaggcttgcagcttagtgagggagagcaacactrcctgcccttcattagggggatgaatgtgacaaagcacagtcaggttgtgggaacctaacctaatctttgggctgaattaagaattcccagaagtgacactcaagttgcaagatgaagaataarcaggaatgagacaggtgaggggtgcggtgtgggaggattgttcttgtaaggggagatagcctatgccttctctggaactgagattacttttctccgtgtttctggtttctgtgttccgccatttgttctgtacatcttgtggtctgctttccagatttttttttttttttttttttttgagacggagtctcactctgtcccccagtctggggtgcaggggcgcaatatcggctcactgcaagctccgcctcctgggttcacgccattctcctgcctcagcctcccaagtagctgggactacagtcacccgccaccacgcccggctaattttttgtatttttagtagagatggggtttcaccgtggtctcgatctcctgacctcatgatccgcccgcctcggcctcccaaagtgctgggattacaagcgtgagccactgcgcccagctttccagatattttgaataggaatgtacacatagactttccaagtgaggaagtcaccatcctaaatgcataagaatccatcctatgactaaagtccctcatcagcgagagcctctcatgttagtggtcctagggagacaagaccctgtaccttttttagttctcaggagatggagtgaagactattttctgcactcttgataaagttcaagaaatgcccatcattggcagaaaatagaattagaatttcttagaattggaaatgtctttagaaatcatgcaatcaggtctcttcaactgaaaaatgaggaaaataagacccaaagtgcagaattcctttctaaaaattttaattattttaaaattattattactttatttatttatttattttttgagatggagtttcactcttgttgcccaggctggagtacaatggtgtgatctcagctcatcagctcactgcaacctccacctcccgggttcaggagattctcctgcctcagcctcctgagtagctgggattacaggcgcacaccaccacgcccagctaatttttttgtatttttagtagagacagggtttcaccatgttagccaggatggtctcgatctcctgacctcctgatccgcctgcctcggcctcccaaagtgctgggattacaggcgtgagccactgtgcccagcttatgatgtcaaattttagatgtcaacttaaaaatatatcaggggcacatttaaagtattttattttgatatacactttaatattaaaaaattaattttgcaaatggtgattctctgaattctcatgttaactcttaaaattttatttcctttaggggaaatacattacaaaccacaaagcttcatcttaaaacatagagatgctatagaaatggatgacatttacttagctctctctctttcccattgtgaccacaaaaatgtcaacaaatagacaagagacctacacaaatgtctatgctaagcagcagatttatcactcacagccacaatttctaactctggctttccttgctgggaagttttttgttgttttgggttttttagattactttagaaaaccatttattaaaggaagagtgtttaaacattaatttaggttaatataaagagtgtagccactccctagatctagaaatagattgccagcaacccagagctcatacgtaccaattcccaatcaaacccccttcccagcccccagaggaaactactacattgacattaaaagtaataacttctttgctttactttctggttataatacccatgtatgcctttccaaacatcgaagtttagttctgtctggctttgaacttgatataaatgaacaagtatttcagacagcatgtattcttttgtctgggcttccattacttaataattaggtttttgagattcatatatattgttgcctatagctatacttcatttattttcactatagtgtcgaatttttagcattgtatgaacagatgacaatgtagccattttattgctgataaacagttgctgctgggaacatccttgtacatgactccaagtggamacaagcacacattcataagagtgagatgactgggtcacaaatagttgaatcttaaattttactagataatgtcaaaygcttttaactcttggcactatcacattttaaaatttcagctaatttggaacatgtgtaatggtattatatttcattatgtttttatttgcacttctacctaatttgattactaatgaggttgagggatttttctacatttttgactatttggatatcatattttgcttgagtcctttgcccatttttctyttgggttctcygattttttttcttttctttctttcttttctttttttttttttttttttttttttttgagagagagtctgactctgtcacccaggctggagtgcagtggtacaatctcagctcactgcaacctctgcctcccgggttcaagcaattctcatgcctcagcctgtagctgggattacaggcatgcgccaccacacccggctaatttttgtgtttttagtagagatggggtttccctgtgttggccaggctggtcycaaactcccaacctcaggtgatctgcccaccttggcatcccaaaatgctgggtttacaggcgtgagccattgcacctggcctaggagttcttatatattstagatatgagcttctttgggttacatgacttacacaaattttttttttyctactttgtggcttgccacaaagcaaaactcaaaatgttttccacagccattcttccattttaaattcctaccagcagtatataacagtcctgattaatccacatcctcaccaacacttgttattgtttttctttttgattctagacatcctcgttggtgtaaggaggaatctcattgtggttttgattgacatttgtagcttgccttttaatggtgccttaataaataaatattttcaactttaatgctcaaaacaacaatcttttcccttattgttagtatattttatgacttgcttaagaactccttccttactgcaaggtcatgaagatagttttctgtattatctttcagaggttttatttatatatttagacagactcttgttctgtcatccaggctggagtctagtggcacaatcttggctcacagcaacctctgcctcctgagttcaagtgaatcttgtgcctcagcctcccgagtagctgggactacaggtgcaggccaccacgcccagctaatttttttttgaatttttagtagagacgaggtttcaccacgttgaccaggctggtcttgaactcctgaactcaattgatccacccaccttggcctcccaaagtgctgggattataggcgtgagccaccatgcccagcccacttttatctatttatcaccatacatattagtttctctctcctttacatatgcaaaataccccacaaagagagacaaccctcaagtcctgtccagttacagcattaagctcaaagttcagaatctctaggtgatatgtgatagcccctatatttgggaatgatgtgaggcagtgcttgcaccacgttcagacgtggccgttttgatctggagacgtacgaactaaaaagacaagatatctgtgcctcgtctcccaccaatgtacaatggtggaatggggccaggaaaaccctcccattaggaaagggaaatacaaagcattctgtagaaattctagacaaatgagcaaagggtttcttaccctagggatgaggaatttcctaatcaggtcccagtttgtcccccaggaagggttcaccagttggtgttctctgtgcctatcactccaccctctggaagatcttccttggtcatatctaaagagggttgctgaggaggaaaaaggtttttcctctcctctcctagggttttgctgtgttggcctaactcctgacctcaggtgatccacccgcctcggcctcccaaagagctgggattacagatgtgagccaccatgcccggccccaggttttattttataagtttaatgtggcaaaacgtgggggtgatccacagagaagagaaactccccgaagaggcagcgaggcttgggggtttttatgccatttagaggaaggacaacaaatttatagagaagtaacaaggcaaaggaagggggtttctaactttctagttctaggaggtagtaaattgtggggaggtaaatatatgggaaatactaatgggagattagggctagttagtaaggtttattcatgtagacacttacgtcatctctctcttgccatttccatctctggtaataagggctgttcttcccttcctgatatgggaaagggggcggtcgcctgcacaaggagaatatatgccctcttttcatatagggagggtagggagcttgtcctgtgtttggtttttctgaattgctttcagctcaaaataattcttatgccagagtggcatatactttcctgcaggaaactgaactactgagcaggtttgacaacttgctcattgcctgtagtagactaagtgcttagaagtcgtttttcagtctcaagtagtcatacacagttaagctataaactaagttcctcccaaagttagctcaacctacacccagagattaagaagggcagcttggaggttagaaccaagatggagaccaggcggtggctcacatctgtaatcccagcactttgggaggccagcctgggaagatcccttgagcccaggagttcaagaccagcctgggcaacatagtgaaaccctatccctacaaaaaataaaaaaagattagccaggtgtggtggtgcatgcctgtaccccaactactagggatgctgaggtgggaggattgcttgaacttgggaggtagaggctgcagtgagccgagatcacgccctggacaatagggcgagaccctgtctcaaaaaaaaaaaaaaaccaaacgaattttttaaaaataagaattttaaaagaaaaagacaactataaaaattttaagggttacacaataagtcatctaacactggccaggcgcagtggctcgtgcctgtaatcctagcactttgggaggccatatgcctcctattctactactgaggtcaggagtttgagaccagcctggccaacatggtgaaaccctgtctctactaaaaatacaaaattagtcgggcatggtggctagcacgtgcctgtaatcccagctactcaggagatggaggcagtggaattgcttgaacccaggaggcagaggttgcagtgagccgagatcatgccacggcattccagcctgggtgacagagtaagactccgccccgccgggcgcggtggctcacacctgtaatcccagcactttgggaaaccaaggtgggcagatgaccaggtcaagagattgagaccatcctggccaacatggtgaaaccctgtctctcctaaaaatacaaaattagccaggcgtggtggtgcatgcccataatcccagctactcaggagtctgaggcaggagaatcgcttgaacctgggaggcgggagttgtggtgagccgagattgcgccattgcactccagcctgggcgacaagagtgaaattccatctcaaaaaaaaaaaaaaatgatagctctagatatcctcttataggataatctctaaagtttattcttaggccaaaaactttggaggtaccctgttttttctctttttctcacatcccacatgcaccgtgtctccaaatcctgttgactcgcttcaaaatatattccgaatccaactacttctcaccacttctattgttactcctctggtctactgcaacagcctcctaacatttacttgcttccatccttgtctctcaggcctattcttaacacagcagccacagtgatgatgttaaaatgtaagtcaaaccacattactgctctattcaaatccttccaacagttcccagtcgcaataaaagctgtaagggtaaaaaagtgtgatatatttcctcacccatcataagggttgtggctggcactcctataataaaagacaggttaataagagaaaagcataacaaaygtacttcatcaaagttttaggtgacaccagtgtcttcagaaatgaagaccaaaagacccagagaacactgtgtctctgtgcttaggtctgatgaagaatgggcagcggtgtaggaatgtgattggacaaaagggtatgatctaatggtaatggactaagcggggaaacccagcaaggtctctctgttcagatccttcttggcctctctgtgcagcattctttcctcctgggtttggggcaggacccttctggagtgagggtcttcaatggacaacagagaaagtgacctttctaggttttatggcttgtttgtggggagagaagttctagtttctctgaccaaccttggggaagaggaattatggtttctgtgactcctcaggggagaaagagaggtgagagacaggagggcaggagaaggtcagagactttgcttctgaggctttttagtctctaaagtactcagcatgccaaagcgccatactttggggtatcattttctgagctccaacaaagctaaagtcagtttttataattgttatttgctctcttcctccccgttctcctctcccctggcactcccacactttgttataactctgaccttacttccagctcctctattcctagctcactgtattcgcccattttcatgctgccgacaaagacatacctgagactgggaagaaaaaagaggtttaaatggacttacagttccacatggccggggaggcctcagaatcatgacgagaggcaaaaggcacttcctacatggcagtggaagagaaaaatgaggaagaagcaaaagcagaaccccttgataaacctatcagatctcacgagacttattcaccatcatcagaatatcatgggaaagatgggcccccatgattcaatgacctccccctgggtccctcccacaacacgtgggaattctgggagatacaattcaggttgatatttgggtggggacacagcaaaaccccatatcatcctgcccctggcccctccaaatctcatgtcctcacatttcaaaaccaatcatgccttcccaacagtccctcaaagccttaactcatttcagcatttcttttttttttcgagatggagtttcactcttattgcccaagctggagtgcaatggcgcgatctcggctcactgcaacctccgcctcccaggttcaagcaattctcctgcctcagcctccctagcagctgggattacaggcatgtgccaccatgcctggctaattttgtatttttagtagagccggggtttctccacgttggtcaggctggtctcgaactcccgacctcaggtgatccgcccgcctcggcctcccaaagtgctgggattacaggcatgagccaccgcgcccggccctcatttcagcattaaccccaaagtccacagtccaaagtgtcatccaagacaaggcaagtcccttctgcctatgagcctgtaaaatcaaaagcaaactagttacattctagatacaactggtatacaggtattgggtaaatacagccattccaaatgggagaaattggccaaaacaaaggagttacagggcccatgcaagtccgaaatccagtagagcagtcaaattttaaagctcccaaatgatctcctttgactccaggtctcatatccaggtcatgctgatgcaagaggtgggttctcacggtcttgggcagctctactcctgtggctttgcagggtacagcctccctcctggctgctttcacgagctggcattgagtgtctgcaacttttccatgtgcctggtgcaagctgtcagtggaactaccattctggggtccggaggacggtggcccacttctcatagctccattaggtggtgtcccagtaaggactgtgtggaggctccaaccccacatttcccttctgcactgccctagcagaggttcttcatgagggccccacccctgcagcaaacttttgcctgggcatccaggcatttccatacatcttctgaaatctaggcggaggttcctaaacctcaattcttttttttttttttttcgagatggagagtcgctgtatcacccaggctggagtgcagtggcgcgatctcagctcactgcaacctccgcctcccaggttcaagcgattcttctgtctcagcctcctgagtagctgggactacaggcatgtgccaccacgcccagctaatttttgtatttgtagtagagacagggtttcaccatattggccaggctggtctcgaactcctgacctcatgatctgcctgcctcggcctcccaaagcactgggattacaggcgtgagccactgtgcccggcccccaaacctcaattcttgacttctgtgcacctgcaggctcaacaccacatggaagctgccaaggcttggggtttccaccctctgaagccacagcctgagctgtacgttggcccctttcagccatggctggagtggctgggacacagtgcaccaagtccctagactgcacacagcatggggaccctgcacctggcccacgaaaccactttttcctcctgggcctctggacctgtgatgggagggacttccgtgaaggtctctgacatggcctggagacattttccccatggtcttggggattaacattaggcttcttgctacttatgcaagtttctgcagctggcttgggtttttcttttctatcacatagtcaggctgcaaattttccaaacttttatgctctgcttcccttataaaattgaatgcctttaagtgcacccaagtcacctcttggatgctttgctgtttagaaatttcttctgtcagataccctaaatcatctctctgaagttcaaaattccacagatctctagggcaggggcaaaatgctgcccatctctttgctaaaacataacaagaatcacctttgctccagttcccaacaagttcctcatctccatctgagacgacttcagcatggattttttttttgttttttgttttttgagatggagtttcactcttgttgcccaggctggagtgaaatggcacgatcttggctcaccgcaacctccgcctcctggattcaagtgattctcctgcctcagcctcccaagtagctgggattacaggcatgtgccaccacgcccagctaattttgtatttttagtagagacggggtttcttcatgttggtcaggctggtcttgaactcccgacctcagtgatctgtccacctgggcctcccgaagtgctgggattacaggcgtgagccactgcatccggcctcagcctggattttattgcctatatcgctatcagcattttgggcaaagccgttcaagtctctaggaagttccaaactttcccacattttcttgtcttctcctgagcccttcaaactgttccaatctctgcttgttacccagttcctaagtcacttccaaattttcaggtatctttttcagcaatgccccattctattggtatcaatttactgtattagtctgttttcatgctgctgataaacacatacctgagactgggaagaaaaggaagtttaattggacttacagtttcacatggctggggaggccacagaatcatgaccagaggcaaaaggcactccttatatggcagtggaagagaaaatgaggaagaagcaaaagcggaaaccctttataaacccatcagatcttgtgagacttattcactatcacgagaatatcatgggaaagacgggcccccgtgattcaattacttccccttgtgtccctcccacaacaagtgggaattctgtttttttttttttgaaacggagttttgctcttgttgcccaggctggagcaatcttggttcactgcaacctccacctcctgggttcaagcaattccccttcctcagcctcccgagtagctggaattacaggcacctgtcaccacgccctgctaattttttttttttttttttttttttggtatttttagtagagatggggtttccccatgttggctgggctggtctcaaactcctgacctcagttgatccacccactttggcctcccaaagtgttgggattacaggtttgagccaccacgcccagcccacacgtgggaattctggaagatacaatgcaagttgagatttgggtggggacacagctaaaccatctcactcactctggtccaggcacactctgcttgctgttctaacacaccgggcacacaatcctccacctggagcagatacacacatgccccctctcttgttccctttacatctcttcataaatgccactttctctgtgaagtcttccctgaccactctgttaaaattctaagccccatcttccaattctcctgacatttttccattaaaaaaatgttcccatagcagttctcatcatgcgaattcccatggattttagattttactgatttgtttgttttctcccccactacaatgtgaactccatgagggtaaacattttgtctgttttgtctactgatggccacccatgacagaaaaaaaagtgactgtcttaggggaggccctcaatgtatttttgttgaatattgaataaatggrtgactcagatgtagggggtgatctaaagagaagagtcaagaatgacttcaacgttttttgcttgggcaattgggattgccactttccaaatcagggaagtctaagggaggagcaggtttgctgaaggtgtgatgactggctatctccagtgtcgtcaagaaaaagaactgaggcagagtgcactgatggggtgatccattttctcggactctggcaactctaacagtttccttagtcagatttacagttgccacagatatcctctgaaagttggaaaaggaagaggttaccaggtgttctttcagttcaatactgggcttgtgtctttgattgattcccatcaattcagtcacttcacaagtcagaagaggcagagattaactcatagctgcaactggctgctgtctggtggtggaaaggataatcctgaaggttatgtttcatggtcctataggacattaaccacttttgtatccaatacagcaatctcactaacattcctttgttaaattgcctagaaacacccatgcttctcaaacgcactttgaactgattttgatatcttatagattctttcattaattaataagttgtataaaatctttgacgtgttcgttttatatttgcatgagttatgattctagctttttgaaaattatattttaatatcacttttacagaactaaaatgctgccactcaaaatgatacctgagtacttacccattgattagtccaaccctgtgacaacatgaatttccctgttgccagcgcactaatacagttggcaaccggctaaacttcaggcagcagagaacgttcagctgcttgctgctttttgaaaaataaataaagggcttcagattatgccaccccaaaatatgttgttttggcatattcatttgagctgaagacactggagaaacagctgatgcaggaaaagctctctgattctccctttctacctgaaagcaggtcatacaattttccatgagaaacatgccctctgtgtacaaggaagagaacattcttatcaccatagaaagggaactgacactgaaatagatctatgcaaatagtcttactaaaataacctttaacttccactggttccccctttatatttcctagtcactgtcccacaatttactgccattacaccaagcccctttgttttgtcacatccccataatttataattctttgtgtaaaaaggtatacagtagttccttggtatccacagggtattggttctagttgccaccccctgcatatacaaaaatctgaggatgttcttatataaaatgacatagtatttgcatacaagttatgcacatcttcctgtatacattttttttatcttatttttttttgagagagggtcttgctgtcacccaggctgggttgcagtggagtgatcttggctcactgcaacttctgtttcctgggttcccgtgattcttgtgcctcagcctgtagctgggattgcaggcgtgcattatcacacctggctaatttttgtatttttagtagaggcggggtttcaccagttggctaggctggtcttgaactcctggccttaagcaatccacctgccttggcctcccaaagtgctgggattataggcatgagtcactgcacctggccctcctgtatacttcaaatcatctctagatcacttatacctaatataatgtaaatgctgtgtaagttgttgttatagtgaattggttttttataaatttgtatttttttctttctttcttttttcttttttttttttttgagacggagtttcactcttgttgyccaggctgcagtgcaatggcacgatctcactcaccgcaacctctgcctccsaggttcaagcaattgcctctttgggtcttttcttttttttcttgagacagagtctctctccgtcatccaggctggaatgcagtggcgctgttaacggtggaaggtatgcggacaattctgaaggcatttctatttttattctgccaataattttaaagctagcttgttaagttacactttaagtcacgtgaacttgaaaattgcttagacttatttacttgatttatgagcgcacttttacttataagccaatttggtagacacaacatataacagtaagtgtacaaacaaataaacacatctagacatgtatacacatacatcaacgaagatccaataccttggaaccttagccacgagatagcaatacaagcttgcggttttacttcaacctaatagaaaatacaaggacggctctgaaccaaaatttcaggtaaagcagcctccatggcagttcgatattgaagggctaaagcctcccagcctccctagacttcaaggagcaccggggccaaacagtaccaaaggagggtgtcacatgttaaccaggccccctgcttagaacagcagcacaaaagcctggatacatgcaacgccatcccactttctgattagacagtaaatttcagattctaaacaattttggggccaagcagcatcacaactgtgaaaaaattttttttttcttttctgagaccgaatttggctctgtcacccaggctggagtgcagtggtgtgatctcggctcactgcaacctccgcctaccaggtttgagcgattctcttgcctcagtctcctgagtagctgggactacaggcatgcgccactacgcctggctgaattttttgtatttttagtagagacagggtttcactatgttggtcagtctggtctcaaactcctgacctcaaatgatccgcctgccttgggctcttaaagtgctgggattacaggcatgagccactgtgcccggtctgcaagagaaaattctaaggagggtttaatactagacctcagaacctctgccaacagcttcctctttggagagtttgaggtccgcagaacccacagagcatcctcctgtggaatccaatcttagagttccagacatcactggccttaggtgggtgcatcaaatgcaggttttccttccaaagcatactatgagatttataagaatagccaagaactgtaatgagaactggatgccgggtgagacttttgttccttagccagtagagtacgacctgggaagaatttagcatatgaaaaggaggtttaagttgcctgaaatatgtgcaagtttgctctgagccgcacagcaggtagagatcatggaccatgcgtggaaaatattttttttaaaaagtccttcccactttggggcaggggtaattattcccattcgctcctcggccttcaggcagtaccagggagtgaccccagacaattgccctcaatttcaaggagctactaagaaacagccactgtaagactgaaagagaagaaaaaaacataaataaagacccagattccttaagtgatctgggcagtggcggttaggcttctccacatggaaaccccttagtttcactggccacggccagaaacctgcagttgcttccatgtttaggcacggtccaccaagcrtcccaagttggaaagtcccaaggtctgctccatggatggagcaggaaggaaagggaaaatgaatcccaaactttgggcttacttctccctcctggctggcttgccaaaatatgttaayrgtggaggatatctaagttcttggcatcttgaacaaagaattggacaaaatgcacaaacaaagcaaggaaggaatgaaagattttattgaaaatgaaagtacactccacagtatgggaaagggcctgagcagagggactcaggcactgttaaagagtttttctgagtttaaataccctctactcagggtatgtcctatgtaaatgaagaggataaagttacaaagtcatttatggcaaacgccagatggagaggctatttcctgttttagcttaagtgtgaattggccttaygctccctgcctccagaccctattttcctgcctcagcacaatctcagctcacygtaaccatctcccaggttcaggtgattctcctgcctcagcctcccgagtaactgggatcacaggcatgaacaaccacgcccagctaatttttgtatttttagtagagatggggtttcaccatgttggccaggttggtctcgaactcttgacctcaggtgatccrcccaccttggcctcccaaaatgccaggattataggtgtgagccactgctctggcctctttgggtcttacattttccttctgaagtctcccacgtacatgtaaatatattaaatgcatttatatccttttttcttcttaatctgttattttgtttagtattattattattttgagacggggtcttgctctgtgcccaggctggagtacaatggcgcgatctcagctcactgcaacctccacctccggggctaaagtgattctcctgcctcagcctcccaagcagctgggattagaggtgcctgcaaccatgcccggctaatttttgtatttttactagagatggggtttcaccatgttggccaggctggtctcgaactcctgayctcgtgatccacccacctcagcctcccaaagtgttgtgactacaggcgtgagccaccgtgcccggcctgtttttttcttttctgtgtgtgtgacggagtctcactgcccaggctggagtgcagtgacacaatctaggctcgctgcaacctctgcctccctggttcaagagattctcctgcttcagcctcccgagtagctggaactacaggcacgcgccaccgcgcccagctaatttttgtatttttagtggagacagggtttcaccatgttgcccaggctggtcttgaactcctgacctcaggtgatccacccgcctcggcttcccaatgtgctgggattacagacatgacccactgtgcccggccttaatctattttatcatgattctggttcactgcaaccgccgcacctcttgggttctcagcctccctagtagctgggattagctaatttgtcagtttaattcttaaaccagctgcagaacctaagagagtagaaggaagttttcctckcctacactaggttgtatgttagttttctgttgccactggtaatgatttgggacacaacaataagccacaaatttagtggcttaaaacaacacaaatgtattatttcacagttctgtaggtcagaagtctgacatgtggcggtggctaacgcctcccaaatcccaacactttgggaggcagaggagggcagatcacctgaggtcaggattttgagaccagtctgaccaacatggagaaaccccgtttctactaaaaatacaaaattagctggggctggtggtgcatgcctgtaatcccagctactcgggcgactgaggcaggagaatcgcttgaacccgggaggcggaggttgcggtgagccgagatcgtgccattgcactccagcctgggcaacaagagggaaactctgtctcaaaaaaaaaaaaaaaaagaaaagaaagaaaaagaaaaagaaaaaaggccaggcgtggtggctcaggcctgcaattgtaacactttgggaggccaaggcgggcggattgtctgagctctggaggctgaggcaggagaatctcttgaacctgggaggtggaggttgcagtgagccgagatcgtgccactgcactccagcctgggcaacagagtgagactccgtctcaaaaaaaaaaacaaaaaaacaaaaaaacaaaaaccctgtctctactaaaaatacaaaaataggctgggcggggcatggtggcaggcgcctgtaatcccagctacttgggaaactgaggcatgagaattgcttgaacctgggaggtcaaggctgcagtgagctaaggtcacgccactgcactccagcctgggtgacagagtgagactcaaaaagagtctcaaaaagaacataataaaaattaaaataaataaataaataacataagaaaaaaagaaagaagtctgacatgcgtctcactgggtgaaaatcaaggtgtcagcagggctgtctgtgttcttttctggaagctctggggaggatccatttccttgctttttctggcttctgaaggcttcccaccttacgtggcttgtggcccccttccagtgtcaaagacagaaatgacaggttaaatacttctcatgtcacatcactgaacctgtctttcctgcctccctcgtccacttttaaggaygcttgtgattacactgggttgccaaggtaatccatgataatctccctattttaaggtcaactgattaacaaccttaattccaattgcaactttaatttctttttgccatggagcataacgtattcacagatttcacagatggggacatccttggtgggggggcattgttctgcttaccacagtttatcagtagacaagagagaaaacagccaatttagggaaataatatatatatctctattttctgctgagacatctccacagtgtctttacagactgataactagagctatttctctagttaacaaaggcagagtggccttccattgcaggtatttaccatggcaaatgccaagcttctttgtgcaaatgtttatgtgtgtgctaagcattttaaatagatcttttgcatcactctattttcacactgtgaaggatataatgtagttatgagctttgaagatggacagacctgaatttaaattctgactccattacttattacacctatgaaccttgagcaatttacctaatcttccagagctttaatttcctcatctataaattaaggattaaaaacagctagcagaaaaggttattgagttgaatgcaataatgcatgtgaggccatgagcagaggctctaagtatattttgaattgtttttccctttagatgttttcccaggtacctggytctctgggcctaggacacataatcccagagggtataaatctagtgcttggtcccaacatggttttgctccctaaatactgaaatagtagacaagacgacacacctgaagcccgaaagaggtaaatttagtatacaaggaagggaatactctttgtyatataaaataatagtaagttcactaaactaattaatgcataaactcaactaaattgtgagttaataaggttgtgatgtaaactgaataaaacataaagaatggtttagttctatttggtgatcacaaaaatatattagttactaaggaaaattaataatagcctgtgctatgtgtcaggtcccaatgtgaagtgctttacaaacatctcacttatttccaccaactaccaggtgttacccctgttttactgaaagcaaaccaaagttaaggaaaggtgcataacttgccatcattataactgtcaatactgatgaagagtatgttatcgtcagtcttatgctccttaaggatgtaggggtacttctatatcttttgcgggcaatgatggatggaatattgggctgaaccaattagtatgttaattttaaacttctgcttgaagaaaggatctatggtaggtattagtagcgagagatgagaggtatccttatatcttttaatttcatattcttttcctatgagagaagggcaagaatctaggaaattaattcagttaactaatatttattggacattttctattttccagggattacgaaatatccctcttctacatttatcatttagacttcaatygtcttcactgaaaactgaggggcttagttttaaagttctttttttttcctttaaatatctaagagcctataaatccactcaatcttcattttctcccaactagaccttaaagtggcatgcagaattatagtgagacacaggtgggctgtgtatggtggttcacagccacagttggtggtggggagagtaaaggttatgatttccttttttctctacttcttcctatccatatttgcataaaaacatggtcacacattcttacttgattacttgtagaargacacattccaaagatactaacacctttagggtaaaggacatctcttccttcacaatttattgcagaatgctaggtttacaggagaagcttgaggaatgcttaagcaatgttcagttgatatgaaaagttctattagcttaacttctagtctatttgcttcagttgctgccaaacatcgacagcctttcaaaccaggatccttccttatttagagaagtttgcaggagggcttccatttccatacaycggattaaatgcttttccttctcacctgtttaggctaatggccttcagtgttatgcagagtaaagacattctgtagcctccattcagaagaaccattttgtttgaaaaagaaaagtctaattcaagcagagtcattaaatgaaaatgagaaactttagaaaaattaagaaaaaaaagttgagtattctctagggaacacagattgttttgctgtttagaccgagataagttcttcaatgcctgctctcaagctgatttagtctatgaaaatgattttcttatggatggaggctttcctatamctttactttgctgttgatatatttcttttttatactaaatcttttttggtgggaactgtttagacctatgaccttagaacactggcctgacttggagaaaaatgaacttgaaaagaatcctgtgatatatggagcacacacctttacatataaaaattaaactactggcccataatcagtatagctcgcctcatgatagattattctcaggctaaatttataacaggcactcaacaaaagtattcatckcttatcccctaacattatctagtagctataggagccggtgacctagtaaataawaaaaaaaaatctttaggggtggaatgtaactatawgcagtagcggtaattctgctccatttgtaaggagggtgaaatgcgatatggtcatgtaccctyttggtacacaagttccayaggctatagaaaaacaagtccataccctctgatatctgcattccttattcttgttatagcttacaaatcttctttagacacttaacagtgataattctcccagggaaactaaggaagcacatgagtcatgtttcttaactttaatgttgtataatctgaaaattatctatagatgctttttttttccattggtgctagaaaattccgcctaggctcaatcgatatccatttctaaacttctgcaagaaagctttaactgctttgacatgccaaaaatccaggtgtgaattaaacaacgaatgctttacctcgttttcaccactagttctaccagtcagaatcttttcaaatcatcctcagccagtgcctgtcatccacggcctggtaacacaccctttcacctcctcataccccgtgtcttcgcttttccagtcctttggctgccctccggtttcttccctcacatacctgtctgactagttmctagaagcctggcagaaattsstctccgattttaatctggctgccacaaatgaaagaccttgragtccaaatactcctctctcaaagcaaaatctaaatggatataatttataagcaaagataacacttctgtttttttctctataaacaaaccatgcatgggcttttaaaggagaaaaggaagagtggattgacagagaaaataactgtttaggatagaggttaggaaaagactgagagcaagagaaaaggcatcaatcccagttgttaatccacgaggcatcccccagacccttctgtaaaggttaatgaaggcagtaaggcagttatctytgtttcgtgcactgatgcaatccaagcttccacggtttagcacatagtagacgctctataaatatttattgaatgttgaacgatgagagagtaattaaaaaccggtaagttgatatcataaatacaacgacaacggctcccctatcaaatgtttagtgttcccagagacagccccattgttctacatctcgttatactctggccttttcccgtttttgtcattcgaactcatatacatattgaaatcgaagcacacacaaatccctgaaatgacaaacttaaatgctatccaaaggaagttacattaggttgctgctttgaaaatgaagtcaactcctaatgggttagctgtttctgcagcattctttcccgccttcttggagttgaggtgagggattaaacaatcaaccttctctctcctttctctcattctcaaagtttttctcgccttttcyttcctttcctttgcttcatttcttttcccagtctatcgtttctctaggggtcgttgctttgctctttctccctctctgtctgttggtccctttgatcctttctttctaccccttattcccagcagctccagaaaataccttctttctccccgtctcacgtcacttccctcccttctcccatctccctctcctctccgagaggtgcgttccccactagaggccagcactttcttagtttcgtccttccaaccggcgagcagaactcggagagaaagaagggggtaaaaaagaggagaaagagagcaagagaggaaaaaacccctgggcctggagcgcagaggcccgggagctgcgtcgccatggcaacgggcgccggcaggaaacgagggacgcgcgggagggagggggcggagggcgccgaggggaggcggagggacggcggggggggggtccggctgccccggaagcacctccccgcagccccctcctccagcccggcccgcagcccctggcctgcggcccccaccttctcggccgggcaggaagtgacaggcccggagcgagccccggaggcctggctgagccgcggccgggcccgcacccggagcggcgggaggggcggggagccgcggtcgcgccgggcgcctcccaccccgccctcggcgcccccgcccctccaggaaggggaggaggcgaggggagcccgccgcggaggccgagcgagcccccagcccagcctggcgactggggaccccggcacatgaggtggacgcccccggggaagacttgggtgcacagccaggcgagaaggtaaccgggcgaccgagggccggggaggggcaggacctctgggggcttggctgcgcggggatgtatcctcagccacctccatctgtgtaacgccccaggtacctcccccagttgctttccctgcctacctccggcgctgagctctgcggtccttcggctctgcctgtccgagtcttctggctattcattctgctgcgcttcatgctgtctgtccgtcaccytagctgcctctgactgctcattttcttattcatttttccttctctgactttggtccttccagccgagcatgctgtctagttatctccctgctttcgtggtccgctgggttcctcagcctccagttccttgacttctgcctctgctctctgtatgcacatgtcccagctcacttgggtcagttcattcccggcgcaccactggatcyacccccttcccccagtgtatttgatttctctttgaaacatcattttcatcaaggttctatatagaacgaggacccttgggcgtctactccctgttctcttgattattaccgtgtctttggcacagtcttccctgaaccacccccttctcccgtcccccttcctatgtcccatcctttctgcatgataagagtttcgtgcttagggatattgactttctccaactctcggcccaatgctaagtccacctcaatgtcccattctaactcccttcggtaggtctgtgcgcctacccaaccccatgtatgcccacatgctaccttttaagatgaccatggcttagctactctgggggcatctgtggatcagcttctcactgtcttccagtttaatttggaaaattttgatacctggtgctgcccaaactgtttgttgtctccatttttttatatttaatcttgtagtcataatgttgatcacaaatgaatacatttatgtgcccgggatccaggaatcctggttttggtggcagtttcccttgattttattgagacttttaagttggtccctttacatttttatttctagttsacaatccaaaaaaaattattaatcagaattcagktttgggaagacgaggggtcatacggtttgtattttcacatgtgaatgtaggaattatgttctctatacctagcaaaggggtctcgtgtctctgagtccagtgaactaaatccagtaatctataaaactgtgccgtgctgcctctaatccttacccactttttttcttcacatgctgataatgaggattcatgggtctgtatctgtttagtgctttgatattttggcaaaagatgtggggagaaggtagactagttgaagctgatatgatttttcctatgtactttttgggtratatacatgtttgcagtgacatttgctagtcctaaatgaaactaaagaytggggggggataatagtgtgattggatgatactgggaatgagataataagaaatatcctcagctttattgccaaggccaagcagtttgatactttgcttgtttgtttgttttggatgcaatccctaagaccagtccattcaccctaatgaaactgttgacaacacttagcagaaattctggtttgatgtttatattcttaagccagataatattttggtgacctgatatttctagtggcccagtgcctcagaagtagagaaaatagtgtgtagcttaacaaaagagaaaaacaaaaaaaaagaatgagtaaaaaccttattgtcatttagtgctgctttggaagaatatttcttcttctcatctcctgcctctttgcttggttcttagcaatgttttcatatgtgtctttttgcaaatgtaagtgtagtccccagtgggtaaattctgacatgttagtagattataaagttgcatcttactttcttgaagattttcattgtgtgtatttctatgtttcatacyccggagtcatttcttaaaatgatatattacattcagtatgaagcctyctttgcagtgaggaaacaggtataaggaaggaaagcaacatgcctgaggtgttattagtagcctgagctggaaccaggcagctatttgggctatgtgggctgtaggtgagctcttctgcttcctagttttatgaccttccatgacccactgaatgtgtctgtatcttaaggtcctcctccataaaatgaggataactactcactatcatagtgaatgacactgccttaattacagtttggtttgaagaagcatgtgttagtccaaagacttgatacttactagggcaacttctttaacctcagaaaaccttatgtctcaaattgtagaatgaggataacagtgttgactttacagcactactatgagagagatacagcataggtgaagtgcctagcccagtgaaaggaggcaactagtggctctccagtatatggtgactcatttggatgataacgatgcagatggagacaaaaatgagataaccaaaacttttaagtggaaagattttaaactgttaaaaaatgctatgggaatgtaaggtaactttggtattgtaaggtgccatctcacattctggccgttttatttaatgacagccatgagggaatacgtaaaggttgtttcttttgagactgcatagcttcaaaagatggtagtattgggaagacatggttgcaagagtgtattgaagatttgggagttttaagatgagaaatcatggcttatggaagaggaggaagattcttagatacttatggatttcctgtgtttttgaataataacatgagataacagcttgggatcaagatataaattttaaccttttactgcttccctctaggtcttgagtcagacagagcaccagccttggggaccctggaccactatcatggagactgagagcgagcagaactccaattccaccaatgggagttctagctcagggggcagctctcggccccagatagctcaaatgtcactwtatgaacgacaagcagtgcaggtgagactcagctctgaggggccatggtctgtgagtcttggcttgtggtaggcagtgatgctggaaaataattgtactcagttctttttcaacaaactggggagagttgggttagatgatgactaagctgtcttccagctctgagaatcttaggagtttacaaatgtttaggcaagcaaacagtgaaatcyggtctttcaaataaggatttaaaaaacacattcagtccatctagctagattctaactaaccctttctcatactggattgccaggtttttaatctttggccattcttgtaaatccccttgagtaatagaagtatcatggaactctttagagatttatttttaaacaaacagcaaattccatgtttttattaattctgttaggaaatgaggtcttttagcaaatattttggttactagaataactatacatatcataaaaatagttctaattattaaagaataagaatacagtaaagtccagttagcactaaaaccaaactactattttcatttcataaatctgtattagcatactgatatgtaaaaatgccaattagttgaattcgttgaaaattttacgtgaaggaatctttagaagccactatttattttttcattatttccaacccattagggctgtattacctttactgtatacctaaaatatacttttacattttctccttttttttttgagacaaggtctagctctgttgccctggctggagtgcagtggtgcgatcagtgctcactgcagcctcagactcccagttctcctatcttatcctcctgactagctgggactataggcacactccaccatgcccagctttttttcttattttctttacattaatcggcattttgtttattttcacccgatctagtctttgctatggcatgtatttccagctcccaattggagaaacaagtttgtataaattgcactgctttacttttcttaacatcctatggagaataaaccatagaattacattcacgcgtcacttaatgacaggaacgcgttttgagaaatgtattgttggacgattttgtaattgcgtgactgtcatagagcgcacttacacacacccagattatgtagcctactccgtacctaggttatacagtataggctgttactctgaccactcctgtgtatgtagtctgccattgaccaaacagtggatatgtggtgcatggctgtaattgtttcttccggtttttaaaggactatatagacttactgaggcagaaggatctctctgtttttttgagatggagtttcgctcctgttgcccaggctgcagtgcaatggcgcaatctcatctcactgcaacctctgcctcccaggttcaagcaattctcctacctcagcctccctagtagttgggattacaggcgcccaccaccacgcccagctaattttttgtatttttagtagaggcggagtttcaccatgttggccaggctggtcttgaactcccgacctcaggtgatctgccctcctaggcctcccaaagtgctgggattacaggcaggagccaccacgcctggctcagaaagatctcttgaggccaggagttcaagaccagcctgggtaacatagcaagaccccatctctaaaaataaaaaaaattagctggacatggtggtgcatacctatagtcctagctacttgggaggttgaggcagtcaggaggattatttgagcctaggagtttgaggttacagtaaactatgatcacgccactgtgctccagcctggtgatagagcaggttgactttgctctaaaaaaatgaaggaaaatcagccgttgacgatttagcccaaactcccatctcctctggtttctgtccttcccatggccccctttcacacaaatacagtgatttacatagaataggagctaggagtggtccattctaaatrttttatcctctcttttcctaggctctgcaagcactgcagcggcagcccaatgcagctcagtatttccaccagttcatgctccagcagcagctcagtaatgcccagctgcatagcctggctgccgtccagcaggtgagaggtcagcagccagctggcccgagagggaggggacaggcactacaggtgggtaggggagattttttgggcatatagcatcctatactaagccaggctgcagacagcctcctccgcctcctgtccttctgtgggaggatggatgcatcttagcttctggggttgcagtaagaaccgtaaaatcactttttaggtatagagtggctgtgttatagacctgcattgtctaataacgtagtcactagccacatatcgctattgagtgcttgaaatgtggctagtctaaatggagacgtcctataagattttagagttagactacttagtacaaaaaaaggtaaaatatcagtaatttaaaaatattaattacatgtgaagtgatattttatattgggctaaataaaataaattatgaaagttaacttttcctgttttactttttaaaactttgcatagtagaaaattataaatgtggttcatattatatttatattggatacctctggactagacttttactgactcatgatatgacytgaccaaaagatctttttctagctgggcgtggtggcttacgcctgtaatgccagcactttgggaggctgaggcaggtggatcacttgaggtcaggagttcaagaccagcctggcctatatggtgaaactcattctttactaaaaatacaaaaattagctgggcgtggtggtgtgcacctgtgatcctagctactctggaggctgaggcaggagaatcgctcaaacctgggaggcggaggttgcagtgagcggagatcatgccactgcactccagcctgggtgaaagagcgagactccttctcaaaaaaaataccatctttttccacctaaaagagagtgggagctggaggacaagttgcctctctgccccaggagggttatgtggggctaattggttagcatatgtggtaatgtgaggatcactggactagtgaatatacttttctttaccctaaagtggaatctccctgtttataatgtgaaatctctatgttttgtgcttgtgatttattactagaagactgagagctttttccttcactgtctttgctatttcttgtttcccttcccctttaataggccacaattgctgccagtcggcaggccagctccccaaacaccagcactacacagcagcagactaccaccacccaggcctcggtgagtacgccctctcccactgagaggcttctctacctgggtctttgtctctgggttaaattactttgtgccgctgatctgagagtgtttattgagccgtcagtggatagttactgcttttaagtagagaatagtagtacaaggggaaagtaaccaacattaatctatattggagtctctaaagaggaagtctaaggaagagaggaaagaaaatcctggggaagaagaggagataacaaagaaggggactaatccctggactcttcaatgagaagtaaaatctgttctgtttcaatcttttgtcttctcaactgttaacactagtggttagagactgttggttttttttcactttggtaataccctaaagtagccaggatgacagttttggatatgaagacattatttatttcccccggctccatgaaagtgaaatactctgttcttgactgtgtgactctgaatttgtcagtcacgtacctttccttttacttctcccaaatccttagtcctggttcctttctgtaccacacagatcaatctggccaccacatcggccgcccagctcatcagccgatcccagagtgtgagctctccyagtgctacyaccttgacccaatctgtgctactggggaacaccacctccccacccctcaaccagtctcaggcccagatgtatctacgggtaagccacagatgcagtcaccattgccccagaggcataattgtctggccctggcaaagacttgagtgaaagcttttttttgagacagaatctcgctatgtcacccaggctggagtgcagtggcacaataatggctcactgcagcctctgcctcccaggttccagcgattctcctgcctcagcctcccaggtagctgggattacaggcatgcaccactatacctggctaatttttgtatttttagtagagacggggtttcaccatgttggccaggctggtctggaactcctgacctcaggtgatccacccgcctcggcctcccaaagtgctaggattacaggcgtgaaccaccgcrcccggccaaaagccatttttttaaaccatggtaaccctgatgttttgagagaagctgggacctacttcccatactttacttaacctggaagtgatgttctgtgttcacaggtagcctatagattaaattgagatattatgctagaaaatactggcttaacatttgactaaattagtgttagatatagtcgacctttaaacctgtggctcaagtatacaaattctgtgttatcgctcagcctacctactttctatatataagtacttgttctaaaatcctaattttctctatttctttgacgtgtgactcttkgacatcaatctgtagttttctatgcwttctaggttttcttctggatggttcattacatgtggagaatatgaggctcctgggttggtgtggaagaggcagggctcagctgtttaatatcttctgtttattttgtcttgtggtccttcctttccatctcttctgtctcttctttccctcttgkcctctttgctcttcctcttcctctccttgccagccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttagtggcgatgactttacctgtgggtgggcactgggcaggatgaagggaatgaccacggacctgggtccacccttctgccccattacacttttcagaattcttactttttgtgttttgtttttccttcccttaatcaccatagaacttgaatcccatataacctttgagttaatctgagttagaaagacaaggagatttgcctgaaaatagtcttgtggatctgggaagtcttattttcaagatagggtaaatttcctcaccatccttctagtcctctgtgggtttgttttattcggagagtcttaattctctcatagtactgtcagaagagaagagattgttgagagaattcttctgttagttagatgtaaagctgacctggctgagttactggaggaatgtttggttgcttctgtttgtgagttactctagttctcaactttcagtcttctcttcctgttcactgttttttcccagtaaaggtcttcctcaccattacttctcatgacttattcccaaaatacatgtatttttgagcctggaattttagcttcttatagatgggacacaacctaggatcttacgataattatttcatccttttagtttatttatcagtaagctggtaaatgttgagttcttccttcatgtacttttggccctccctgtttatgggtttcatacctgtaggttctgcatctctggcttccacatccgcagatacaaccaactgcagattgaaaatatttgggaaaggccgggcgcggtggctcacgcctgtaatcccagcactttgggaggccgaggcgggtggatcacgaggtcaggagatcgagaccatcctggctaacatggtgaaaccccgtctctactaaaaaaatacaaaaaattagccgggcgtggtggtgggtgcttgtagtcccaactacccgggaggctgaggcccgagaatggcatgaacccgggaggcggagcttgcagtaagccgagatcatgccactgtgccccagcctgggcgacagagcgagacgccgtctcaaaaaaaaaaaaaaaaaagaaaatatttgggcaaaaaaacaattaaaaataacaatacaagaacaaaaaataatacaaaaatacagcatcgtgtaaccatttacatagtacttacattgtattagatattataagtaatagaggtgatttaaagtgtatgggaagatgtgctatgtgcacagatgatgtgcaaacactgctctgttttataaaagggacttgagtgtctgcagactttgatgtccatgagcctggaactaatcccctgtggataccaaggaacaattgtattagaaattttgcaggattaaaaaagaaatgtgagtcaggtcttcaaagagcttagacaatgaaagtgctaaattaggctgggcatggtggctcactcttgtaatctcagcactttgggaggctgaggagggtggatcacctgaggtcaggagttcaagaccagcctgaccaatatggtgaaaccctgtctctactaaaaatacaaaaattagccgggcatggtggtgtgtgcctgtagttccacctacagggaggttgagacagaagaattgcttgaatctgggaggtggaggttgcagtgagctgagatcgtgccactacactccagcctgggcgacagagtgagactccgtctccaaaacaaaaagaaagtgctaaactaaatggtgctaactttgagtgacacatgagtttggaaaagaattggttacattactttgcaatgccttattgggatacttgagcagagtcttggacgagtggatttgatttggagtgagaagaaaactagagagagaacagcaagcgtaagagtatagtcatatatttaaatrcgagtatgtgtggtaggcgttggagatgaggggataaataaaatagaatcaacaggcatgrtgatagaagaggtcattgctggggtagagcatataaaggaggttgtagttaacttcataggtcacagggatcattgctagctattgaacagcagattaacaagatgaggaaagtacttaggaagaactatagggagaataactgttctaacagttcctggagaagagaagttagggaacttgctaagaaactcttgtggtcatctagctgtaaggcaagtctttgttttagactctggtgatagcaatgggagccacgagtgaggttggttccatttccatatccagttctttgatttatccgctcattcattcatcagatatttgagtgtcaatatgtggaggaacagagggcagtagttaaaaatacgcatctgatgggtcagattccagctccactacttactgtgtgaccctgtgcaaatgatctgacatctttctgttatcgtttttttcatctgtaaaataggtattgtaatatacctacctcaggatgtgttgtgaggactaagtgagttgctgcgtttgactgcttgaagaatgcctggacgtagtgagtgtttaggagaaactactgctattaatatatcaaacattccttagcgttggatgcccaagaaagtcacgatcactgcatttgtggagctcacagaccattgaaacaccagacattaaactgatagtcacctgaatggggaaataattgagaaagtaccgagtgttctgagaatttagaaagggacctaacttagctttggcatggggtgtaaaagtcaaggaggtgacatttaacttggggtgtgtagaagttagccagataagaatgtggaaggagagtgttggaggcaggagaacagtgtgtccaaaggtcctgaggagggcaggaacttgatttgttagaggaattaaaagtcttgtattcttggagtttggcatagtggggctagacgggtaggaggaaccttatctttcagggctttgggggctgtgtttaggattttgggctttttataaaaagcaattggaagctatagaaggattttaaatatggaagtgtcatagagagatttggatgtatttttgttttgttttgctttttaaataccatgttgatttcctctttggagactaaacggatatggtgtgagtgtgactgtagggagaataactgttctaacagtttaagggacagacgatgttcatactgggggtagcaatggagatggacagaaatgcatagatttgaggataacttagaagaatcattgaagagggtgaactaatttagtagatgggggaattaaaggagatgccagataggaaatctgtggggtggctggtggtgctgtttatgagacgaagaatgtaggagtgtatttagagtgacgttcagttttggacatgcagacctaattagaagtgtttgtgagccatccatgaggagatactgagactgcagttttattatgtggttcttgagctcagaggagaggtctgggttggagataaacatttgagagtagtaggcatatagatgataattgaagtcccccatctactaaattagtttactctcctcagtctttaaaattgcctggggaggccgggcacagtggctcatgcctataatcccagcactttgggaggccgaggcgggcggatcacctgagatcaggagtttgagaccaacctgggcagcgtagtcaaactctgtctctactaaacatasaaaaaaaattagccgggtgtggtggtgcatgcccatagccccagttaacttgggaggctgaggaaggagaatcacttgaacctgggaggtggaggttgcagtgagccaagatcgtgccactgcactccagcctggtcaacagaggagactccatcttaaaaaaaaaggccagcgctgtggctcatgcctgtaatcccagcactttgggaggctgaggcgggtggatcacccgaggtcaggagttcgagaccatccagcctgatcaacatggtgaaaccccgtctctactaaaaataacaaacattagctgggcgtggtggcacatccctgtaatcccagttacttgggaggctgaggcaggagaatcacttgaacctgggaggcggaggttgcagtgagccgagatcgcgccgttgtactccagcctgggcaacgagggcgaaactccatcttaaaaaaaaaaatgtttggggagatagtacaggttgaggagaggaacgtttaatatggggccctgaggtaggatgaacccccactttggaaaagcagttcaaggtcgacagaggatcgtgggctgacagaggcgaatgggaaagagcagcagataggaaaatctggactgtagtgtcacgaaggcaagggaaccaaatgttacaagatgtgcatgtgtgcatgcgcgcatgcgtgggcagggggcatctctttctaatgtagagagagaaagaaagatggttttattaacagggagggagagttgtttcagttgtttggggggtggtgaatccaaagtagtatgagtttgaggggtgtgaatggctggtgggaatgaatacagtgactgtaaacagctattaagagtttagcagcaccaggaaaggaaggtggaactggggaggggaatgtgcagttcctacatggtgatgagggagccagtggagaagaagtggaagaggaggcagtggatattatatgctgcttgagatggcaggaggaggtggaatatagagtgcagagaaggactgattgccttttgataggaagaggagagaagggggaaatgatgggtgtgtatgcagataaatgtatagattcggtggtggaactgatgaagcaatgctcatataatggtttttgttttctctgaagaggtgaagagtaggaggagaaagagaaggtagtctgaggtatagggagagagtgggaaagtttgaaatagccattatggaaatgaagctgattggaaaaactgtatattaataattgccagataatattatgtgctctagcacccaatcctgatgattcttgtcaatatctctcaaaagccatcaactctttactgctcctgcctgaattcaggtttttattattttaacctgtactgtactagttttctttctttctttctttctttctttctttctttctttctttctttctttctttctttctttttttttttttttgagacagagtctctgttgctcaggctggagtgctgtggtgtgatctcggctcactgcaacttctgccttctgggttcaagcgattcttgtacctcagcctcctgagtagcttgattacaggcgcgtgccactatgcccagctaatgttttgtatttttagtagaagacggggtttctccatgttgctcctgctggtctggaactcctgagctcaggcagtctgcccaccttggtctcccaaagtgctaggattataggcgtgagccactgcaccggcctattgtactagatttctacatggtcttcttcacttcagtcttaacctacttgtagttcttttccacattactatcaggaaacttttactatgtttttttaaataagaaaatatatgttgttactactaattttttaatcgtacttctggtacacagaatttgataaaattgtaatccttggatcatgacactctctcactgttggtctcgtcataactgttaaaatttatttactctgtaatttttaataatgtaataagcagtgtgcagttccgtctactgccttccattacccacagtaacgagccttctgatttctaagtccattcttccctcgggtccttttttatatggttttattgcatctctctatgtttctaaaatgccctttttattatagaaaattttaaaggtacacaaaaacagaaaaagtatgaattcctgtgtacttaccatccagcttcaacaattatcgacacatgaccaatgcattcaggcccttctctgcctgtggaatattttgaagcaaaccccagacaccatgtatatattttaattgtattgaaatgtgtaaggtactcgtgctgtatgtacacttttggagagtgctttcttaataacattgtcacgatccatttgttttgttgcagtcattggagtttattaattgtagtttctatatactattccattgtatgaatatactatagtttattcatcttctcttctgtagatggccctttgagttgattccaggtcgtggttgctaatgaataatgccaccatgaacattcctacacatgcctcctgtggtacatggcaagagtttgtcttgtggaattcctgggttagagggtgtgtgaatgttcaactttaggatatgataacaaatattttctaaaataggaagtgtattgatttatacttcaatcagaaatgtataaatgtataagtgaatgtttattttgattaataagctttattggcttcctataatcagttaagcagacatcattctttccctttatccatattttggagtactgactatgtgccggaactgtgaaggtgctaggaatataacaatgaataagacagataaacttgctgttcccaaactaaagttcagattccttgtttcaatacaccaggcccttactggcccagcaccttcctacctccttatccacagcctgccttccttgctttatttctttccattccttgtaactctccccaaacataatgaaatatttataatttctaaaaatacagtctttttagaaattatacattttttttaataatattttaaaataatgtctttttttttttttctggacagggtctcactctgttacccaggctggagtgcagtggcgtgatctcagctcactgcagtctctgcctcccaggctcaagtgatcctttcaccttggcctcctgagtagctgggactacaggtgtttgccaccatacctggctaattttctgtatttttttgtagaggcagtgttgcccaggctgttctcgaactcctgaactcaagcagtctgtccgtcttggcctcccaaagtgttgggattacaggcatgagtcatagcgcccagcctaaataataatccttttttggttctggccttgcaaatgctgttatcaatatctttaaacccccaccttcaccattacctactgagtgtcacatcagtatcacttgttttaggaagcccttccttgatctccctagtcttagttgatattccttctctgtactcctrtggtactgggtgcatatctatacatcttattatgtcataagtgataattttcttgtcttctgtagtagaaagtaatcattaagagcagagactgtgtctttcctctgcatttccagtatccagtgtagtacctgaagcatagtaggtttttgggaggtgctgaatgattgaatggcgaggaaagggataattgaagagatattttgaaggaataaaagaccacacttgatgataaacttgctagtgagtgaagatggctgaagaatcagatacrgagccagagttcctccttaggaggtaggaaggccttaaagtatatggtaaaggcagagatacgagctgaggtattctgtggaatacgacacaatagcagtcctggctgcttttgaatctttaaccttaatgcctccagtcctccttttctcaatctgttttttcgtatctttcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggyggaggcagtgggaatagcatcccagggtccatgggtccaggtggaggtgggcaggcacatggtggtttgggtcagttgccttcctcaggaatgggtggtgggagctgtcccagraagggtacaggagtggtgcagcccttgcctgcagcccaaacagtgactgtgagccagggcagccagacagaggcagaaagtgcagmwgccaagaaggcagaagcagatgggagtggccagcagaatgtgggcatgaacctgacacggacagccacacctgcgcccagccagacacttattagctcaggtaaattgtcattcctcatgtcattattctctcagaattcatgtgaaattttcctttttttctttttttgcctttttttctttgcctttttgttttttccccgcttctgttggtccttgaatagtggaaggaatgggaataatatcagccttgaacatattagttcagggtcaggaggacaagtgacagatacagattttatctgtttctaccaggcagtagtcagcttacaagttcccctgtccgctttcttaggctgtgagttcttcagttttatcactctgtctattcattcatcacatcttactgaattgcttactgttttctaggaattactggggatacatttttgaaaagtagattccctgtcttcatgtaacttagcatttactataagggatgaattctcacctcactgtttaatgtggttacttgatccagtgtatagcagatacagtacaatgccttagagcacttaagactaatggagaggcggggtgcggtggctcagtcctgtaatcccagcactttggaaggccaaggcaggtggatcacttgaggtcagagtttgagactagcctggccatcatggtgaaaccccgtctctactaaaaatacaaaaattagccgggcgtagtggtttacacctgtagtcccagctgctcgggaggctgaagcaggagagtagcttgaacccggttggcagaggttgcagtgagctgggatcacaccactgcactccagcctgggtgacagggcaagactctgatagtttatacttgctttcagactgcgggtaagatgtagttagatgtgtgtatcttatttggtcatgttgatttttgccttttyttgtttctagtaccttagttgttgatgtatttagataatttactcacaaaaaaattaagagttagttattactatacttggtatttatatactctagcagttctatttctaaattgctttatcatcacatgctttgatctctggacaatctggtacaayatggagaagtagagtttgtcactcccagtttacagtggaggaaactgagttaggtcagagctgacaggtgctgactctcaagactcagatggtggtctaagctgatgatttgtaaaatccaagtcatttgtgggawgacgttgrcatctttaactctgtgggtatctcttctttcagtgaatattaagtgcttctgcagtgtcaggccctgggctgtgttttagggatgtgaaaatgaataaaacatggattcagcctttgagaaactccaagtctaatggaggaggggctaaccattcttctttgctgagtacagagtaaaagaatacaatatttaagtatggcaaagataagagacacaagaaattactcaggatctgaaatgactgagcaaggragttctttctctgagatctttaagactagtagtagttggtaatgtctgattgagtgggaagagtatggacgaagtgatgtccaagtttcatactgactagatttcttttcaccgcataattccaaaactaggttataccttggaaaaatgaatttacttttaatttaraatgattattattctctgctcttttttctctctgttgtattctgggattgttcctatagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagmaagcccaaaccctggtcgttcagcccatgcttcagtcttcacccttgtctcttccacctgatgcagcccctaagccaccaattcccatccaatccaaaccacctgtagcacctatcaagccgcctcagttaggggcygctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccggtgagtgatgtctgatggttttgagggcactattatgcatgagagtggacctgggctaagtggaaatagagcttaattgaataggggaataaagagttaagagggttaatattggtatttatctgcttcttctgtaagagagtgacacattatataatatctgaactttataytcctaaatttgttgctgatactattctgggtttttgggtatgtaataagttagatcaagatagccttaaccaaatcagtctttgaaaaaacaacagttcttggttggtctacgtgaatacagggtctcaagacctaggtcaggactaaatcatgttacattttcttttgtcctgatggaaagttactaggaatgaccaggaattttagtgtaccatgggaagtagataaattgggaaatctggaactaagaaaattttctttgaacatatggtaataattgtggttccttattatccttcatttgtacatctttgtttctttcctattctttacggtatagggtaaaccccagacattggctgtcaaacgcaaggctgactctgaggaggagagagatgatgtctccacattgggttcaatgcttcctgccaargcatctccagtagcagaaagcccaaaagtcatggacgagaagagcagtcttggaggtgagtaactgacttctaatgctgttggagagcacacagagtagaggaatgttctgagtgagctaaaagataaawctggttgagtagaaaatgggccagaagttggtggacaaatgaatagatccaaaaacagggaatccaggtgaattgtcaagggtggacatagattattatggaagatcatgctggctcaactaatagatggatcaatatgtcatctcatgtctgttgcttaatctgtgtttgttttccagaaaaagctgaatcagtggctaatgtgaatgctaatrctccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgaggrcagggccataaggtgggactttgaagtggggacttggtctgattgttgtcttttcaaactccagtaaaagtaaaaggcacagaactatttaatgaaagaatggttcaattacgctatttatttaattataaagaaggaaagggaaaagagtgtgtggaccataaaatgaaaatgttaggaagaggagaaaaaaaggaagaaagtaacctttaaaactgtaatgtttagttagataaactagtttgttttataatgaataaaattatagtaatgaagttaaggagctttcctagggtttgcagaaccaggactagaactgaggtgtcttgactcctagtgcattctcagcaccataggaaggaagaggacaaaatagggagccagcgtaggaacctgttctccaatggcttatctggaaaaaaagccagttactattttttttttctcatttccaaacattgtatagagaccagttactactcttgattaccgtattgaaagtgattctctctgaaccagacttggtcattaactcagagatccaagcagagrcataattgatggggaaatgttggggaaagctatagagaagcagaaggggatcaggctaacttaactctcaatgttttctgggacaggtgggttgttctcagttactgaaggagtctgagaagccactacagactggccttccgacagggctgactgagaatcagtcaggtggccctttgggagtggacagcccatctgctggtgagcatttatttagagactcatttgggggaaggagactcgtggagatgtgtttgaggactcggtgtaaaatagtagttacctatttatttaaagtagaaatgaggcctggcacagtggctcatgcctgtaatcccagcactttgggaggccaaggcaggcatatcacctgaggtcaggagtttgagaccagtctggccaacatagtgaaaccctgtctctactacaaatacaaaaattagcctggtgtggcagcatgcgtctatagtcccagctactcgggaggctgaggcgggagaaccacttgaacctgggaggcggaggttgcagtgaagtgagctgcacgccaccgcactccagcctgggcgacagagcgagactctgtctcaaaaaaaagtaggaataaaatgaagtctgtctacatatagaaaccatattatatatcagagtatgtagaatcacggaaaaggaattacataaggtgaggggaatttatccagctaaagtaatcttttgaattattattattatttttttttgagacggagtttcgctcttgttgcccaggctggagtgcaatggtgggatcttggctcaccgcaaccagtgcctcctgggttcaagcgattctcctgcctcagcctcccgagtaactgggattacaggcatgcgccaccacgcctggctaatttttgtatttttagtagagacggggtttctgcatgttggtcaggctagtagtcgccaactcccgacctcaggtgatccgcccgccttggcctcccaaagtgctgggattacaggcgtgagccaccacgcctggcccttgaattattctttactctatagatgtattttttggccgagtgtgatgactctcacctataattccagtactttgggaggccaaggccggtggatttcttgagctcaggagtttgagaccagcctgagcaacatagtgaaaccttgtctctacaaaaaaatataaaaattaactgggcattgtggcacatgcctgtagtcccagctacttgggaggccaaagtgggaggatcgcttgagcccgggaggtggaggttgcagcgatccaagatagcaccacggcactccagcccgggtgacagagtgagactgtctcaaaaaaatttttttttccaaaagatgatctaaaataggacatttrtatctttaatttccagttctccttattctagattttataatctatcttaaggactcttactgattttcccactgcttttggaaatctttgtggtagaaggatcttatatctttctaggcattagtagttcctctctcctcagaaattgaatcatatctgaaatctaagagtatgaattaggataaaattagtaagacatctaaaatggagagagttcggcttaaggttaggaagacgtcataaagttctcamgggacaagtcttcgtgattttaggttttgaactttgcgttttagggattctcaactaggttgtgtaggtttttgggggtgaaccctgagaataattttagaatccagctctgagcctaatgattgcctgaggggcagcagaaacccatggtgactgtccagcaataccttgttttttagagttagataagaaggcgaatctcctgaagtgcgagtactgtgggaagtacgcccccgcagagcagtttcgtggctctaagaggttctgctccatgacttgcgctaagaggtactctgggcaccctcctccttgccctcagcactggtatctccatctaatgttacaccccttccccaggatcgtctcmtagctgatattttatgtctccctccttgcttttattcccttccccaaatcagctcataagcagaaattcacatttagagcagggtggtcytctgtggcrctattgacatcctatatatgccctgtcctgtaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccgggtgagctgcttgttgtagagccagatgcctttaaactgggtctttttttctttccctgcagggcaattcatttgcccaggtaagagggtgtgagatgagaactctggtttcacattgattgcattactacaaattccaagagatcctgaccccctttgtctccrgacctcttacccaactactggttcatgtttccattaatccttacactgtacttgagtacaattgttaattgtactcaattgtactcaatttctctcaattgtacttgagagaaaatctagatcaattgttaggtcatggggagaatcaaggaagtgatacagtttctatttgaaagactttgagagtagattttgggaatttgcaaataaartgctgcttatttcacatatgataagatgagtttttcttctacgcccaacccagggtggtttgggaagaaagagagaggaataaacctttgacactgacctcattggtttgctcttttcccctatagggtcaagaagactctagccggggttcagataattccagttatgatgaagcactctctccaacatctcctgggcctttatcagtaagagctgggcatggagaacrtgacctggggaatcccaatacagctccacctacaccggaattacatggcatcaaccctgtgttcctgtccagtaatcccagccgttggagtgtagaggaggtgtacgagtttattgcttctctccaaggtactgaccctytcttcaacagaacccaggttgttttccttaacatcatcccacaggggccttgataagagggaaagtaattgacttttaagcagtaggagcttgaatgctaatatagaggctctactcctaatattcaagttgacttcctaatttttttctgggttgacattatcttctgtaatgtcagcaattttacagtrtttgattctcatcttatgatgtagctgcatttytcactaaatttttggataaaatgtttttgtgtaattaactatgatacctcccatggggaaaaaattttttttttcagtggagcagggtattagaaactaagtggccattgttgccccactcttcaaagagggcttgtttgctagtcttcttttttttttttttttaaacagagacagggattccctatgttgcccaggctggtcttggagtcctgggctcaagatatccttctgccttggcttcccaaagtgctgggattataggtgtgagccactgcactcagcctatatgcaattttgacagagtttttttcggaaatgaaaatcaccctacccttcttgctatttgtctgaattctgggcccttaaacaaaaatatcacaaagaatctttttgccagtataaaagaaaacatgcttttatttctgttctctccctttcccctgtctctaagctatttgaatgaagttatttctgtggttgaacaatttagttgcttttcctttcttggtcttggactttggttttgttgttgttgttgttttgagacagagtcttactctgttgcccaggctggagtgctgtggcatgaattttggcacactgcaacctccgcatcctgggctcaaatgatcctcctgcctcagcttcccgagtagctgggactataggcatgcatcaccatgcccagctgatttttgtatgttttgtagagtcaaggttttgccatgttgcccaggatggtcttgaactcctgagctcaagtgatctgcctgccctggtctcctaaaatgctgggattataggcgtgagcctctgcacctggccattttttaaataccagttgctttctaatttcattttgcttttaaagcttgccatctgacttcatattactgaatttaggacaggtactttggaattaatcattgctagacctcagtttcatttagcttcccttctcctatcatctggcattacctacatgttctcaccatttcttctaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatccyggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctyccccctcccagtgtagctgtggctcagagttttttytttttgttgtcacttactcccttgtgattgaattttttctcctgcatccatggcaggatccccagccartatagagacttggttggcatcttctgctgcagggactaaaagtatttgactggggcacatgtggctgttgtcattctttctgcatcccactgttcccctccaatttatgttattttctaccctgtttttcagttccatctctgctctgtcctrtagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttktttaatcattaagagtttttgtacaaaargtgatggttttttttcttcattttaaaacaccagggtgtgggggrgggatgcaaacaaataacaaaaaagatgcttttgtaacattattttccctgtttagaaagaaaaaaaatcactccaatagtattgaaaagtccaaagatgaaatagtttcattttcttttcctaaggcttataaaaggscccctgcctrttgattccatccctcttttgtgtccagtggagycatgttactcttcagtggcccaggggttcactattaaagaaagatcagtccaggtttctgggcacatggcctaaacaggaagatggaagcatcagaggattaaaaacctttccccacagaaatgtgggcaagaagacacttccctgagccagcagaagggacaggtgcagcagcattccacacccagcgcagaggacagcagagccctcgatgtcccacttctgcttccgttccctttctagaagattgaaaaaaaggtcaaaaccacatgcctgtggagaaagtgcgacatgtttagaaatactggtagggaaccaggartaagaaaagctttaccagcttttactacaaatggatgaaagacatcaggatcccaccaccgcaaggtaaagtgacttcccttttctggaacccctgtggcacaggagtaccaattttcctttccaacgaactggatttctggataggcattttggctgtatgtggacagataagaccacagtccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcmctgcaaagtagttccaagcagcaaraaataccagattctcatggaggctactatagggtacagaataacaacatgaaarcaatcaaccctgtataaataatgtttcttggcattttttttttaattaaagaaatccagtgtctcaaaaacttgtgaaaatgtgtttaaaaaacaaacggccagtgagcctgctacaccattttgcccatatgcctattgtaacttctgatgtcaagagacaatgcaaaagcctctgttttcacaggccctattatattaactctgacttacaactgtacctctctagagaaaaaacagaaaataaggaacaaagggaaggcagttttactagtgaraagatgcaaatcaaaagcaaactggraagcaagagcaatagtaagggtgagatgagggactggagttgagactgcttgagaaatctggctgtgtagctttggtttgggggactgaggaagaggctggacatataaagtgcaatctacattggtaataaatggtcatccctttcttctgactcctcccccagctggtcatcccccacaccacgatatgctgcaggcacatttcgaggtttagaacggcagacaaagtcacagccatcctgtagggggaraaaaaaraaggaaataattcgcagcatctaactttaggatatgagaaagtgtacttatggtctaggaatgtggcaagaattggttttctatagggataatgagaaaacctaaaagatctgacaatcagcctaaattcaatttggggcaacaggagaaaaagtttcttcttattaggcctcaccttcttcccacccaggccctcttaaaagctaaatcagatttagaagagcccatctggtcaacagtgttgctctttcagcaatgtcttaccaaggccagaaatggatgctgtgccacttactactctgtactagggcaactgtcttgtttgctgggacttttgtggttttagcactcaatgtcctgtgtcccaggaaccccctcagtgtgaacaaacgaggatggttggtcacccaaccttgtttgcaggctacaaattcaaccagctgccctgttacttactgctaccaggttgccaagatcctgccagaaggctaagtggggaaactgctccattcctttggctcccactaccagtcgctggtataggaaccccccaacaacataaacagcaaccagtgatgcaaacctgtagagagagaaagacatctatacttaagaactgggaaatagtaaaaactcagataggataacctctgcatttattgtcagctgtytcctaagatacattccctgaaaaggaaaaatgagtagtgatwctaaatgaaaaagggggctggtaactcttagaaaaccagttagagtgctgtcagtccaagagaagcaaaggcccagacaaaatgtgacagcgtgtgattctatggccaagaataatcaccattaagtatatgmttccatttctctagaagttctcataatctaatgaaataatataaaaattgcctagtcctgcagtaggggaaaaaagcacctccaaatgcaaatctataccggcaactaaacattaaatctcatttttcaaaaacttgcagtcagaatttttttttttttttttagacggagttttgcccttgttgcccaggctggagtgcaatggtgcgacctcagctcactgcaacctccacctcccaggttcaagtgattctactgcctcagcctcccaagtagctgggattacaggcatgtgccactgtgctggctaattttgtatttttagtagagacggagtttcatcaygttggtcaggttggtctcaaactcctgaccttaggtgatccatctgccttggcttcccaaagtgctgggattacaggcgtgagccctgtgtcctggcagaattattttatagccagaggatttaaaaagttatccccatcaattacagcataatgtacacatacaatttgtgcttatgtaccaccatatagttactgaccttaaaaacaaaaggaaggaaggtctgttctgataaaggaaggcatactcacgtgacaagtaagatggaacccacactgaggtgggagatctctggtgaacaggccaggctgctatccatctcaaagaggtagaaacaatcttggactttgccacgctcctcagacacagggttaaaattgtcctgatgatgagatggcataacacattcaggtggttargtgttttgactcctgtccaacaaaataaaaaacccaaaaaacatctgctccttcctggttcagcagcctattttccatggaagatgcgtgtctgacacagagagaaactgagctcctagttttctaatgtccatcccaacgtatygtgtcccctctggatattctccccaacctcaggtcagtcctttcagtctcctccctcggcttatacaacacagggtgcctcaccgctagggtgtgtcgattgcaggagatcatcaccactgcacgacgctgctccttgccacagtggttgtcatattcatcaccccctttatagatcagcatgatccaattacctgaggagggacaaggaaaatggagctatggggtgggggaaaagcagaggcagatctgggtggtatggcagagtggaattgcgtaattcattgcaattggttataactaaacaaccctcatcagtacgaacttggtataccagaaatgccaagctaaacttgtttgcttacaaagacttgtgttcccttaagacaagaatcagatattcatttaagaataatcttaatttttaacattaaaggtaggcaactgacaatgcaaaaccaattatgatccataccttaacactgattcattttctgaataccttctaaaagcaaaaaaagaggttccatacaattgctgagcagcaggggtaagcccatctaagatttcaacttagccccagataaattcagagtggatatctaagattggaatgcatatctcttctttagtatttactgtgttcagttcttttgcaaaatatcatttgattcagtaattgtgaggtgaataaggtaaagattctgctcctagttttgcatatgagaaaacaasgtcaaaaggtgatacgactttycagtcacaggattaggaaacaggaggagaacctggtcacatgatccccagccccaaacccttttgttacttttttattgtattatttaccaggagtaaatagctaccttgtataacttatttatctgtatgggagggaattggaccataggtgcttacatggtcmtctccagcaatatgacttttaagaaatatcaccaccatagcacaaaaatcagtgggtaaagttttgcagactgagtagtttgcaaaaaaaagtttgagctcttaaaatttaactggtaaactttgattaatttgatgaaaagtggtggtggtggttggtatttktaagtctagtgtgaaactcattaaaagtatttgggtgaataaaaggactctaggctacagaattctggctagagttggctgggcgcggtggttcatgcctgtaatcccagcaccttgggaggccraggtgggcagatcacgaggtcaaagatcaagaccatcatggccaacattgtgaaaccctgtctctgctaaaaatacaaaaattagctgggcatgatggcacacacctgtagtcccagctactcaggaggctgaggctggagaatcgcttgaacccaagaggctgaggttgcagtgagccgagattgtgccactgcactccaggctgggtgacagagagagactccgtctcaaaacaaaacaaaacaattctggctagagtcttcattttgcrtaagtttttcactgattttaatgcacaactgtcctgagctgtggcttacagaggagctgtggaattaggcatcctgtggtatattacagtctcaggtgtgccgaacsacacgtatgatatgctgaagacactagaaamggccaagacatacaggattgtcagagggattgacttgggatcagttagtcaatcgatggtaggaaggggagttttcttacttccgttgaagatgtgagtctcgttgagtctccctaccactgtctccttcccattacttttgttgatttgcaccaggcctgccccagaagtgtggttgccagcttcccggcacaccctgaagatgtagatgtatgtgtctgaaccctggcccacagtgctctcaaagctgtaaagagaagtgggaagaaagaagaggagagttactagctatcagcctcaggaataacagcatccctttccttaattaaaacaaaacaaacaacatgctcgatttatttatttgaggtcatggctgagtgaatatttgtttaattttaagatattcataaccttgacagaccatccttattgctgatgatgaattattaaaacacacttgagctatcttgatagctcaatattctagttatttttagaatgcctgttagtaaccatgttccaatgaataagggcccatgttcatcggatagtctcgtttcttagggaccaacttcagatttatatatctgaaggttcctgacacttataatgacatgtgtcggcctaaatatgtttatytgatatttctaaagtcctattatatgtaggtgtcaaataatccttaaatttctacaagctggtctcttggatccagtcttggaaatagctacacttctgtgaaagatgagaaaactgcacacagcaactaaaaactgggctgagaatttgctctatgtcataaaagagagcacattatgaaataaaatcagtaagaagaaaagactttaacataaatattttctcaagctctttaaggttcttctcatttaccttttattaaacagtggtttcagcctcttcactagagccaactctttctctgactctttacccttttctcctaccaagtcgcaagttttttcttctgtctgccaggattctctcactgccacagccaggagtagtagtagcagtccagtcctccagcagctgtagaaagggaacatcctttgggagagagtgtgtgttggggagggcagrtaggatcaggagagagaggaaagagataaagcgtatgaatgtgtaataaatcgatggtattttaattatccagaaagtacaagattctctggcatatgcaacacatagtacattttaatatctctgtaacaagagcatctgcagcagaaaattcatttatatgtaacttgtagtctaatgtataggtgagtctttcagaacaaactacaaagttgggaagagggaaatgaaagaacttaaaaaagaatgatgacagcttgggtggagccatccttgcctctttactgtttgatggcttgatgtagtcttctgaaacctctttggcctctacaggtcacaaatctcaagggtttctagacttcccataagtacagttgtcttttacactacaaatcaatgacaacaaattggggatcaccaagccactttacaattgagtaaattcaatgcacctgctgcttgtactgctctaggaatgaaaacacacagacagctctcyttcccaaacttactagactggtgcaaaggtcattrtggttttggcaaaaaaaccccaccaaaacctaacattttcttttctcttatccatcttcatacccaggacagactgacttacccttgcaaaacactttactctggtatctgttaatgatccctcaggccattgctacttgtttattccaagagtatcacggacaatttcctgatttaactcttctaaacttttctcacttacaaaaaacgctgcaagtctggactttggtttgaatattctttaaagttctctagttctttttcatgcgggtccacttactccacctcatttttaaaatataaaacttgaaacaggcagaattttcatgggtactaatgagtttgaagatgggaaaatggaagctccaaccttggccgtgaatgcactttccccattcccctaaacaacctaacatctgaccttccacttcccacaccccactaaagcaaaaaatcccgggaaattgtctacctgacttcctgtaccccaaacatcaattctctactgtaatattatggtagtttccatagaataatcatagctaaccaagaggtccaaggccctcataacacatttaatgcactgaaaccacacaacagcaggaaacaacagactactgccttgggccaggtgctgttcaaagcacttaacatatattaattaactaattaatcctcacaaccttatgagtaaatacaattattgttgctattttaccagtaagaaaactgagacacagctagtggagtgagccagagagtctagctccagagctcatggtctgtgttgaacaactacatgtatatttccactatgtgcataacaattttttggagatgagagtagacagccaaaactgtgggtttttttttttttctactaagaagtgaaggggaagtgattcctcacacagttgactgaataggaggtgaaataaagaactcagacctccaactcccaccttccctaagttaacccactgctcaacacacaacttgaccagctgactcactaaaaagaaataggagactccttcttctagactgacttagcctgccattttcctttccagtctctcaggacctaattaaaaactgacagttgatttcttttcctaaattagaacaaggaatctcacaaaattaggaagggatgaaaggttaaacacctcagccattagctgagttgaactatctttcatttgcttattattcaaaaagttaggataataaatttatactgtattcttctttcctgcttaaggcttgtctttaaatttaagctgcttctctttaattcagtggcatatgcgctaaatgttttccctagattatgttcattcatcttcacaacccagaaaataggtataatttttcatacttcacagatgagaaaactgatgctttacagaattacttgttaaattacttgctgtacattacacagatattaaatgtgtgtgaagttactggggcaatttagacgattcgtggcataaagataactgctggaaaacttataaacataggggtgcaacaatcaggaagagaatgaaatggaagggcccrgtagcccccttttaatatgctacaattagattctcaaggtacaagagtttgtctatatactttggaaataaggagcaggattttatgatcttgaaaaatctttcagttttcttattctctaacgacagatctattttatttggcaatgctaaaaattatcctttattagggtggccaatgactaagccagcaactgggaagcagcttacaccactgggcctctgtagcactcacttccccatctgttaagacagccatggccatttaccagtggaatttctactgtcttcccgctggctcctttctgatgtagcagtccttatccctttttctccagcagcctacatgtttagaaaagcagcctcaattggctaaaaggcctaatgctgaaagaactcaagagagaaggagcctcagacaagtagcggctatgtcccaagagcggaagctccccacaacgaggaacacaagataatccgtccrtcagccattcttatccacaccacagtcgcatccccctcaaagctctcccagggtgccagaaattctcgctctgtctagtgtcccgactttccaagcgcttgtagccataccctctccaaatgatgccacttgacctcccaccgtgatgcaggccaaaattcctcctacaaataaatccaccaacacctccaacggactccatacttggggtattttcctttccctgctttctaaatatcgtaaatcccctctctggtcttggaagtcctttctccctcacacctttcggaactccgtgactctccgctctcatgcctccgcctccattctacccttagggctcctcagccagatctttrgctagaaccatggtcaagggagaatgcgattccggctcctgtcacagacgcttaagtgtgagcgcaacccagcccgcctcctcctccacgcccctcacactcacgtgtcgtgggaaactggagtagccaaagctcagaatccccagtgaayacccttctggggatgggagacggggccagctaggggccggccgcagaccccggtcccagagctagtttcagaggccagcgttcyccctagcgcctcgctgtgccccactctgggaaccggaaacaggaagcgccaagaggccgctgggcaaccgctcctcccaccagaccccgcggcatgtgaccatagaaccatttcgcccctttccccttcccgggctccctgataatcttaaactctgattggccagtattctgggactttagctccgccctcgttccrtcagctccaatcactatcgaggttgtcgtttcgccttttctggttgcctttctttcaatggggtcccagagtcccgcttccagggcctctcggctcgcgcaccccggtcacgcggggtcacgcgcctgaccgctcccgggtagggttcgagtgaagagggtgmgaggggcaggtggcggaagcggaagttacgcaggcagctcgccctcgggctccgcgggagttgtagttctcacgctaggtctcctccgggcgcttccctagcccgttcgccgcctgagagggacgctgttccgccgcgtggaagcttcgagtctcgactccactgttgacccctagacgagagtagtgcagcgacggggccgtgatgtgcgtcctggctttcttaacgacacctctcctctgtatttcctttttccagttgagtaccttggggtgaattattattgttactgttatctctgtcgttccttactgcttcgtggtattttgcttgataagcatgctctgcamccacctctgttcgccagaggttacttctgcaaagtaggaagaaacgagcaatacgatggtaatctttgcgcctttgctaagatcttttgtaggttccttatgtcttactagccacttgttgaagtcctgctcattcttaaactctgttcagatgttatttttcctgtaacttcgtgcattcactctcttcagaattaacaatttcttcctgtggaccctcgcttgtggcttgtacctggctttagcatgttttcattccgcttccactcttacgttgcttctatgtgtgcctctctggctctatgcaggtgcctggatttttkattcttacccctctcattagaactactacagtgttttgagtctaataataataaaagctaacggatgcatatctcggtggtgcccggcacttttgtaagtgctttaaacgatagttaattcacttggtcttcacaccaaccttatgaggaagtatcttatcccaagtttacagatgagtaaattaaagcagatagaagctaagtaacaccgtgggtcccaagctattaagttatggagccagtatttaaatagtctccataatccatgctctcaagcactacgctttaccgactgtatgccattctgcatttctttgtttattagtaatacattcagttcaggctaggtagtaatcatatctgggttggatgttgccccaataaaaaaaaaattaaatttttttcttcctgaaaakgaaagtaatttgtgatcagataacacagaaaacaacaaaacaaaaatcatacataaactcaccaggagggtgtgtatttccttcatgaatatatgttgtttccttttttcaaaaatgtatcagtcccacactgtggctcatgcccgtaatcccagcactttgggattccggggcagraggatcacttgaggtcaggaattcaagactagcctgggcaacatrgtgagaccccttctttcaaaaaaaaaaaatcagctgggcttggtggtgcacacctgtagtcccagctgcttgggagcctgaggctggaagattgcttgagcctgggagttggaggctgcagtgagctatggtcttgccactaccctccagccttggtgatagagtgagaacctatctcaaaaagatatgtatgtatcaaatatttttccatatccttgactttacaaataaactttttaatagcataatatttagttctatgcattgctacttaaccaatgacattaatgttgagcatttaagttatttctactgacttaytttttatcaagtaactcaacacagctttactgagcaattactatgtgccaaaaccacagaatatataatatagatcttggggatacagcagagaaaaaagacaaaaatccctgttacaatccgttctagaattgatgttcctttgttggttaattcaagttttgatttcagaaatcttacctcttggtgactgcctagagtggcattgggctggaggggaggaactgttcatgttggaaatggggaatgggccaaaaatgcaattgagtaggttgattaacttgtctgctgtcagagtggaagcaggggtagtttccctttccgaccagaggcaaacaacctgggtcacttccttgcttctcagacctcagtgccctttctgggtgctttctgtgttagaaytctcacctctgagaactgagctcaaggttcttgctggggcaaaaattgaaatgagcagaatttttttttgtttgtttktttgcatttctggcctkcctcctttcttagcctcattattaacaagcacactccccacaataaacctacacccacactgccttctctcacacaaggtaaattgttcaccttgtttagaaagcagttctaggattgttggtctgaaatcaaatgggaaggatgcctcctgttctgtataatcataagagaggaaggtaattaacagtcctagaacctcagcttcccaagtagctgggaccacaggcgcaagcyaccatgcccagctaatctttgtattttttgtagagacagggtctcacatttttgcccaggcttgtcttgaactcctaaactcaaataatctgcctgcctcagcctcccaaaatgctgggattacaggtgtgagccactgagcccggctcagatgcttttcaaaatgatcatgttttccatatttcaaggactaaatatagtttttggtaactttcaattttaatatatttatcatttatagagaagatgcaaggataatacaaagaactctggtacacattttacctaaattcatctttttcccctccatatacattagtttattttgaacaggttgagagtaaacttccattaccattaaatatatcagtgtgtatttcctagaaacaaggacatcctctcatcaaaatcaggaactacagtattaatacaatattaccaaatccatagtctgtattcaaaattttatcacgtttcaatagatgctatgtatagttacttccgatttcccaacaatcacaggagccaagccagagtcacacattgtaattagttgtcattgatcttacttgactttgaaattttgataggtactggccacttgttttgtagaatgtctttcattttggttttgtttgatatatctgatgtaggatttttctcggtcactttgccaaccagggacccgtccatagctagtgacacccccccccgcaaaacccccaggcctcacttgacctgctgcctgtgttatagtttgtatctgcattcggtggttcctgaactcttgtcccacatccaagaagaatgaggatatgctgacaatttgaaggatgagaaggatggagaagaattttattgagcgatggaacagctctcagcggagaggggatgcggtaggtggaggtggtcccccacccctgcagtcaggtggtttctcacccaatgtggctaggtctgggcatttatggattcagaatgggaagtgtgtgctgattggtttgtgagtatgcaaaaacagttaaagtgaagacaccactcaaaggtgggcacgacagtgtagaaaaccaattaggaaagggtaggtgtatataaaatgggtgaaaggtggggatcaatcaaagaaaaatgtgccaaatgggaagacaggtttttaatccggtccatggatttgacttgtagcttggctttcaggctttaaactgtcttcagcttggagatggggtttcactggggatctgcctaggcatttgtctgcctcctgcggctatcatttcctcatgattatatttaagtttgcattttttttggatagaaatgcaagggaagtgatacgtttttatatcaatcagggtccattcagaaacagatatcatattggcgattttaacaggaaaaatttaaagaattattttctagtaaaagatgatcagttactaaaagaggactctatgatacagaagaagcagctacgaaaaggagctgttacttctagggctgaagaagagttaataaaggagttacttaagttaaaggaaatgctcccttccccacctgcaagattagagattcagatctctgaggggagggtgtgtttcctaccacaggaacatgcagtccacccactgatgaggccgagaagttgcgggagggtgtgggcctctgttgagcagccagtgggagccttttagtggtgcctcctttatccttttgacatgtccatatgattttttgaggaattctttactttcaggcacataagatgttccgattttatcttgtagcattcagcatgaatggacctggaggacatcatgctgagtgaaataagacacacacagaaagaaaaatatgatatgatatcggttgtatgtggagtcttgaaaaaaatcaccatagaaacagtgtaggaagatggttaccaggggcggggtaggggaaatgggaagatgtaggtcaaaaggtacgaagttgcggttagattctaatgttctagtgtgtaacataaggactatagttaatattgtattgtatactggtactttgccaggagagtagattttaggtactcttaccaccaaaaaaaaaaaataactacatgagatgatgaatatgttaatttgcttgactgaagtaatcacttcactatgtatatgtgtatcaatcaaaatatcttgtatgcctcaaatgtatatttttaaaaagttttgtggttctcttacccttatcctagaatcagtcatttcaccaaggggtcttggttcttttagtggaaaatggtattgaaaaaccaagatgtgattacgagttgtgtttgttgctacttgtgtgtcactgcttcagtgtcagcagacagagctaggaaattgtttatttccaagagtgaaccaagttcccattatattcattgtatgtatacatttattcacatataagaaaacacaggaagtgattttttaactgataagccatacgatgtgtgaagcaagcctactagtaagagttccatatttgtttaaagttctggtttctcttgttaaggcaaaatatataagtcatgaaatgtacaactcttttttttcttttttttttgaggcggagtctcgatctcttgcccaggctggagtgcaatggtgcgatcttggctcactgcaacctctgccttctgggttcaagctattcttctgcctcagcctcccgagtagctggaactacaggckcctgccatcatgtctggctaatttttatatttttagtagagatggggtttcaccatgttggccaggctggtctcgaactcctgaccttgtgccgcccacctcggcctcccaaagtgctgggattacaggcgtgagccactgcacctggccgaaatatacaactcttaaggatacaattcaatttattttgacaaatgcatcataactgttatctgtaatcaaaaaatttagaagattttcatcatccaagaaaatttcctcatgctcctatccagtcatcttctcctagtcctagaggcaactattgctctgattttttttttttttttttttttttttttttttttgagatagagtctctatcactcaggctggagtgcgatggtgcaaacatggctcactgcagcttcgacctcccaggctcaaatgatcctcccagctagcctgtggagtaggtgggaccacaggagtgtgctaccatgctaggataatttttttttattttttgtagagatgaggtttccttattttccccgagctggtcttgaattcctgggtttgagtaatctttccacctcagcctcccgaagtgctgagattacaggcatgagccatcaagcctggtcttttgaatttttcttttttttaaattatagattaattttgcctattttagaacttagtataaatggacagatactgatagtggtgggaagcagacaaattcctaggtagatacgggcgggtccctggtgaaaaccaaccttcgagtcaaagaccgcyggaagcctgaaaactcacctgccagttctgggtagaatctaagacccaagtgagaactcccgcaatgccttttagccaatcaaatggtgctttttccaggctgcctatggaccaatcagcacacactcccccattctgagcccataaaaactcccggactcagctacacagtgggactaccacctttgggtcccctctctgctgggagctgttctgttgctgaataaacgtcctctctgccttggttactctgcaattgtcagtgtaacctcattcttcttggacgcaggacaagaactcgggacctgccgaacagcgggtgcaaaagaacagcaggtgaaaggctgtagccctcctgccctctcctggcaccaggcggccaccccacgttatgggaagtggtggtggcgccaggccagcccaggagccrtgggctggtgggactgaacaagttgggacatgcmcccgttcggcaaagcttgtggacagcaggaatgaatgaactgtaacacaaacgagctgagactcttcggggtgcaracctcgggattccccaagccagagctgtaacatgctgtaacaccccccaccgcatttttttttctttttcttttgagacagagtctcactctatcacccagactggagtgcagtggtgtgatcttggctcactgcaacttactgcctcccaggttcaagtgattctcctgcctcagcctcctgagtaactgagattacaggtgcctgccacgacttccggctaatttgttgtatttttagtagagatggggtttcgccacgttggcccggctggtctcgaactcctgacctcacgtaattctcccacctcaggctcccaaagtgtggggattaccggcatgagccactgcacctgacctttgaagttccgcagttgctggtgtcttttgagttttttggacgccactgcgttcccttcgttcatatgccagtgcccaaggcagaagctgcttgcagtatacctgatccagccacagcttcacatgaagctggtgcctggaggtgatgccctgctgtagcagctagcatacctggcttgcccttggtgggtgtgagatctgggccagtaccgctagccaagagccaagcacagcctgccaagcccagtgggtggagccagcccagtggtcacgagtgaatcttgatcttgagcagggcccccccggccgtggaggtctctggctgtggaacaccaccaaaaaatcctgtgtcaatagcatgttccttttgcatttgtttgatttctttcactgtaatatctgtgaacttgtatgtatcagtagtaggttttgttttgtgttttggtggggtagtattacattttatgaatacagtagccctcccttctcctcaggggacatgttccaaggcccctgctgtagacagcatctaacccagttgccttcaatgagaatatgtttctgttcatatcttccacccacaaatttaatgccttttctgtcttaacgaagcacttaccgtggcccatggcagtaacttctgcagtttgagttgcaacagcaaaactagcacacattcttttcccttcttcacaatttaacagatagaggatttattcttaccatagatgttagcaacctcggaatacatgttttgttttttgtttgtttgtttgttttgttttgtttttttgttttttgtttttttttagtaagtcaagaaccttcacctttttatttaaaggaagcactttacacttctctttggcatgtctgcatagccagcattactactcttgcgctttgtggccattattaagtaaaataagagttacttgcactgcagtactgtggcagtcaatctgataactgagagggacactaacgggcagggagtgtccccagcgtgtttccactggatgaaggggtgatttatgtcccaggtgggatggagcaggacagtgcaagattttatcacagtactcagaacagcatgcaatgtaaaacttatgagtagtttatttctggaatttttcatctgatattttcagacctcggttgactactggtaactgaaattgtagaaagcacacctgcagataagggtggggaactatcgtatttctcatcttattcattcccttttgatgggcgtttgggttctatctgtattttcttctaagaagccttatagttttatgtttatgtctgtaatttatttttaaatttttttagagacaggctcttgctatagtacccaggctggtctcaaactcctggcctcaagctcttctcccaacatggcctcccaaagtgttgggattacaagcatgaaccagtgtgcccggcctgtgatctattttgagttaatttttgtgtatagttgaggtaggactgaggttcctttttttccccatatggatatataatgacttcctataacattgtttgactatttttcctctcttaattgcgycagagctttgttgagaatcagttgattgtataaatgtagttctgtttctggacttaattctgtttagttgatayctttattattaagctaataacacactcctgattcttctagttttatattaagtcttgaagaaaggtattataagtctttcttctcttttcaagattgttttggctattctaggtcctttgcatttccatatacactttaaaagcaacctgtcaatttctgttaaaaaatcctgctggggcaaggcatagtggctcacgtgtgtaatctcagcactttgggaggctgagatgggaggatcacttgggctcaggatttcaaaccagcttgggcaacatggtgagactctgtctctacaaaaaaacctaagaattagctgagcgtggtggcttgtgcctatggtcccagctacttgggaggctaaagtgggaggatcgcttgagcccaggaggtcaaggcttcagagagccgtggttgcaccactgcactccagcctggacaacagagtgataccctgtatcaaaaaaaaaaaaaatcctgctggggttacaattggggttgatatgaatctgtagataaatttggggaaaattgacatcttaatgttgagtcttataattcatgaatatgaaaccacctttgcagaactataagtaatgagagaagtctaatatggttgactccatcttgcttccaacctctcaagttaaattgtttttttgtccattctaatgtgggggccaagataactataagaggaatttagtttacagttaaaaccacattcataaaacaaagttaaaattatggtaggggcttgaactttgctgaagaatagacatagttgaacaatgacccgccattrcttagcttgtttttgttatataagttgcttactgccccagagtcttgtatctggggtsgcaagatttagagcttctccaacttctcctgtaggtaatattactattgtaaaacctgaagaactggtctttgagacatttttcagatttagcatttcaggagaccaagagatgccacttcgtcctgagaccgcttcccaggaaatgacytggctgtgtgaawatggttttagacacccctgcaatttcatccccagccaatccgttgtttcagttctccagccccctgcctgccaaagtagtagttaaaaaactctagcctctgaactcttggggggatgagtttgaaaagtgtctgtcgttctcctcacttggctggccctgcaattattaaactctttgctgcaacacctgctgttctcattgtttttttcagggcagcaggcaagaagaacccctcgggctatgacaaatagggtacaactctatttatgtaggccttaatttttttcagcaatgttttacagttttcagtgtagaggacttacgtgtctttcgttacatttgtcctgaagtgctttattttttgatgcttttataactgaagttattgtgaaaratttattttgtgaatgtttactggtagtatgtagaaacacaattggtttttgtatttgtaactgtattctgttagtttgccacttattttggcagttgctttttagatttgttaggattttatatttagacaatgartttgtctgctagtttaatatctattttcagacttctggattctgttcatgatggtataactgggactggatttattcttctatcttaaacaactggcaaactgggaaaatatatggaacaatggcttcctgatattggacaacaggtaacacaagacagtgattcctgagaggaggggaataagttaggcgagccccacaattccccctrcttaatgcatggagagactatccaaggtgcagtgcaggaagggggaacccagacagagcctgccagtttcactgagcttcagagggagagagtgtggagtttgagaagactaaggcaaagactaagatttgtgggtcagagtaccagagaaaagagagatgcgcaaagagtgagctctagataactacagaggaatcctctcaagcctttggttgagttctgagctgaaccacttcaaagkagtaggcagaacaactcttagatctcacacagtgctaggaatagtgttttcacctgccagagtggaaagatgttcttaatatatgggattttcagtaaagttctgagaagacttttgactcactagcgcattcaaattagttctagacttacataaagccctgataaagctttaatatggtgggaagcatggatccatggattgttcacatttttgcatgtctttcaagcagaggccctaactgaccttttgttccagactatcttttcaagaatatctgaatagtgaacagccttagaatacagaaatagtgtctccttctggggccaagggcagatttgtttattgtccagtataataaaggtcatgtatccttttgggacaaaatatagtactgcttgtagcacattataaaaattcagattccttaagctcaagggagattccctaaggtctcctctcatttgacccactcaatgttttctggtagttaggttatttgaggggacgaggtgtaggagatggcaaagaagaggagaaaaagaaaatttctaccctgattatcaaagataccaagagtgtcatctcctttaatccctgtaccaactcagcaagttaggtttcattttacataaggaaactgaggttcacagacattaaactgctcaagctgtgatgtagacccactggttgcacagcatccatctggccttttccatattgctgctttgagacttgggaggcaagaaaaaccaatgcaaacaggaatctcatgttgcttgctacactgtaaatagtaatgtcctttgcctttgagccaggagttttgtgtctttagctaatatttgtgaaacttggcaggttaatgtgtttgctcagaagtagcataaaatctctgattcttcacagttctagataaaaaacaggcctcaaaaggatcaaactgataacaggtaactgtgttccataaaaagagatggcaatttttatttatttatttatttatttttagagacacagttttactcttgttgcccagactggagtgcaatggtgcgatctcagctcactgcaacctccatctcccaggttcaagtgattctcctgcctcagcctcctgagtagctggggttacaggcacccaccaccatgctcagctaatttttgtattttttttttttagtagagacagagtttcaccatgttggccagcctggtcttgaactcytgacctcaggtgatctgtctgcctcggcctcccaaactgggattacaggtgtgagctactgcccatggcagcgatttttaaaagaacacaacaatatctggcactctgtagcatacaattcacaatgtctggcatccaggtaaaaattgccacacaagccaggtgtggtggctgtcgtctgtaatcccagcgcattgagtgtccaaagtgggaggatcacatgaggccaagagtttgagaccaacctggataacataggaagacctcatctctacaaaaaatttaaaaattagccaggcatggtggtacgcacctgtagtcccagctacacaggaggctgaggtgggagaattgtttaaggccaggaggtggaggttatagtgagctatgatcctgccactgcactccagcctatgcaacagagtgagaccccgtctcttgccaggcttgctaagaaggaggtaaatgtgatctataacaaggagaaaaaaaattaatagaaagagacccagaaatcacaaagctgatagaattatcagcaaggatgataaatcaggttttataaatacactccatatgttcagagaatagaggaaaattgaacatggtgaagagaaaaatggaagatattcaaataatatcttctagaaatgagaagtgtaatatctgaaatgataagatgaatatatgatggatgggatcaacaatgattagaaactgctgaaggaaagattagctgacttgaaaacgtattatcagaaaatatccaaaataaatacatggaggctaggagtggtggctcacacctgtaatcccagaactttgggaggctgaggtgaatggatcatttgagcccaggagttcaagatcagcctgggcaacatggcaaaaccccatctctaccaaaaaaatacaaaaattagctgggcttggtggtgaacacctatagtcccagctactcagggtgctgaggtgggaggatagcttgagcccaggaggtggaggttgcagtgagctgagatcacaccactgcactccagcctgggtgacagagccagaccctgtttcccaaaaaaaaaaaaaaagaaagaaagaaaaaaagtaaaggaaacaaacaaaataaacacaaagggaaaacagaagatacctcccccaaccctgaaaagatcagagcttcagtgacctgtggtactacgtcagtcaatctaacatgtataattagggtttcagaaagaggacaaatttggcccaaatttttccaaatgagataaaaactaaaaactcatagatcaaagatgctcartagattttaggcagaagaaacatgaaaaattatatatactgagctacattattaagctgctgaaagtcaatgataaagagaacatgttaaaagcagccagagaaaaaatatataatggcatagtttctttgcatcagaaactatgcaagctggaaaaagttaaatatatttaaaacactggggtgagtatggaaaaccctgtcaacctagagttctatgcattcaaaaatacctttcagaaatgaaggcaaactcaatttttttaacatgaacacatgctgagagaattcattgcaaacaggccactaaaagatatattaaaggaattttttctgcatgaaggaaaataacaccaagggaaaagttagttttatacaaggtaatgtagaacatttagaaatgttgaaccagccttgcatcccagagatgaagcccacttgatcatggtggataagctttttgatgtgctgctggattcggtttgccagcattttattgaggattttcgcatcaatgttcatcaaggatattggtctaagattctcttttttggttgtgtctctgccaggctttggtatcaggatgatgctggcctcataaaatgagttagggaggattccctctttttctgttgattggaatagtttcagaaggaatggtacccagctcctctttgtacctctggtagaattcggctgtgaatccatctggtcctggactttttttggttggtaagctattgattattgcctcaatttcagagcctgttattggtctattcagagattcaacttcttcctggtttagtcttgggaggatgtatgtgttaaggaatttatccatttcttctagattttctagtttatttgcatagaggtgtttatagtattctctgatggtagtttgtatttctgtggggtcrgtggtgatatcccctttatcattttttattgtgtctatttgattcttctctcatttcttctttattagtcttgctagtggtctatcaattttgtttatctcttcaaaaaaccagctcctggattcattaattttttgaagggttttttgtgtctctatctccttcagttctgctctgatcttagttatttcttgccttctgctagcttttgaatgtgtttgctcttgctcttctagttcttttagttgtgatgttagggtgtcaattttagatctttcctgctttctcttgtgggcacttagtgctataaatttccctctacacactgctttgaatgtgtcccagagattctggtatgtcgtgtctttgttcctgttggtttcaaagaacatctttatttctgccttcatttcattatttacccagtagccattcaggagcagattgctcagcttctatgtagttgagtggttttgagtgagtttcttaatcctgagttctagtttgattgcactgtggtctgagagacagtttgttataatttctgttcttttacatttgctgaggagtgctttacttccaactatgtggtcagttttggagtaggtgtggtgtggtgctgaatagaatgtttattctgttgatttggagtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacatgagatgggtttccggaatacagcacactgatgggtcttgactctttatccactttgccagtctgtgtccctgggatgcaaggctggttcaacatacgcaaatcaataaatgtaatccaatatataaacagaaccaaagacaaaaaccacatgattatctcaatagatgcagaaaaggcctttgacaaaattcaacaacacttcatgctaaaaactctcaataaattaggtattgatgggatgtatctcaaaataataagagctatctatgacaaacccacagctgatatcatactgaatgggcaaaaactggaagcattccctttgaaaatgggcacaagacagggatgccctctctcaccactcctattcaacatagtgttggaagttctggccagggcaatcaggcaagagaaggaaataaagggtattcaattaggaaaagaggaagtcaaattgtccctgtttgcagatgacatgattgtatacctagaaaaccccattgtctctgcccaaaatctcctcaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggacacaaagaaatggaagaacattccatgctcatgggtaggaagaatcaatatcgtgaaaatggccatactgcccaaggtaatttatagattcaatgccatccccatcaagctagcaatgactttcttcacagaattggaaaaaactactttgaaattcatatggaaccaaaaaagagtccacattgccaagtcaatcctaagccaaaagaacaaagctggaggcatcacgctacctgaattcaaactgtactacaaggctacagtaaccaaaacagcatggtactggtaccaaaacagagatatagaccaatggaacagaacagagccctcagagataatgccgcatatctacaactatctgatctttgacaaacctgagaaaaacaagcaatggggaaaggattccctatttaataaatggtgctgggaaaactggctagccatacgtagaaagctgaaactggatcacttccttacaccttatacaaaaattaattcaagatggattaaagacttcaatgttagacctaaaaccataaaaaccctaggagacaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactatcatcagagtgaacaggcaacctacagaatgggagaaaattttcacaacctacttatctgacaaagggctaatatccagaatctacaatgaactcaaacaaatttacaagaaaaaaacaaccccatcaaaaagtgggcaaaggatatgaacagacacttctcaaaagaaggcatttatgcagccaaaaaacacatgaaaaaatgctcatcgtcactggccaccagagaaatgcaaatcaaaaccacaatgagataccatctcacaccagttagaatggcaatcattaaaaagtcaggaagcaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacttatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactattgcaaggacaaaaaaccaaacaccgcatgttctcactcataggtgggacttgaactatgagaacacatggacacaggaaggggaacatcacacaccggggactgttgtggggtggggggaggggggagggatagcattaggagatatacctaatgctaaatgacgatttaatgggtgcagcacaccaacatggcacatgtatacatatgtaacaaacctgtaagttgtgcatatgtaccctaaaactttatactttaagttttataataataaaataaaataaaataaatgttaaatatgtgtataagtgtaaaagacacctgttttaatttttaaagatatctctaaaaaattaataaccaggctgggccaggtggctgacacctgtaatcccagcactttgggaagctgaggcaggaggatcctttgagcccaggagtttgagaccagctgtggcaacatagcgagactccgtctctayaaaaaattaaaaaattagccaggcgtggtggtgcatgcttgcagtctcagctacttgaaggctgaaatgggagatttcttgagcctaggagttcaaggctcaatatatgaaacaatggttccatgtattttctgcactgcagcctggccaacagagctggaccttgtctcaaaaaaagaaatgaggaaaaataataatttattttggaatttataacaatagaagtaaaatgtatgaaaacggccagggaaagggagatgggtatactattgtaaagttcacttcatatacatgaagtagtatagtattatttgaaagcagaatgtgactaaagatgtgcaatggagaacctagagcaatcataacagaaagaaaagaaggaaggaagggagaaaagaaagaaagaaaaattaaggaaagggaaggaaggaggagggagggaataaatcaagaaagggaaagataaataataagcaataataaagtagaatcatgaaagacattcggtttaaaaaagaaaatgaacagaaaataaatagaacatacagaagataaatgcaaagtagtagatataaactcaagtaaaatgataatcacattatctaaatggccaaaattctccaattaaaacgggtcgtcagattagatttttaaaaaaggtccaagtgtatgctatctaaaacaaaaaaaaaccacactgaaataatagaaaaatctataccatacaaagagagttggagtgcctatcttaatcagacaaagtagatttcagaacaagaaatattactaagccttgctctaaaatagagtgacaattttataagggataaggggtgataattttataaggataaaagggtcagataatcaggagaacatgtgtttgcacctaataacatagcttcaaaatacataaagcaaaatctaagagaacttgagaggaaaagacaggtccataattatagttggaggttttaacacccccaccccacgtaattaacagaaaatctgtggtggtataggagccttgaacagcatatcagttaaactgtttaattgacattaatataacatttagtccaacaaatgaataatgtacattcttttccagtgcacacagacttttaccaagatagcacatattctggccataaaacaagttttaatacatttamaaggactgaaatcatgcaaagtatatttgacsaaaacagaattaaactagacatcattaataaaacaatacctggaaaatccccaaatatttgaaaattaacagtttttctataacccatgggtcaaagaagaaataatgaattaaattaccaatattttgaattgaacaaaaatgaaaacattatcatcatcaagggatgcagctaaagcagtgcttacagggaaattcatagcattaaaattttagcattatgctaaaatttatagcattattattttttatttccacagagtgaagtttatcctcaacaaagctctcctctcccatctccagccttggacagggtaggacaggtaggggctaagatgtggctccagtggttgaggggcctctgagaaacaagtaagggccctgggcttccaggcaaaaccgtgtctggctcctccagccaggctgagtctgctgtgcctccctgcccaggccttgggaaagaggagggtgcagtggctcctggctagttccamagtggagtgtgaaaatggtgagttgtttacatgcagtggccagtacagcgtggtactcacacctctttctggaagttgccattgggtggctctgtgggctcccaggctrttgctcagtgcagtcagccgttcttgggagttctgggggaagagcccagtgtcatggatttgagggcattccagctctgaggttgcaggcttctccttggcagtgggctggctaccgtagcaggtgaaagtgtggaacttctggttgagctcttttattttagttaaaaaaaaaagtctcaaatcaatgatctaagctttcacattgaggaatgagaggaagaggaggaaattacacttaaagtaagcaaaaggaagaatctaataaagaggcacaagacatcaatggaatagaaaatagaaaaacaacagagaaaatgaagccaaaatctagttttttaaagtgatcaataaaattgataaaatgttgacaaaatgactagaggaaaggcacacatttccaatatcaggaatcagggaggtaaaatcactatagattctaagccatgaaaagcatactaagggctgggcatggtggggctcatgcctgtaatctcaacactttgggaggccaagacaggtggattgcttgagcccaggagtttgagaccagactgggcaacatggtgaaaccccatctctacaaaaaataccaaagttagccaggtatggtggtgcatgcctgtggtctcagctactctggacgctgaggtgggaggattgcctaagcctgggaggttgaggctgcagtgagctgtgattgtgccattctccaccagtctgggctacagagggagaccttgtctcaaaaaacaaaacaaaacaaagcaaaacaaccacgataataagtggtcagtaaaatctggcctgtgtgcctaatctggcttgccatttcttttgtgagtaaagttttattggaacacacacacaactatttacattgtatctatggctgcttttgtactatagtggcagaagtgagtagttgtgggagaccacattgccagaaaagcctgaaatatttactgtgtggcttcttacagaaaacgtttgctgatccctgacttagatgaaaagaacaaataaattgacagacactaactaccaaagtcactcaaggaaacagatagcctgtatattcccctatccacggaaaaaattgaatttatggttaaagttttcccacaatgaaagctttgggcccagatggcttcactggtaaattccacttcttccttttcatcttttatttatttacttttcggcttcactggtaaattccacttcttccttttcatcttttatttatttacttttctctaggatttcagtacagtgtttcatagagttgctgaaataagacatccttgccttgttcttaatcttactgagataacattcaatatttcaccttaagtgtgttaggttagttgtaggttttatgtagaagccattatcaaattgagaaagtttccttctgttcttttgcagaccttatttattctgaatgggtgttgaattttttttcatgcttctttctgcttcagttcacgtgatctatatcttttttctgtttcattatgttaatatggcaaagtacattgattgcttttagaatgttaaaccaacattgtacatttctgggataaactgtactttgtcatgatgatttattttatatttttatagatattttgttaaagattttcatgtctataatcttgaaggcggagcgtctgtaattttcttttcttgcaattttttgtcaggtttggtatcagagtcataatggcctcctaaaccaaattgggagagtgtacttacattttctactttttgaaggagcattgttatttatttcttaaagtttaatatagtatgctattgaagtcacctgagcacgaagttttctttgtgggtaagtgtgtattaaccaattcttttttttttagtggtaaagagctattcaaaaatttatttctttttgtgtcagtttgttaaattctgttttttttccataaataattygtctacttaatctaacttgttaaatttattgacataaagatataacattaccttattatacttttaatgtctttaaaatctttagcaatatagcctctccattcttgatattggtaatttgtgttttttctctttgttattttagtttttatttatttattttttttgagacagattcttgctctgttgcccaggctggagtgcagcagctcactgcaacccccccaccaccccgcccacaacccccaggttcaagcaattctcctgcctcagcctcccaagtagctgggattacaggcgtgtgctaccacacctggctaatttttgtattttcagtagagacggggtttcaccatgttggccaggctggtcttgaactcctgacctcaagtgatccgcctgcctcggcctcccaaagtgctgggattacaggcctgagccacctgggaggctgaagttggaggattgcttgaggccagtagtttgagaccagcctggttaacatagtgagacctctgtttaaaaagaaaaaagttttgtatcagctatttatatattttggatattaaccccttatcagatatatggtttacaaatattttctcccattctatagaatgtcttttcactctgtcgattgtttcctttgcagtgcagaagctttttagtttaatgaaataccatttgtctatttttacttttgttgtctgtgcttttggtgttacatccaaaaactcattgcccaggccaatgtcaagaagatttcccctctgttttcctagagtagttttacagtttcaggccttatgtttaagtctttaatccattttttyttttttgagacggagtctcgctctgtcgcccaggctagagtgcagtggcgcaatctcagctcactgcaagctccrcctcctgggttcacaccattctcctgcctcagcctcccgagtagctgggaccacaggcacccgccaccackcctggctaattttttgtatttttagtagagacggggttgcaccgtgttagccaggatggtctcgatctcctaacctcgtgatccgcccctgcctcggcatcccaaagtgctgggattacaggcgtgagccactgcacccagccagtctttaatccattttaagttgaatttttatatggtgtgagttaagtccagtttcattcttctgcatgtagatatctggttttcccaacaccatttattgaagaaactattctttgccttttgtatgcttttagcaaccttgtcaaagatcatttaactgtaaatacgtggatttgttgttgtgctccctattctcatccattggtttatatgtctgttttcatggcagtattatactattttgattgctgtagctttctgatatatcttgaaatcaggaagtgtgatacttccagcttttctcttcttgctcaagattactttggctatttggggtcttttgtgattccatataaatttaaggattattattactattctataaagaatgccacttggggctgggcacagtggctcacacctgtaatcctagcactttgggaggcccaggtgggtggatcacctgaggtcaggagttcgagaccagcctgggcaacatggtgaaatcctatctctactaaaaataaaaaagttagccgggcatggtggcgcacacctgtaatcccagctgggctgagggaggctgggatttgggaggcggaggcaggagaattgctagaacccaggaggcagaggtttcagtgagctgagatcgtgccattgcactccagcctgggtgacagagcgagactccatctcaaaagaaaaaaaaaaaaaaaaaaaaaaaaaagaatgccattgggactttgataaagattgcatttaatctgtagatcactttgggtgggctgtggtttgtatgtgtcccctcaaattaatatgttgaaacttaattgccaatatgatagtattaagatgtgggacctttaggaggtgaatgtgggaactttaggaggtgattgggtcatgagggctttgccctcatgaatggaattcatgaccttataaaaaggctggaggaaaccaggtagtcgccttttgcccttctgccttctgcccatatgagaacaagtgttcattcgctctggtgggcatagcaacaaggtgccatcttggaacagagactgggccttcatcagacattgaacctgtgccttgatcttggacttccagagaatatgacaaataaaattacccagtcttaggtattttgttatagaagcacaaatggactaagacatagtatggatattttaacagtaataattcttcctatccatgaacatgggatatctttccatttatctgtgtcttatttaatttccttcattaatgttttataattctcagtgtgtaagtctttcaattcaactctttggctaaatagaaataaattctaagtattttattctttttcttgctattataaatggtattaatttaaaattttccttttcagatagttcattgtgtatagaaacatgaatgatttttgtatgttgattttgtattctgcaactttactagttctaatactttttttgttgagtcttttagttttctatatatataatcatgtctactgcaaatagctatagttttacttctttctttttaatttggatgcctttatttcattttcttctctaattgctctggctaggatatccagcactatgttgaatggaaatagtgagaatgacatcttttcctttaaccagatcttacaggcaaaactctcagttttttgtttttttgtttgtttgtttgttttgtttttttttttgagatggagtctcactctgttgcccaggctggagtgcagtggcgcgatctcggctcactgcaagctccgcctcccgggttcatgccattcttctgcctcagcctcccgagtagctgggactacaagcgtccaccaccacacccggctaattttttgtatttttagtagagacggggtttcaccgtgttagccaggatggtctcgatctcctgaccttgtgatccacccacctcggcctcccaaagtgctgggattacaggcgtgagccactgcgcccggctgtctcagttttttctgtattgattgggatgttagctgtgggcttctttatatggtttttattatattgaggtacattctctctatacccattttttgagaatgtacattatgaatgaatgtcaaattttgctacatgctttttctgcatctattgagataatcaaaagagttttttcattatgttaatgtggtgtattacattcattgatttgctagtgttgaatcattcttacaatccagggataaattccacttggtcatggtgcatgagccttttaatgtgctgttgttatttggtttacgggtattttattgaggattttacatctgtttttatcagggacatttgtctgtagtttccttttcttgtggtatctttgatattgcttgcctcataataattatgaggaggcattacctcttcttcttcttcttcttyttttttttgagacagagtcttgctctgtcagccaggctggggtgcagtggtgtgatctaggctcactgcaacctctgcctcccagattcaagcaattctcctrcctcagcctccagagtagctgcgattacaggcacctgtcaccacgcctggctaatttttttttgtatttttagtagagatggagtttcaccatgttggccaggctggcctcaaactcctgacctcaagtgatctgcctgcctcggcctcccaaagtgctgggattacaggtatgagccaccacacccagccacattttctattttttggaagagtttaagaagattactattaatttttctttaaatgttttgtaaaattcatccatggaaccatctagtcctgggttttaatttgttgggaggtttttgaatactgatttattctcctcatttattattgatattttcaggttttctagttattctcaattcagtttcagttggctttatgtttttagaaatgtatccatttcttgtaggttatccaatttgttggcatataattattcttaagtgctccttatgaccctttctatttctgaagcattcattgtaatgcctcttcattcattttttattttatttgtgttttcactctttttttcttctttcttttcttttctttttcttttgagacagggtcttgttctgttgcctaggctggagtgcagtggtgcggccatggctcactgcagccttgacttcccaggctcaagtaattctcccatgccagcctcctgagtcgctgagactacaggcatataccatcacactggctaatttttgtatttcagtagagacgaggttttgccatgttggccacactggtcttgaactcctgacctcaggtgatccgcccaccttggcctcctgaagtgctgggattacacgtgtgagccactgggcccagctttttttttcttagactagctaagtgtttgttgatttttatcttttcaaaaaataaactcttggttttgtcaattttcttctattgttttcttttctttatttgatttatttttgctctaatctttattatttccttccttttgctaccatttggcttaatttgtttttctttttctagttttttgaggtgtgaagttagattgtttattcgagattttctttttgaatgtagatgtttattgctctaaaggttcctcttagtattgcttttactgcatcccataagttttggtattttgtgttatcatttttgtttgcagatagttttaaaatttccatgtgatttcttcttttacccagtggttgttcaagaatatattttttagtttctatgtaaatgtggatcttctcattttattagttattgatttttatttcattccattgtaattgaaagagatagatatttggaatgatttgtatcttcttatgtttgttacaacttgttttgtgacctgacatgtgatctatcctggagaatgttctctgtgctcttgaaaagaatatttttctgttgttgggtgaaaatttctgtatatatctgttgggtctatttggtctatcatgttgttcmaatcagctgcttttttaattgattttttgtccatatgttctattcattactgaaagtgggggtagtgaggtctactaatttattgtattgctgtcaatttctcccttcaaatctgtcaatatttgttttatatattagattctctgacactgagtgcatatgtatttgtaattgttatgtattcctattgaattgacctttttatcaatataaaattaccttttttctttagaggatgtttttgactcaaagtttacttttttttttgagacagagttttgctcttgttgcccaggctggagtgcaatggcgtgcattttggctcgctgcaacctccaccttatgggttcaagtgattttcctgcctcagcctcctaagtagctgggattgtagacatgtactaccacgcctggctaattttttgtattttttttagtagaaacggggtttcaccatgttggtcaggctggtcttgaacgcctgacctcagatgatctacccgcctgggcctcccaaagtgctgggattacaggcaagagccactgcacccatcctcaaagtttactttttttctcatgtaagtatagccatttctgctctcttttggttactttttgcatggaatatctttttctatcccttcacttcagtctatgtctgttcttaagtctaaagtgagtttcttgtagacattgcatcactagctactgatttttttttttttgagacggagtctggctctgccgcccaggctggagtgcagtggcgtgatctcggctcactgcaagctccgcctcctgggttctggccatattcctgcctcagcctcctgattagctgggactacaggtgcccaccaccatgcctggctaatttttttttttttttttttwtttgtagtagagacagggtttcaccatgttagccaggatggtctcgatctcctgaccttgtgatctgcccgccttggcctcccaaagtgctgggattacaggcatgagccaccacacctggcctagatcttgagttttaaaatctaatcagcctgtatgccttttgattggggattttatttacatttaaagtaactcttggtaagtgaggacttactattgccattttgttgttttttgttttatagttcttttgttcttctcttcctctcttgctgtcttccttttttttatttgatggtttttatagtgaattgctttgattcttttctgtaacacttagtggttactttgagtcttgaataaaataacttgttgttaaaataatctattttgagttgataatttaattgcatacaaatctgtacagtgttgcttcctctgcctgaattttgtgtttctgtattgtttcaatctcattcttttgagacagggtctcactttgttgcccaggctggagtgcagtagccccatctcagctcactgcagcctctgcctcctgggttcaagcgattctcctgcctcagccacctgagtagctgggattacaggtgtgcaccaccatgcctggctaatttttgcattaagagtttcattcttttcatagtgtgcattggttaacaaatctttattttttttaacttttatgttaggattaaaactatatgtaccactattacagtgtcatatgattctgtgtttgtctatataccttcaccaggagatttaggctttcacattgctagttagcatacttcacrttgctgtttagcatgtttcaacttgaaggacttccttgagcatctcttgtaagtcaggtctagtggtgataaactccctcaagttttgtttatccagaaaaaagtaatttgtccttcattaaaaatttttgaaaatgttataatttttacatttttagtatagatgaattctcactatgttgcccagatgtgggattcaaataatcctactgccttggtctcccaaagtcctggaattacagacatgaaccactgcacctagcctgtccttcatttttaaacaataatttttctaggtatatcttggttggctgttttctctttcagtactttgaatattttatccctttctcttggtctgtgaggtttaggctgagaaacctactgatagtcttacatgtgacagtctttctttttctttttctttcttttctttctttyyttctttctttctttctttctttctttctttttctttcttttctctctctctcttctttctttctttctttttttttggagtctcactctgtcacccaggctggagtgcagtggcacattcctgsctcactgcaacctctgcctcctgggctcaaatgatcctcccacctcagcctcctgagtacctggggctacaggtatgtgccactgcaccaggctaatttttgtagttttaggaaagacagggtttcaccatgttgaccaggctggtcttgaactcctgacctcaagtgatccacctgcttcagcctcccaaagtgctggaattacaggtgtgagccacttcacctggcctgtcttttttttttttttttagacatatcttgctctgtcacccagactggagtgcaatggtgcaatgtcagctcactgcagcctgtgcctcctggattcaagcaattctcctgcctcagcctcctgagtagctgggattacagatgcccatcaccatgcctggttaattttctttgtatttttagtagagacagtgtttcaccatgttggccaggctggccttgaactcctgacctcaggtgatccatctgcctcggtctcccaaaatgctgggattacaggtgtgagacactgcacctggcctgtccttcatttttaaaagataatttttccaagtatagtattcttggtttggctgttttctctttcagtgctttgaatatatcatcccatcctcctggcatatgaggtttctgctgagaaatctactgatagtcttatatgtgatgagtcatttttattgtgctactttaaaaattctctttgtcttacctttaacaatttaattataatgtgtctaggtgtagacttctttatgtttaacctacttggaatcttttaggattcctgaatctggatgtctatgttcttccctcaatttggatagttttcaattattaytttgttacatatgttttctgcttctttctctattctccttgtgggacttctataatgtgtatattggcttgcacattcatgtctcccaaatcctggaggttttctttttcattctttttttttctcctctgactggataatttcaaataacctgtgtttgaggttgctgaatctttcttcttttgatcaagtctgctgttgaagctctgtattgtattttttattttactcatgtattcttcagctctataatttctgctttttttgtttttgttttttgtttgagttggagttttgctctgttgcccaggctggagtgcagtagtgcgatcatggctcactgcaacctctgcctcccaggtttaagtgattgtcctgcctcagcctcccaagtggctgggattacaggggcctgccaccatgcctggctaatttttgtatttttagtagagacagggtttcaccatgttagccaggctggtctcaaattccttacctcaggtgatctgcccacctcagcctctcaaagtgctgggattactgggattactgggattacaggtgtgagtcaccatgcctggccctgttttttttgtttttttgttttttaatgatttctatctctctgttgaacttctagttttgttaatatattgtttctgatatcactgagttgtcaatctatgttatctttagcttactgagcctctttaaaacactttaactttgaattctttgtcgggcaattcatagatctccatttctttgggtttggttactggaaatctattgcgttttttggtgatgtcatattttcttaattttttatgttccttataggcttgcagtggtgtcaatgcgtttgaaacagcagtcacctcttactgcctgcaagggtagtggctgggtgaggtgcatggtgcactgggtcagcatgggactggagacttgtggggcacatatgggcactagttctaaagggtgtgtcatggcattgggtctgataggtgagtgcacacatgcaatgctgggcttggggtaaataagcagcattcatcctggttccagagggtgtggctgaggctctagctttggagggggtgcagcagtgtgagttctgggcagctccatcggctggtgtcagcattcttgaagactgtgggggtccttggcagttaaggctgtgggtatttgtggcagtggggatggctgctagagtcctgagtggcacaggttgcatgggttttcctgctctccttttcaccttgtgaggaagtcacagctgatggtattcctcttgtctttgagctttgccagcctggggaatggggttacacaggtaaaatgctttctacacttttctgcatgaccatcctcagtttttctgtttcactgagttgcagcagctttttaattgcactccagaactctcccagagctattttcatctgtggataattgctaaattgttgtttttgtggatatataaggactggtacatcctagtctgctctcttgctgtgttagtcctcttgctcaatcttattagaagtttatcagtcttaatcttgtcaaagaaccaaattttggctttgttaatttttctagtctttgtttcatgattttattaattttccattttaaaattctgtcttttcttctacttacattggttttaatttactcttctttttttaaccctcataaattataaacttggattatttattaatttttttcttttccattcatttaaaactacagtatttgctgtaagactgttttagctgtgttctatatatttttgtattctattttcataatcatttaatttaaaatattttaacgtttaaaattatttttttcttttacccatgggttattcttcaaagtgggtattttaatttccgaatatttaggaattatgtcgattttttcttgttattgatttcactgtggttataaaatatatctgtaagattttaatattttgtaatgtattatattatggctgagtatgtaatatatctttgcgaacattttatttacacctaaaaacgtgtattctttaattggtgaatgtcattttgttgggttaatttaatttggtcaaggtggttgatggtggtgttgaggttttttatattattactgaattttgtttaatagttttatcagttactgagaaaaggtttttaaaatatccaactatgattattgatgtttatttttctttaactcagcttttgcttctgttcatatgttttgaagctcaaaattaggtgcatacttatttatagttgttatatatgcttgatgcaatcagtaactcatgtaattatgaaatgtacctctttatactcacctatttttgtcttatattagtatgaccacttgtggaaggctgaataatgtctctccccacctcaaatatgttaacaccctaatcccttcagcctataattatgttaccttatatgacagatactttgtagataggattaagctaataatcttgagatggagagatcatgctggtttgttcacgtgggttcaaggtaattatgagagtccttataagagggaagcagtagagtcaaagtcagaaaacagagttgtaacaataaaagcagaggttggaattatatacttcaaaggtggcagaagaatccacaagccaagaaatttgaaatttggcaaaactgatttccttctggaggctttagaggagaacatttccttgactttcccagaaggaaatcagttctgccaaaaccttgattttggacttctgacctacaaaactttaagaaaataaatatatgttatgttaagtcactaagtttgtgttaggttatgtgttacagcagtgataagaaactaacacaccactccaggtgcttactgtaatgtgtatattggtttgcacattgtatatatttgtatacctttcttttaatctgtcattatatttaaagtgcatatcttacagccagaacagacaatatcttttttttttttttttttgagatggagtttcattcttgttgtccaggctggagtgcaatggtgcgatcttggctcactgcaacctccaccttttgggttcaagcaattctcctgcctcagcctcccaaacagctgggattacaggcacctgccaccacgcctggctattttttgtatttttagtagagatagcgtttcaccatgttggccaggctggccttgaactcatgacctcaggtgatttgcccgcctcagcctcccaaagttctgggattacaggtgtgagccaccatgcctagccagaacagacaatatctttttggttcttgctttttcttctagtcttacaatttgtgccatttatttggtgcagcagtccatttatgatgaattcaattattgataagactggctttatcattttgctgttttttaaaatgatttgccttatctgttttactttctgttttttttaaagaaattaagatgggaaaagaaaataaatataattctttatatgtacttatatatttaccatttctgttgctcttcaatgttttctgtatatctatgtttttatctagtgatacttattttctaagaacttcttttagcatttcttgtagtgctggactgctcatgacaaatttgctattttctctgctctgaaaatatttttacttcctcttcatttctattggatactttttctggatatagaattctgtattggcagtcttaccattttaccttttttttttttttttttttttgagacagagtttcgctcttgttgcccaggctggagtgtaatggtgcaatctcagctcactgcaacctcggcctcctgggttcaagcgattctcctgcttcagcctccagagtacctgagattacaggcgcctgccaccacacctagctaatttttgtatttttagtagagacggggtttcaccatgttggccaggctggtctcgaactggtgagctcaggtgatccatgtgccttggtctcctaaagtgatgggattacagccgtgaaccgccgtgcctggcccattttaccattttaaagatgacatctcattgcttttctccttttttgtttctgwtgagaatttagctatcattcatgtgttgtttcccattattaatgtgttatttattttcctctggctgttttcagtattttctttttatctttggtttttattagttttagattatgttcttaggagtgattttccttctgtttatcttgatgcggattcagtgagtttcttatacctgtaggttgtatcccaaatttggggaatatttgatcattactttttcaaattcctttccgatttcattatatgtcccctttattttgggggactwcagtttcacttttgttatactatttggcattgttcataggtcactgaggttctgttcatttttttctcccattttttccctctattcttcatattggattatttttagcaatctgtcttcatgtttactgacctttttatctgccctcttctatttgctattaatctcattcagctattattattattattattgagatggagtctcgctctgtcacctaggctggagtgccgtagtgcaatctcagttcactgcaacctctgcctcctgggttcaagtgattctcctgcctcagcctcctgagcagctgggactataggcatgtgccgccaggccaggctaatgttttatatttttagtagagacagggtttcaccatgttggccaggctaatattttatgtttttagtagagacagggtttcaccatgttggccaggctggtcttgaactcctgacctcaaattatccacckgcccccgcctcccaaaatgctggattacagctgtgagccaccgtgcctggccctcattcagttatttttaaaaattatgaatgctgttctgttctggaatagtcacttgattctttttggtagtttctacttctctgagattcttcaaatttttattcattatgactatattttcttctaaktctttgaacrtatttatgcagatattaaagtccttgtttgctagttccagcatctatgttacataagtttcttttctacttactgacttttctttgatccatggcccatatattcttatttctttggattctaataatattttattgtatgctagatattaaatgtgatgcattatggctaatctgtgttatgtatcctcttttttgaagaaaagttttattggggaataatttcagatttacagaaatgtttttaagatagcacagaacatttctttatacctttcaccccatttcccctaatgttagcatcttaaaaaatcatggcacatttctcaaatgtaagaaatgaatattgctacattgtttgaattttaccagttttccactaatgctctttttgctgttccaagatccaatccaggataccacattacatctagttgttatatttattgttttcctctggtctatgacagtttctcagtgttttttttttttcgtgaacttgatatattttaagagtattggtcagatatttagtagagtaccactcaatttagaattatctgattttttttttgcatgtttacattggatgtgtaggggaaaactttcttcagctgtgtttttcttctgctttcacaccagcactaccacaattatcaacacagaagaagacttgtgtgaccaaatgtggtaggggtgttccccacataccaattagcagacaccaactgggtatcctctaattcaattccgacattatctacctggagatagtgttagatcttacatttcagggattcaatatgcaagatcaccccctacacccacagacaccagtcacaagtctgggcctctggaacatctgaccaataagcttcaagttgggatttccacarcttcccctttgagttcagttaatttgctggagcagctcacagaactcagggaaacccttatgtttatcagtttattataaagtatattacaaaagatacagatgaagagaactgtagggcagggtatggggaaaggggtgtggagcttccatgccctytctgggaaggctgctctccaggaatctccacaggttcagtcatctggaagcattctgacacagttctcttgggtttttatggaagcttcaggacatcagcattcttgctgctgaccccctccccttgtcaccccagtaaagggcaggaccctctctggggaaggttttaagacccacaatcagaaaggyaggggaaaattagagtcctgccttgaggcagatgaaaggagggcagaagaaggccagaggccttccccttggggcctgacacactcaacattataagaaaggactgtaacagggaccataggagttaggagccagaaactgtggatgaaaaccaatatatacatatgtataataccaccctggggttatggattttggggaacaaaccttactggttaggtgcttttatcattgcatcatattagggggtacatgatatcaacaagactcatcactggtggttcacgcagtgaaccctgttcatgtggttgaggtggtatttgccaagattctttaatgaatagttactatttccttttatccatartgtactctttggaagtgagtctcttatccctgactaccctcaaagggaggagagttaaattccacatcctgaatggggagtatctacatatattatttggtattttctgtaagcaagatttgtcacttctcacctatttatttatttaaatcagtatggatttatatagtttttccccttgtgttataattcaacactgtcatttattttgttgttcatattgttccattgggagcttttccaggttggtttctgtgtcctgatatgctcccatctttttttttttaacttgcttattttttaacattaaaagactggaagatcctccaagcttattttgtactttccctgtcctggccctagaattagccatttcttcaaagarcccctgattcctatgttgccttctgatgtggtttggatctgcatccccacccaaatctgacrttgaattgtaatctccagtgttggagatggggcctggtgggaggtgattggatcacgcggatggtttttcatgaatggtttagtaccatacccctagagctgttctcctgatagagttcctcacaagacctggttgtttaaaagtgtgtaacacctccccgcgtctctcttgctcctgctctggccatgtaagacatttccctttgccttccaccatgactaagtttcctgaggcctgcccagaagcagatgccactatgcttcctgtacatcttgcagaactgtgagccaattaaacctcttttctttatcaattatttggcctcaggtatttctttatagcagtgcaagaatggactaatacaccttcctttttttaaaaaatgatcttaattattttaaagcatacaattcagtagtgttaagtattattatggactgaatgtttgtctcccccagattcacatattgaagccctaatcctcagtgtgactgtatttggagatggagtgtttaaggaagtaattaaggttaaatcaggtyacaagggtggggccctgatctgataggattaatgttcttgtaagaagagagaccagagccctctctctttcttcccttgtgcacacactgaggaaaagccacttgaggatatagtgagaagtctgcaacccacaggggaagcactctccaaacaccaactctgctggcatcttgatcttagactttcagtctgtggaatgatgaaaatataaataaatttctgttgtttaagtcacctagtctatggtattttgttgtgatagtccaagcaagtgaatacaagaatattcacattgttgtgtaccgtatctccagaacttaatcacactgcaaaactgaaaccctgtacccattaagcaacttccttttctttttccctccaaacttctttcagtaaccattcttctttctttgtctatgggtttgactactttagattcctcatataagtggaatcacacagtatttgtcattttgtgatcagttcatttcacttagtataatgttttcaaggttcatcagtgttataaagtatgacaggatttcctttctaagactaatattccattgtatgtgtagaccacattttgtttgttttgccttcatattaagggcgtgaaaatttgttctcagaggcagctaaactattgatgactctttttggcaatgttaagttttgctctgtttttggttggtgctactaagcaatgcatcacctctgtcctttctgttcagctcttggccctgcaggaactatctcagcttggacttgcagagttttgtcctatgtctgcgcagcctagaacttggccacagacatacagtgaattcctacagtcttaagggtgcctctctcttgtgaattatcctgccctgcaaattccagccatttaagcagctcaaaactccaatatctgcctcctcattttagtaagactgctgttctgtttaggattcatttttgtgctctgtactagaamgtggtcctagatagaaagctagggtgatcattgcactcacctttgtattctctcaaggatcacaatgctgcctgtgtgttcctgaaaatagctgccttgtgtgtcttgccatgtgttgtattttgattggagagtaagtctaatgccattctgtcatggctggaagcagaaatatatttgtttttattaatataaaacaaattaatataaagcactccctgtttctcttcttttatccttatgcagtctatcttgatgatcttatccactcttaagagtttcaatactctttctgtttccttactttaacttttgttttttttagacggagtttcactcttgttgcccaggctagatagagtacaatggtgcagtctcggctcgctgcaacctccgcctcccggtttcaagccattctcctgcctcagcctcctgagcagctgagattacagcccccaccaccacacccagctaatttttttgtatttttagtagagacggggtttcaccatgttggccaggctggtcttgaattcctgacctcaggtgatccaccctccttggcctcccaaagtgctgggattacaggcgtgagccaccacacctggcctactctaactttttattaacttttcacctactaaaaacaaattactaagatgttagaatgtatttgtttactttgctcttctttttagttatctttgcatgaagtataatmataaaaaaaataagacaacaaagagaaaaaatataatggaatttctgatactgtgaagggtaaagaccatcacacaatttggacaaggttttggggaagatgtggtcatgtcatattcacaaaatatatctgggtaatagtctatttctcccgtgattccaggcatatgcacccaacagtccatttcgttattgcttatcactgcccaaaagttccaagaaatgatgaagtcagtctcatttggcatacatctactttttcagaaggaaacaaagcagagaaaaaattcyragagaaattcatagctagtaaccactctcacttttattttagtttccataactgaaattgctggacttgagagcaatttttccttgctcaacagaattaggtgagatggggaatcaatttaatatatatttagtgagcatctacagtgtcatggggcaaaaaaatagcaacttacaatattaatttctataggcagcccccaaatttgaatcatttcctgaaaaattacttctgcttttgtgaagtttcctgctagcagtttagagattgggctgtttcctcactgatacatatcccttcacacttctataatttaactctctcaactgcatgtgaaagatcttagctgaagatgactgacagtgttatttattccatgttagagttgcctacrgcaacccaagcccagaatgactayggaccacagcaaaaatgtgagttaaccaaggtagcatggaagacgatgcatagcarcagtaggctatggatgaatggggagtagaataagtttaaagcagagggtgcagaagaattgaggataatttgaggaaatacttttggttcagtttaaagtccagagttggaatatgaaaagttggtgtatggtacaggatctgatcttaggtctcaggtaaactcttttctaactgttcacttctttgatcgcatcttagaaacccaacttagggcattgccgttattccttcttgctcttagctaaagcgggaactttgttgggagaattttatctctttagttatattcggagtaaccttggaccagctgtttaaattctaggtatggctgtttttctgactatggaatgaggaggacaccaatagttttgctggtggatacgagtaagatttttgtcaggaaagaaactgatttacatatctagttttgttttttttttttaacttcacagtgttgcactagaatggtgacagggaagaaaaagtatcaagaaactacagataatagtctctgtgactgaggatttgaaggcaaaagagccatttttacatagagccctgagagaatattatctgagacagacaggtaatagtgtaaatgccaaaattaatccttgattttgtatcgtaggcagtgaactcccacaaggtgtattctttagggtagttccctaagctttctctctttttactacatagttttactattataatttttaatgtcttttgagagtgttgccttaatttgctaaatcattctagtatacttgggatatttagacctatttctattaccataaattatatagcattggatatctttatttgtgtaaccttttcctatttttgaattgtatctatgttaatttctaaggaatagaaatattacgttagaagtaatgcatatctcaaagtatatgttcaaggtcacacacacaactggtgataaattggaacctagttggaactatttagaggctttcaatatatacttaaagtaaattttaaaaatttactttacttcttgaattggcttgtggttacacaaattcaattatggtttgatacctttttaaaatttagcataacataaaaatgaacatttgtgtatttcattaaatgttctcctgtgatgcaaatgtatttttaaaagtttttctagaaatcttaatgcttttggattcatcagtccaaatatttattatgcagaattctctatttatgaaggcatctctcattatgaatttttttctttaagaagttcagaatactccatagatacacacatatatagaataatttatctaaaatttaatcagaaaattgaagcccaaataggcaagtttaatttcctaattaaatgttattaagcaaaggaatcaaaattagaagttaaatatcatcttacttcacagagttttgctcgttacacgtaatttctacactattgcactatgagatacctttgattttaaaataaagatttgctgaaaatacttccatttttcaaatttaaaatttagatttcggttgtatgcaacagctaacatgaagtagtgtcctattcttaaacttggcatcaacttaaacttactgctcttttaataacgacagtttacaaagcacttctgaaatgtagattatttttatttaaattttatgtatttcaatttcgagtagataatrtgtttacatggttcaaaattcaaaaggtacaaaagaaaatagggtaaaaagtctttttcctattttgtctccagtgactgttttttccattccagaggcaaacaatgttatcagattcttgagtgtgcttgcagagatatttgtatatcctgttctgcagaatgtttctttgtcttgactatatatcttacaaaatattccatatcagttaaaaaaaaaagccagtttttattagaagctatatattcactttatggatatatcaaaaatgtatttgactggccttttactgatagaatgtagattgtattcagtcttctcctcctacaaatattgctgccacgaataaatatgacattttgcacccgcgagtatctgtaggagaaatttctaggtcaaagggtacatgcctttgccgttttggtagatattgcccaattgtcctccaaagaggtaccaatttgtattctcaccacctaagtatgagacagtgtaagtcacagtttcaaaggaaaaaagcattctttatcttgataaatatagtaagttctttgatacaggtgttggtggttaccttagactttagagcaagttcctgacacatctagaaaaggaatctttatggcctggatctcagttcccactaggccaaattrctttaagatgcgatatccttccctgactttctcttttctttcaacctgtcatctgactcaggattgtgctttgactctgttgttgcagcttcctcttccaggccttcttgttcttgccttgtggcaatagctttggggcttctgactgcagttcttctgagtgtgctgctataccagtggatcctgtgccagggtaagtgcaaacttaaaccaaaattaatctttcattttatattataaaagcaatataacatagcagaagctttgaaaaatcaaaaaataattcaaacaaaataactctccatctgtatacagctatttcctgggtatagcctttgaccaygtgcacttgtgtaagcttgtattttcttttttctttttgttttttgagacagggtctccctcaatcagccaggctgtaggtgatagatttgtgtgctgctataccagcggatcctgtgccactgtacagtcacagctcactgcagccttgacctccttaggctcaagtgatccacctcagcctctcgagtagctgggaccacaggcacataccaccatgcctggctaatttttgtattattattattattwttttttttttgtaaagacatttcaccatgttgcccaggctgatctcaaactcctgggctcaagccatttgcccttcttggcctcccaaagtgctgggattataggtgtgagccactgcacctgaccatattttcttaatagaactgcagtcaagtcctcttaaaatttctcccacctttctttcttttaatgcaaggctgagaatagttcttatcgtagtatgctcataattttgtatattgctttttaattttatgttgccagaaacatttccttactgccatatttattgggatgattgaattataatattaatgatgtttaacttttcacataatagatatatcataatgtaatgaaacattctgaatttttttttttttttttgccattcaggtgctttcacattttctaaaactaatttttaagtttagttcttctaggaccttaaatctggtgatctagaggactctcagtttgttgttttacagtctagagtcctagcttaggtttatatttttaggggatgatagtgaccgattacacagaagtgatttattagggttcttttttaaatttttttaaaaattttgagacagaatctcgcaatgttgtttgggctggagtgcaatggcgtgatctcggctcactgcaacctctgcctcccaggttcaagcgattctcatgcctcagcctcccgagtagctgggattacaggcacctgccaccacgcccagctaattttttgtatttttattagagacggggtttcactatgttggccaggctggtctcgaactcctgaccttgtgatctgcccgccttggcctccccaagtgctgggattacaggtgtgagccattgcgctctgccgatttattaggattctaagagttcagctccagggcttctacctcagagccaagtccgacctttgacaaaaaggaactcctagggaagttgggaatttctaatccaggctgagtaatgtcacagttgtatggaaaaagcaaaatctataaggtgccaatttaacagcttgatctccagaacttatattggttgtatgccagtacttcctagagaacaattatctaatatttatatgaaaaatactactttccccactttgtaactcccaaatctagagtagatatatactctattctgcaattatatatctacacatgtgctcatggagtataatggctcatacttgctcactgtagaattgtgcttatggcgagtttatgcacatatgtttaagtattgaaactgaagtagaaaaatcaatagaattttggaatcttggttggaattaccttgaaagcatattcagttccctttcatctttgattgtttgtttttgagacagtgtcttgctctgtcgcccaggcaggagtgcagtggtgtgatcttggctcactgcaacctctgcctcctgggttcaagtgattctcatgcctcagctcctaagtagctgggattacaggcgggtgccaccatgcccagctgatttttttgtatttttagtagagatgaggtttcaccatgttggctagactgatcttgaactcctggcctcatgtgagccacctgcctcggcctcccaaagtgctgggattacaagagtgagccaccatgcctggtcagttccctttcatcttgacagaactatgaaccaaccattttaaaggaatgtggatcttccgtatttaaaagagctcggttagggcattctatcacttttcactttagcacctgttatgcttctctgccagaaaacccttttgaaaaatatcaaagtaagttctttttgctgaggtataagggtttttttccagttttcaatggtgagggacagttacatctgtgataataaaaaagcaaaacctttcattctagttaagtttgcttttcctaatttctttttggcattttcagttgggcattctgaatgattctgcctgatttaagcaatatacattatgcaattatgcaatatatacacagagcaaagacagtacacagatgcatatcatatgaattcacagttatctggtgtgtgtatattacatgtgcacagagatctctagcacaagtcaagtacttgctccagagttttcaggcagattgttgtatgctttcttctttgttccttcagttatagtcatattcttgtgtagtggaatatatacttagtagatgatggagttggacattatgaggacattatgaggtattcaaattgacaccacrcattgttacacatttctctaacccttaatctgaaaagtggtggagcagggaagacccagggctgccatattccattttatctcccatttcatttccaagactgagtggtccataaagatgtgaaccaggtcctcttctctcctaggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatggtaaatgcaaacatttagaaaatgtagggtttttgttttgtttttgtttttgtttttaaactgctatttaaatgtatcatgtatcctcttttaaggaacagaaggaatctgtgatttgggggggatactatattcttccccttccctcttcttctctttcctcttctacttctgccttcttccctctccctccccactctttacccttatgctgtctgacccaacaaacctcagttacagcaacccagatgcttgtatagcatgtaagtgtgtatgtggggcaaggaggcagaaggatggtgagtgttttggagaggaatgagacctgaaatacaggtctagttaaaagaagtcttaggtccggaaacctacaggtccaacaacaaggcagcagattctttttttttttttttgacagagtctccctctgtcatccaggctggagcacagtggtgtgatcttggctcactccaacctccgcctcccaggttcaagcgcttctcctgcctcagcctcccaagtagctggaactacaggcgtgtgccaccatgcctggctaattttttgtatttttagtagagatgggatttcaccatgttagccaggatggccttgatctcctgaccttgtgatctgcccgcctcggcctcccaaagtgctgggattacaggcatgagccaccgtgccagtccttatatagtggaacttgggagggagggaaagatagagatcacggggacagagtgattgtggcaagggcttaaatgccttcttttaaaaagttttcccttaattcactggaatccaataagttccagactgcaatgttgagaaagttgggatataaggaagaaaacaygcgtgcacgtgcatgtgtgtgtgtgtgtggtggcctccacttccttcaggcccctcagatccttcctatccacccagcaatctcttggaaaagagcttgctattggtcctagaccatctcaaggcaatacaaggaactgacatcctgaggttgcctagtataaaaatcaatcaaattctaatttgtcaacataaataacatctataaggaaaacaagaaatcttagttttgtgttagtgctaatttgatactgatttttgtgttttgctattgttttctgttttcttttattgggtaggatctagtcacagagaacaatttattgagaattaaactatattaacttaccttgggaaaaatccagaggttactctaaagcagtgggggagaacatatagttcctaaattttatagctacctatataactacctatataaagcatacagattcttgttttctgccaaaggaacacttactcctttggaattccacatagaatctaaactctaaatcattccacatttgtgactaacttttttttttaaagccttctctaagtgaggtggcagaatgcattgagttgtattaattaaacatgagttcttagttttatggcctccagcaatatagccttgctttctggaccttgttgtagcaactcctattctcattctgatatagtgactctcaggatttgagctgactaaagtcagtagcagaagtgagccatgaacttgaaacattgagggcaaaactgataaacaggagtygtgagtcatagcacaagacactgccacagaaaattgtggtgtagcagctgctataaatttcacagtgtgatcatgagaggtgaggagggaaaggatgaagggcacagaatatctgggaaaatggcaatatttctgtttctctgaggaacccagaggaagggcaggatcattagagggattttgtccttcctctgcttcctgacatgcccccattccttagactattgttgagtaaaaccagcagagttacattcactgcatttccaaattgagtttattttctcctaaggctccttggggccaagtcagtgctggagagggcggaatgtccctgctagatgtcataagttttacttttaacattcctgtggaatcttacttgattctctggtttaattctttttcttgctccggcttttgtcagattctgtagaaccaaattgattttacgtgccctgctgcgtctgttgttctagtgttattattcttttgttctcagggcaagatttacatactattttgaggtatgtacaatgtttctagtatcatactggggtctgagccactaccaaaaaagcaagaagtaaaaataaaaaagagagctctatggatctattaaaactgaagtttttcaaactgacattccattggtggagagtgctgctagagaattttgttgctatatgtagaatctacaggcctatggaaaatatccctcttatgctgttaaacggtcatctttcagtgagatgcttacgtagagttcacctcctatcttagatcacttacggcaaagtgtacaataataacagaggctaccatggattgagcacttgctttttgccagatgttttatgtatagtattctttttttttttctttttgagatggagttttgctcttgttgcccaggctgaagtgcagtggcacaatctcggctcactgcaacctctgcctccagggttccagcaattctcctgccttagcctcccaagtaactggggttacaggcgcctgcctccacgcccgacctttatgtatagtattcttaatcgtcacagcaattctaaaaagtagagttcaacatccccattttgttggtgaatgaataaaattcagaggaattggctgggcatagtggctcctgcctgtaatcccagcacttttgagaggctgaggtgggtggatcacttgaggtcaggcgttcgagaccagcctggctaacatggtgaaaccccatctctgctaaaaatacaaaaattagctaggcgtgctgttatgcacctgtaatcccagcttcttgggaggctaaggcacccgaatcgtttgaacccaggaggtggaggctgcagtgagctgagactgcaccactgcactctagcttaggcagcagagtgagacactgtctcaaaaaaaaaaattcggagaattaatgagtgtaagtctaaggctacaaatctggcagagccaaattttaaattctactccagtgggcatggtggctcacacctgtaatcctagcactttgcgaggccatggcaggtggattgcttgaacccagaattcaagaccagcctgggcaacatggcaagaccctgcctctacaaaaaaatacagaaattagctgggtgtggtggcgcacacctgtggtcccagctactcgggaggctgaggtgagagaatcccctgaacccaggaagtagaggctgcagttagccgtgatcacaccactgcactccagcctgggcaacagagcgagactctgtctcaaaaaaaaaaaaaaatccacatcaactcaccttcaaagtcacttatagaaatatcgtatttgacagcttccagaatccattttgcatatgttcaacaagacaactttttctactaattgtcttctggtttcttttctatacatatttaaaaatttttttgaattgacatacagaatgtacrttgtatgaccgtggatatttaaatttatttattgtgatgaggtctcactatgttgcccaggctggtcttgaactcctgggctcaagtgatcctctcgccttggtctcccaaagtgctgggattataggcttaaatatatttaaaatagtgagatgctttcttattatctcttttttttttctatctgggacttcaagattattcttgatagagaaaataaaatggaaattaaatttctctgttattttctcatttttgtgttaacattatggcatcagcccttgcttcttcttgccctatgagtatatctttagatgtttggatatattcaaattcttgatttttcttgccatttttcccccaccaagctcagttcatcctggatgttgttagcctggttccttatagttattggtatgttattttaaagtatgcattcgttagtgagttcccagtgaaactgctttgatttctttaaatctattctgatgctccttgccctataatatctctcttcctcattatcataatttggaattatatgatccaactttactcttgcaacaacctctcattcaactttacctatcttcctgaccttgggattccccgagcttttgatgtcggcttctcacatatttaggatttacatctaataatatccaaagtttccttctttgggtgcagcaawgcaaacactatggtaacatggtcacttttctgtatatttttaatcaggtaatgaaaacagcttggtttctttcagacagtcatgagtgtgcttttactatatttcttactagctatgcgaacttcaacaactttcttaacctttttgactctcagtttcctcatgtacaaagtgaagataaaactttctagactgtccgggcgtggtggctcacgcctgtaatcccagcactttgggaggccgagatgggtgaatgatttgaggtcagaagttcaagacctggccaacatagtgaaacctcatctatactaaaaatacaaaaattagctgggtgtggtggcacgtttctgtaatcccagctactcaggaggctgaggcaggagaatcacttgagccccggaggcagaggtcgcagtgagccgagatcaggccactgcactccagcctgagagacagagtgatactctgtctcaaaaacacaaaaaactcaaaaaacaatataaagcccagagccaaaaataacttttactttgctcttctgtgtcccaagacatacaatttcagtaaaatatgcatcacagagtaaattatgacttgttgaattgagtatattgtttatgaggaaatctgagatgacatgtcagaagattcaaagaaatggctggaaacacagcatagatggtaggggaattgctttactctggaggtcttcacagtctggtaatgtgcatcttttgtcacgcttctttataatcagattaagcagctagtgtcaactgcataacaagggatgggcatgataagctaggatatttccactattttttaacttaaaaaattgtgggaaaatatgcatagcataaaatgtactattttaaccattttcaagtgtacaattgagtggcattaagtacattcacattgttgtacaaccatcactaccatcatctccagaactttttcatcatycccarttgaagctctgtacctcttaaacaataactcccctccctctagcccctggtaatcactattctacttaccatatctatgtatttgcctattctgtcctttagtgtctcacttattcacttagaayactgttttcaaggttcttccgtgttgtagcatgtatcaaagttatggctgaataacattctattatatggatatactacattttgtttgtccatttattcatcagtggatacctgggatgcttcaaccttttgactgttgagagtaaggctgctgtgaayttggatatccatctattgacagacactgtttccacaagcttttaaaaagtggagcaaatgatggtttacggagcagggcttactgacttttagcattgtgtacttacacaaaattatagggaaaattcttattgatattaasctctagtaatttgtaacctgtcagattttcctttgaaatttcttaacgttatttgcatgtttttagatgatggtaattaatgtgttcatattataggatatctgaaaagtctggaaacaggctaaacttatttttaaacagtatgttggttacattttcaagtaatatgctctatatttttactcaatcttgagacatgttttcaagtgaaacatctctaaatttaaagcaatagatataattatttttagaccttatgagtactctgtattgtaaatttttttcaaattagtaattacatcctttgctttaaatacttcacctgaaaaagtgtctgaagaaaaacatattaatgatattattttaaaatatragactgtagggttccccagtgcctggctttctttctgtgtattggctgaaaatcgcagagggccttgaccgctctgtgacccgcccagctacaggtttttcccctgcaggctctacccaaaccccagccttgaacatttccagtcactgataaaggtatctaggttgctgctcaaaacactgaaataaactagccccagccctaagtcagattccttaaaccctcataaaatctccatctctgaccccctggccgtggacatatgtaggtcaaatgctccttttctctggctgtccatcgtgagtgttgctgcagccctctgtaacttcccctaatagatgctttgcacagatcaccttgacatttagtgctttattctatggtatcccaaccaaccccatctcatgatgatttggggtcctcccttgtgggaattcccctgtcgctgcttttgggatgatttcagccatgggtttggtgggacaaaacagagatatactgcctaaaaatacatttatcctatgtttttaggtgttttggaacccattattttgtattctgcttttatcaaatagcattatttcattcttggtttttgctaagcattaaattattccaggtaataaaaagttgcaaccagattttattttattttttatttagttttaaatattatttttatacgtcttgcatcattccactattgcttaaatcttttcatattcttagataaaattctccttgttttcaattgtcatgagctgtgagcatatttatagaaatcattttgcttgcagttatttatttacattatattccctaaaattaagttggctaatcaaaagataagattttatagttttgatgtattattagtttttcttaatatgggttgaaataacttacatacattctgtaaaccattttaatttggaagtttaaggggtatgctttgtgccttaatgatattttaatttcaattaaaaatactacatacagaagtgtatgtggaaggtataaatgttgaactaaaaaagcaaaaaaggaaaagaaaagaaaaagtgcccttgattttatttgtttgggttttatcttcactttgcttttagggtttgcattttttctaaaatataagcaaacattacaaactctaagtgacataacacctaagtgttctagctcacaccctctctgggtgacaagagttctcagttaccacctttacctatacttttgttgttgttgttgttgttgttgtttgagactctcacccaggctggagtgcaatggcacaatctcatctcactgcaacctccacctcctaggctcaaatgaccctcctgtctcagcctcctaagtagctgggactacaggcatgtgccaccatgcccagctaattttcatattttttgtattaatggagttttgccatgttgcccaggctggtctcgaactcctgggctcaagagattttcctgccttggcctctcaaagtgctggaagtacagatgtgagccactgcaccagaccgatttgtactttcatgctgcttctatattctctctctttctaatacacacacacacacacacacacacacacacacacattatccatgagtacatagaatataaggttattgtactatggttttgaaggcctcttccaagtgggaagattttcgagtgaaagtgccataataaacattttcaatatccagcctcaccaatgagaagttgtaagaggactgactgatcaagtgatttagaattatatgggtcttgagggtagtaaatgagcacaggattggggtttgtacgtgggcattacctaatcctagctctgcagattctaactgaaatttctgagcaaatctttatcaatttctgtgcttcattagctgccgttcctcctcttgaaatgaaagaaaaagaaatggactgtttttctcattatcagtggagaaatggggaatcactctttttttccttttgttaattttatttattttttcaaatatttagcttacaatttttgatttgaatatactcaaattttatatactttgaatgcagtaacatttatttttgaatcttttagatcatggctatcattcacaccaattttgtgaaaatattaaaaaaaatccattctttttttcctaatttaaataattctttaaacaagttggttaagaaatgcaaaaattttaagctatcttgaaaattacagtgtcatttcatctgtcgtatacttcattcactctccggtctaccttcttacccccagcatgcacagttaagtgctccacagagagaaagtaaaaaatacagagtttgtgttcagagggttttttttttctttttcttttttattattattatactttaagttttagggtacatgttcacaatgtgcaggttagttacatatgtatacatgtgccatgctggcgtgctgcacccattaactcgttatttagcattaggtatatctcctaatgctatccctccccccttcccccaccccacaactgtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacacacgtgtgcatgtgtctttatagcagcatgatttatagtcctttgggaatatacccagtaatgggatggcagggtcaaatggtatttctagttctagatccctgaggaatggccacactgacttccacaatggttgaactagtttacagtcccaccaacagtgtaaaagtgttcctatttctccacatcctctccagcacctgttgtttcctgactttttaatgattgccatgtgttcagagagttttaacttcttgcagcataatacctaattgtgtgttctttatttctatagatacttattaaacataattttttaaaaaagagatgggatcttgctctgttacccaggctggagagcaatggcatgatcacagctcactttagcctcaaactcctgggctcaaatgatcctcctccctgcctctgcctcccaagtacatgtcaccaagtacaagcacatgccaccatgcctggttggctacattttttacttttcgtaaagatagagtgttactatgttgtccaggctggtcctgaactcctggcctcaagtaatcctctcaccttggcctcccaaattgctgatattacaggcaggagccactgtgcctggtctgcatttattgagtataattttatatatttttctaggtgctagggatatggtagtcgagttgttgctattataatgtttacattttatttattatttttaaggaaaatgatattttaaatttagttttgttattaacatttttttaaattggcacataataattatatatatagggtatttatccgaaggaaataaaatcagtatgttgaagagatatgttcactctcatatgtattgtagcaatattgacaatagccaagatatgaaatcaaccaaaatgttcaacaacaaataaatggataaatgaaactaacacaagaacagaaaaccaaacaccgcatgttctcacttataagtaggagttgaacaatgagaacacatggacacagggaggggaacatcacacaccgggcctgtcggggggtggggggcaaggggagggatagcactaagagaaatacctaatgtaggtgactagttgatgggtgcagtaatccaccatggcacgtgtatacctatgtaacaaaactgcacattctgcacatgtgccccagaacttaaagtataataataaaaaatgaaataaagaaaatgtgtatgtatacaccatagaatactaatcagccatggaaaataaagaaatcctgtcattcatagcagaatggatggaactagaggacactgtgttaagtgaaataaaccaggaacagaaagttaaacactgcatgttctcgcttatgtgaaaactaaaaaaaatgttgacctcagaacagacgatacaagaagctgagaatggctggggatggggaggttagggagagttatgttaaaggatacaaaattacagctagataggcagaataagttctaatgttctatagcaatggtctccaagatgtttagcaccaggcaccagtttcgtggaagacaatttttcyatggaccgttgctgggggctggtttcaggatgaaactgttccacctcagatcatcaggcattagttagattttcttaaggagcaggcaacctagatccctcacatgtgcagttcacgatagtgtttgtactcctatgagaatccaatgccaccgctgatctgctgatctgacaggggtcagaactcaggcggtaatgctggcccgcctagccgctcacctcctgctgtgcagcccagttcctaataggccacagaccagcaccttgcatggcctgagggttggggacccttgttctatagcactgcagggtaatctatagttaacaaccatttattgtatattttcaaatagctagaagagaggattttgaatgttcccaacacaaagaaatagtaaatgtttgaagtgataggctaattatcctgctctgatcattacacattgcatacatgttacgtgtgctttcattttcttcggaagagacagactaaataaatgaatatggtgatatgtgctttaaagaaaatgaaacagtatgatataatagtaaatgtgaatactattttagattggttagttaaggaaggcctctttggggagggaacatttgagttgatatctagacctgattgacagccatgtagaaatctcgggtaagatattccaggcagagggaaaagctatgcaaagaccttaaagcaagaatgaccttggcatgttaaaggaaaagaaagaaggctcatgtggctggaacctaggaagtgagtaaatggttagtaggggctagattgtgtaggactgtgcgtacatagtaaggattttagattttattctatgtgaaaagtgagactactggagaacattaatcaggggcacagagtgattaaaagtttagcactgggagagaaaagttggatgattatttgaaaaggagacttggatgaattctttcacccacatgaccttgtcttctcatctctaaaggtgaggataataatagttgcctaccttccaagattgtcaagaatttcataactggaaagaatcctagaaaatatctaacctaaatcctcataaagaagttgacgctcagccagattaaaccacctgcttatcttcagataggaggacagagctaggaggctccagaattttgtttctgctttgttttcctaaatgccatactgtatattcagtatttcaaatgatactgggaatgaacgcaaagggattttgcaaaccttagagtacaatacaaatgtaagagataattgttttcaggatactgggctctgagagaacaaagttatcataaggaatagattatttgggaagaaaagcactgataaacaagttgtactgatttttcaaatgctttgtctaggagccaccacagtcatgtcctgaatggaaacaggactgaaacccagtgaagagaaaatagaggttattctgaccatgagaaatagcacaaaagactccttttctctcctgtagtgtctccactagaagtgcaaagaggctttttgcctctctttattttattttgtttttttgagacagagcctcactccgtcacccaggctggagtgcagtgatgccatctcggctcactgcaatctctgcctcctgggttcaagcgattctcatgcctcagtctcccaagtagctgggattacaggtgccmgccaccatgcctaattttttatttttatttttgtttttagtagagacaggctttttgtaccacattcaccaggctggtctcaaacttctgacctcaagtgatccactagcctcggcctccctaagtgctgggatcacaggtgtgagccactgtgcctggccctcccttaactttagaagagcaactctttatttgtgctgatgcagggtccaagtaggcaaagagacarttaagagcagagcccataaatgtttactcttcagcaaccatctttcaggagtggaataaaaacaacatcaaaatgggacatctggtggtatcataatcaccataggcagttgaaattgtattgctttcttagtagtttctagataaaaaagaatattttattccaaaggtatttaaccaattaagctgtcwttagaaaatattgaaagtgtaattgttaattacaccaacactaaatcctacaacaaaattaccttggattatctttctaaccttttattttaatctattttaatctttaacattttattttatttcatttatagaggcaattctctttggatataaacttcttcatttgaatgtcagactttgcagatcaaagtcttttatctctgttctgttgggtaacgtggcacacataagtggtgtagccaatttacctttaccttaaacttgttcccttaagaactgtttttttcttgccacatacaagattgatgaggatgcggaaaatgagacctcagtggggaaaaaaacaagaatattgctataggcttaatcrtaatttatatatttaaggatgatgggaaagatgaccacttctgcagcaaaygtttagcttctttcttttgaaataatctgaatacctatcaggtgctccctttaattaaggagaaaattgcaatggaaggtagagatgtaatattatcttatttgctacattataagaatccagttattgacagaaaggtcaattcyaggatgctgctcctctctacagctaacacatctttagaattagatgttaaatgagaaattagttatttagagtgaataattgtcttagcttgggctgctctaacaaaataccatagactggatcgcttgaacaacagatgtttctctctctcagttctgaaggctggaaaatccaacatcaaggttctctggctcctggtgaggacctacttctggcttgcacatggctgcctttttgttgtatcctcacttggcaaagagagtgctttgatctcttcctcctcttataaggacactaattgcatcatggaggccccaccctcatggcctcatctacacctaattacttgctaaaggcttcaccagcagatttcatcacattaggggttaggggttcaacatattgattttaggacgcattcagtccttaagagtggtgatgatggaggctgtaaggaatgctagtttgtcttttaattaattacttaacttagtattaggaatccaatgtggaaaggaataattgtttgactgtgacactaggtcccttttttggttttcaacctctcccttagagcctgctccaagttttcctcagtgaggccttttgctggattggtctgaggaacaattctggctggaggtgggaagayggatcacctctaaacttctcaaggtaaggggcttcaaaggaatgcaaaaaaagagagagaggaaaaaggaaagccaaattatgatacttggggaatagataaagaagagcagatggagaggagaggaaagaatgaaaaggagaggaaatagggaamaaggaagggaatgaacaatgggtaagggcaaaaaaaaaaaaaaaaaggataacattttaaagagaggctgatgaacaattttaattcttctgctgtttgggggaattaggggcctgaatagggagacagaatttgcttcatttttatcccttcatgcctttcaactccttttctgtgcatgyggccttaagtgattgacttttctgatttcttacaggatttcttctaatagctttgtgcagacatgcggtgccatcaacaaaaatggtcttcaagcctcaagctgtgaagttcctttacactgggtgtgtaagaaggtcagactttgatagatgaccactctgtcctgaccctcagatctgtcatgtatccctaaaaggagggagctggccactggctgttgggaaagccatgagtatatagttagcaaatactgaactttctcagatatggcattagatgcaagacaacctcctagggattgatgcctaactgatggattctctttgagactatttagatattatgtgagcaatttaaagaccagatytaagcaaattttgaaatagatgtttgttttttgtatttctcagtatggaaactaatgctgccactctcatccccgtcccaaccatctctgtcaaaaatatacctttttcatatgatattctgagctaatctgataaaatctatgccaatatatactattgcttgtgtactagagaagtacattattgctgtactcctctgtacattactgatccctgatggtatatttctatcctaacagtgtccctttgcagatcaagctttattctgaagaataaacctagctggcatgctggtgtgtacctgtagtcctagctatttgggaagctgaggtgggagggtcgcttgagcccrggagtttgaggctgcagtgagctatgattgtgccactgtactccagcctgggagatagagcaagactccatctctaaaaaaaaaaaaaaatgctaatgtgagaatataaattgtgggaaatgagtgagggcaaggtggtacttcctcyttctgagctcttcacacgtaatgcaaaaacccggtcttaaytgattttgttttttttctgagtatgcatatatgtggttgaatgaaccaatgtgtgattgtatcttttccattatgtgactgtttgacctgcatattaatttcaagatagcagtcaattcgataaggcattttcatagaggaaagtttacagaaacagtttatrtggttggatcaccaaattatcttaggtactaaggcctcaaaaataagaaaaactttattatttctcctcagtagagtttggacatacataaggagagaaggtacagtgatgaaggagrccataattctgtagtgttgatgatcctggattataatctttttctctttatctttcatagtttttttaaaaacatggactgtatcttatctaccactatatcccaaatacctaagatagtgcttaygttcagtgactattaaataaataaatggatgaattaaaaagtaagaatgaaaactgttcattctagttatttctgttagcccataaattagaggaattgaagatgagaaaaacagtatatcctaatcctccctaactcaccaatatgagtcttcagtagctaactctacaaaggcaaagggccagttaatctggatacaatgctcatagaaggaagtcgtggaaacaagctcccatcccctagtgatctcttccctttggttctggtgcaggaagtatcccttagttatgratattttggtagtgactctcaattaaggatgtaatgatarcgattccatgtgggccatggcttggctactacagggtgcacaatttcatttacttattgaaagataagaaaaggagaactacagtcgggtcttaaattctcatctgagcaggcaggatgtgtgcagacctcctctgtgactagggttcaggccttttataaggattcatccacctattgtcagaattgggtgtagttcttcactgctttgtctcccttaaggttgttacaagagaagtaacagtttacttcctggttgcttatttattccttagacttatttakgaagggctggggtcagttagtaactcaattcttgcaccttacctagtgaaataaagtttggtaaaactagaaactaacattttttgattagcacttacattgcacagyggacttctttgatgaacattatacattaaacatatctgggacattcagtgtttggaataggacatttattaaagataataacagagcagtcacaaaattaaaatgaagaaaatccaggaacacacaggaggaggtggagcaagaacaagaagcctccactgatttttcccccgcaggaatacaaatggaacaattatccgcaaaagaaagcaccttcataagaaccaaaaatcagatgagcagtcacagtacctggttttaacatcatatcaacaaaagaggcactgacgaggacaggagagacagtcttgatttgccaatgccacccyttccccatctcccagcagcacagtgtggtgtggagagagagtctgtgctttggggaggaagagtgctgtgattatgggactttgcagtggaactcggtgcagctctgtcaaagcagatagcgacatgggacagaawtcagccmgtgcccacagagggagcatttagaccagccctagccacaggggaatggcccatcccagtggtcggaacctgagtttctgctagtcccaccactgcggctaaaacactctgggatcctaaataaacttgaaaggcaatctaggctacaaggaccacagttcctgggcaagtcctggtgctatgctaggctcagagccagtggacttggagggaatgtgacctagtgaaacaccagctgggtggccaagggagtgcttgtgtaacccctcctccgaccccaggcagtggagcttgcagctctgggagagactccttccttccacctgaggagaggagatggaagagtaaagaggactttgtcctgcaatttggatacagctcagctacagaaggatagggcaccaccacgcagagtcctaaggtccctattctgggacctagtttctggatgatattttaagacccactctggaccagaaaggaatgtgctgccttgaaaggaaggacccagtccaggcaggattcatcacctgctgactaaagagccctttggccctgaataatcagcagcagtacccaggcagtgtttgccataggtattgggtgagatccagtgccatgcggcttccagtgtgacccagcacattgttagctatggtagccatggggagagacttcttctgcttgaggaaattagagggagtttggacatagataaggagagatttaacccaagactaatggggactctgtcttgcagcttaggtattagcttggctacagtggggtagagcaccaagtaagcacctggggtccttgattccaggctcctggacagcatttctggacctgccctgagtcagaggggagggagcccattgccctgaaggtagagacccaggcctggcagcattcaccataagcttactgaagagtccttgggccttgagggaacattagtgatagccaggtagtggttaccacaagccttgggcgagacccagtgctatgctggcttcaggtctgacctagtgcactccaagttgtggtggccactagggtacttgtgtcactattccccaagctccagatagctcagtatggagagagagactccatttctttggggaaaagtaacagaagataacaagaggctctgcctggtaatctagtaaattctcctgtatcatacccaagaccaccaaggtggtacttctataagtctgcaagagtcacagtgttactgggtttgtggtgcttcctaatgcagatatagctgcagtggccaaagacttagatcataacactcaattccctttgaatgcttggagagttttcccaagaaggatgggtacaaacaaacccagactgcaaagactataataaaaacctaactctttaatgaccagacacaaataaacatccacaagcatcaagaccatcgaggaaaacatgacctcaccaaatgaactaaataaggcaccaatgaccaatgccagaatgcagagatatgaccattcagacagagaatgtgaaatagctgtttagaggaagctcaatgaaattcaaggtaactgtgttagtccgttttcatccttctgataaagacatacctgagactgggcaatttactaaaaaaaaagaggtttagtggactcacagttccatgtggccggagaggcctcacaattatggtagaaggtgaaaggcacatctcacgtggcagcagacaagagaagagaacttgtgcagggaaactccccttcataagaccatcagatctcatgagacttattcactataatgagaatagcatgggaaagacccacccccatgattcaattacctcccaccaggtacctcccaccaggtccctcccacaacatgtgggaattgtgggagctataattyaagatgagatttgggtggggcatagccaaaccacatcaataacatagagaaggaattcagaatcctatcagaaaaacttaacaaagagaacaaaaatttaacaaaaataagtttgaaaaatcaagcagaaattctaaagctgaaaaattcagttgacttactgaagaatgcatcagagtctctcaacagcagaactgatcagttagaagaaggaagctcaaagacaggttgtttgaaaatatacaggcagaggagacaacagaaaaaagaatagaaaagaatgaagcatgcctacaagatggagaaaatagcctcaaaaggccaaatctaattgttttgaccttaaagaggaggtagagacagagactggggtagaaagtttattcaaagggataacaacagggaactctccaaacctagagaagaatatcamtattcaagcacaagaaggttatagaacaccaagtagacttaactcaaataagactacatttaataattgaacttccaaaggtcaaggataaagaaaggatcctaaaagcagcaagaaaaaagaaacaaataacatacaaaggagctccaatatgtctgacagcagacttctcagtggaaaccttacaggtcaggagagagtggcatgatatatttaaagtgctgaaggaaaaaaacttttaccctagagtaatgtatccagtgaaaatatccttcaaacatgagggagaaataatgactttcccaaacaaacaaaagcagaaggatttagtcaacactagatctgttgtataagaaatgctaaagggggttcttcaatctgaaagaaaagaacataagatgcaataagaaatcatctgaaggtacaaaactcactggtaatagtaagtacacagacaaacagaatattataacactgtaattgtggtgcataaactactcatatcttgagtagaaagactaaaagattaaccaaaaaaaaawaactaccacaactttttaagacatggacagtacaataacataaatagaaacaacaaaaagttaaaaagtggtggcatgaagttaaagtgtagagtttttatttgttttctctttgcttctttgtttattcaatcagtgttaagttgtcatcagtttaaaataatgggttataagatattatttgcaagccttatggtaacctcaaataaaaaaacatacaacagatacacaaaaaataaaaagcaagaaattaaaacataccgccagagraaatcaccttcactaagaggaaaacaggaaggaaggaaagaaggaagagaagaccgcaaaacagcaagaagacatataacaaaatggcaggagtatgttttatcaataacaatattgaatgtaagtgaactaaaytctccaatcaaaagacagagtggctgaatggataaaaacacaagacccaacaatctgtcacctacaagaaacacatttcacttataaaaacacaagtagactgaaaataaagggagggaaaaagatgttccatgccaatggagaccaaaaagagcaggactggctctatttacatcagacaaaatagatttcaagacaaaaattataaaaagagacaaggtctctttgaccttatgataaagatgtcaattcagcaagaggatataataattaattgtaaataaatatgcacctgacactggagcacccagatatataaagcaaatatcagagctaaagaaagagatagaccccaatgcaataatagctgaagatttcaacaccccactctcagcattagacatatcatccagacagaacatcaacaaagaaacatcagacttaatctgtcctatagaccaagtggacctaatagatatttacagaacattttatctaatggctgcagaatatgcgttcttctcctcagcatatggatcattctcaaggatagatcatatgtttggtcacaaaacaagtctttaaaagttcaaaaaaattgaaatcatgtcarttatcttctctgactataatggaaaaaaactagaagtcagtaacaagaggaactttgaaaactatataaacacatggaaattaaacagtatgttactgaatgacaggtgagccaatgaagaaattaagaaggaagttaaaaaacttctgaaaataaatgataatggaaacataataccaaaatctatgggatacartgaaagcagtactaacagcaaagtttatacctaaaaccacctacataaaaaagtaaaaatgcctcaaatatacaacttaacaatgcgtcttaaagaactagaaaagcaagagcaaatcaaacccaaaattagtagaagaaaagaaataataaagatcagaggagaagtaaatgaaattgacatgaaaaaagatacaaaaggtcaatgaaaccacaagttggtttttttgaaaagataaaatcagcaaacctttagccatactacgtaagaaaaaaaagagagacgatccaaatgagtaaaatcagagataaaaaaaggagacattacaacaaatacagcagaaattcaaaggatgattagaggctactgcaagcaactatatgccaataaattgaaaaacctagaagaaatggataaattcctagacagataaaacctaccaagattgaaccgtgaagaaattcaaaacttgagcagaccaataacaggtaatgaggttgaagctgtaacaaaatgtctcccaggaaaataaagcccaggacccagtggcttcactgctgaaatttcccaaacatttagagaataactaataccaatcctactcaaattattatattttattttattttgagacagtgtcttgctttgttgcccaggctggagtgcagtggcacgatctcggcccactacaacctctgcctcctgggttcaagtgattcctcatgcctcagcctcctgtgtagctcagattacaggtgtgcgtcaccacacctggctaattttttcatttttagtagagatggggtttcactatgttggccagactggtcttgaactctagactgcaagtgatccacctgcctcagcctcccaaagtgctggtattacaggcgtgaaacactgtgcccagccctcaaactattttaaaaaatagaagaggagggaatgcttccacactcattctatgaggccagtattaccctgatacaaaaccaaagacacattttaaaaaatttcaaacagggaggccaaggcgggcagatcgcaaggtcaggagttcaagaccagcctgaccaacatggcgaaaccttgtctctactaaaaatacaaaaattagccaggcgtggtggtgggcatctgtaatcctagctactcgggaagctgagacaggagaatcacttgaacctgggaggtggaggttgcagtgagccgagatcatgccattgcactccagccagggcaacaagagtgaaactccatctcaaaaaaaaaaaaaaaaaaaaaaaaaagaaaagaaaaaaaatcccaaacaaacaaacccaaatgtaaatatccctgatagacattgatgcaaaaatttcctacaaaatattggcaaactgggttcaacaacacattaaaaagatcattcattatgacaaaatgggatttatcccagggatgcaaggatggttcaacatgcacatatcaatcaatgtgatacatcatatcaacagaatgaagaacaaaaaccatgtgattatttcaattgatgctgaaaatgcatttgataaaattcaacatcctttcatgataaaaacagtaaaaaattgggtatacaaagacatacctcaacacaataaaagccgtatatgagacagacccacaggtagtattatacgtaatggggaaaacctgaaattgtctcctctaagatctggaacatgacaaggatgcccattttcaccaccgttattcaatatagtactggatgtcctagctagagcaatcagacaagagaaaggaatgaagggcattcacattggaaaggaagaagtcaaatcattcttgtttgtagatgatgtgatattgtatttgcaaaaacctaaagagttcacaaaaaactattaaaactgattaacaaattcagtgaagttgcaggatacaaaatcagcctacaaaaaatcagtagcatttctatatgccaacagtgaacaatctgaaaaagaaatcaagaaagtaatcctatttacaatagctacaaataaaataaaattactaagaattaacaaaagaagtgaaaaccatacagtgaaaactgtaagacattgatgcaagaaattgaagcgaacacaaaaacagtagaaggatattccatgtttatggattggaaaaatcaacactattaaaatgcccatagtacctaaagcatcagatcagatttaatacaattcctatcaaaataccaatgacattcttcacagaaatagaaaaagtaatcctaaaatttatatggaaccacaaacccagaatagccaaagccatcctgagcaaaaaaaacaaaaacaaaaacaaaaacaaaactagaggaatcatattacctgatttcaaattatattacagagctatagtaactagaacagcatggcactggcattaaaaacagatacatagaccaatggaacagaatagagaactcataagtaaatccatacatttacagtgaactcattttcaacaaaggtgtgaagaataaacactggggaaaggacagtttcttcaataaatagtgctgagaaaactggatattcatatgcagaagaatgaaactagacctttctgaggctgaggtgggagatcatttgagctcaggagtttgagaccagcctgggcaacatagcgagacctcatctctatttaaaaaaaaaaaaaagaaagaaagaaagaaggaaggaaggaaggaaggaaagaaggaaagaaactagaccctcctctctcttgatatacaaaaattaaataaaattggattaacaacttaaataaaagacttcaaattatgaaactactaaaagaaaacattgaggaaactctctaggacattggtctgagcaaagatttcttgagtaataccccacaagcacaggcaaccaaagcaaaaatgaataaataggatagcatccagttaaaaacttctacccagcaaaggaaacaaagtgaagagataacctatggaatgggaggaaacatttgcaaactatccatctgacaagggattaataaccagaatatataaggagctcaaacaactcaataggaaaaaaatctaataatacaatttaaaaatgggcaaaagatctgaatagacatttttcaaaagaagacattgaaatggcaaacaggtatatgaaaaggtactcaacatcactgatcatcagagaaatccaagtcaaaactacaatattgtctcatcccagttaaaatggattttatccaaaagataggcaatgacaaatgatggtaaggatgtggagaaaagggaaccctcatacactgttggttggagtgtaaattaatacaaccactgtggacaacaatatgtagtttcctcaaaaaactgaaaatagaactatcatatgatccagcaataccactgctaagtatatacacaaaagaaatgaaatcagtatattaaagagatmtctgcactcccatgtttattgcagcactattcacaatagccaagatttgtcagcaatctaagtgtcaatgaatagaagaatggataaagaaaaatgtggtacatatacatgagggagtactactcagtcataaaaagaatgagatcctggctgggcacggtggccaggatgataggatgaatatgttctcttatatatccgtactcccatcttccccacctcaggaaatggctctaccatctactcagttgtttaaatatcaaactgaagaaatttctgatttcttcctttaaaaagaaaatacaaatagagatgggggtctcactgtgttgcccaggctggtctggaactcctgggcttacacagtcctcttgccttcgtgtcccaaagtgctgggattataggtgaaagccaccatgcccggctcttccttttttactcactgcatcagaaaactttcttgtctctgttaacaaagtgtattctaaatctcactcttttcctccattcccacttttcaactctttccaagctactgttgtttttcacctaggttactgtgacagattcttaatcattctttgtatacatatatatatatatacacacacacacacatacatacatatataaaattttagggatggggtcttgctgtgttgcccaggtcttgaactcctgggctcaagtgatcctcctgccttggcctcctgagtctctgggattataggcacgaaccacaatgcctggcacttcttcctttaaaaaataacttgattaaggtacaattgacatacaataagtgggatatatttaaagagtaaaatttgataagttttgataggtgtatatatccatgaaatcaccaccacaatcagcagagtgaatatatcaatttctcacaaaagtttccacatgacttttcataattcctctccctttcctccctgtcccctcaacactcattacccccggaattcccaatctactttctgtcactatatatcagacagcatcttctagagttttacagtacatagagttttatagaatcatatagtatgtacttttttttctggcttctttcactcagcataattattctgagattcatccatgttgttgtttgcatcaatattttactcttttttattgctaatattctactgtgtggatttaccrcaattaatttatccatttactctttgatggacgtttaagttgtttccagcttttggctattaaaaataaagctgttatgaacatttggatacgaatctttgaatggacatagtctttcttttttcttggctaaatgcctaggaagtggcatggctggatcatatggtagatgtatagttatgtattagttgaaaacaaggatgccttctgagaaatgcatcgttaggcaaattcatcatcgtggcaacatcatagaatgtacttacacaaacctagatggaagagcctactacatacctgggctatatgggacagcctattgctcttaggctgcaaacctgcacagcaagttactgtactaaatactgtggacaattgtaacacaatggcaagtatttatgtatttaaacacatccaagcatagaaaaaatacagtaaaatacagtrtaaaagataaaaaatggtacacctgcatatgacacttaccatgaatggagcttgcagattacagtataaaagataaaaaayggtacaccggtatatgacacttaccatgaatggaacttgcagactggaagttgccctgaatgaccaatcggtaagttaatgtaaaggcctagggcattactccacattactatagactttataaatattgtacgtttaagctacagtaaatgaaataatgaaataaccttagcttactgtaacttgtttactttataaacttttacatttacatttttaaaaacttttttactctttttttttttttttgagacacagttttgctttgtcacctagactggagtgcagtggcatgatctcagctcactgtgacctcygcctcctgggttcaagcgattctcacgcctcagcctcccgagtagctgggcctacaggcgcacgccaccatacccrgctaattttttttttttactctttttgtgatacacttagcttaaaatacaaacacattgtgcagttgtacaaaatatttttctttatatccttattctataagcttttttctattttaaaactatttttaatttttaaacttttttttaaaaaacaagacataagcatgcacattagcctcgggctacacagggtcaggatcatcagtatcactgtcttccacctccacatcttgtcccactggaaggccttcttcggaagtaaggcatggagctgacacctgctattataacaatgccttcttctgcaacacctcctaaaggacctgcctgaggctgttttacagataactatttttttttcttaataagtagaaggaatagactctaagataatgattaaaaatataagaaatagctgggtgccatggcatgtgcctgtaatcctggctacttgggaggctgagatggaaggatcccttgggcccaggaggttgaggctggctgttgagtgatatgattgtgcctgtgaatagccaccacattccagtctgggcaacatagccagaccccatctctaaaaaaccaaaagtatactaaatacataaacaataacagttgtttattatcattatgaagtatcatgtactgtacataattgtatgtgctatacttttacgtgactggcagcacagtgagtttgtttgcacctgcctcaccacaaatacctgagtgtttgtgcagtgtcttgagctacgacttcatggaatcacgaggcaatagaaatttttcaactccrttacagtcttatgggaacacagtgtatacatggttctttgttgacagaaacattgttatgtatatatggttcattgttatgtgtgcatgactgtatatatttggtcttcctcccatttcctgacatatagcttctaaaatccttgggatctccggagtggtaagagtgtcttatgtatgctcatgaatgactggtggctggaggctcctagatagttttaggatcgggggtggtcaccaataagaccaaggcatgatcagagggctgggatttttagccccacccctcaactccagggatgttgaaggttgagttgatcaatggccattaatgatggccaatgatgtaatcaattatgcctctgtaatatatgcctacgtgtgccactcctcaactccagggatgttgaaggttgagttgatcaatggccatcaatgatggccaatgatgtaatcaattatgcctatgtaatgaagcttccataaaaacccaaaagaacttgttccaagagcttctggacagctgaacaggtggtggtttcttgcaggtggtgcacctgtgtggggcctggaaaatctgtgccccttctcacatgccttaccccatgcatctcttccatttggccgttcatctgtatcttttgtaatattctttaaaacaaatgagtaaatgttaagtgttttcctgagttctgtgagccatccagcaaattggacctgaggagggtgtcarggatacctagatttaragccagtcagtcagaaactcaggccacatcctgtgcttgtgactggcattggaagtgggagacagtcttgtcaggctgagccctgaccttttgggatctgatggtatctccaggtagatagtatcggaattgaattgagttagaggacacttagctgctgacctctggagaattcactgcagaatcgattgcttgcttggcatgtggggaaaaatccctacacatttggtcacaaaagcattttgttgkgagagtatagtatgggagaaacagattttggtgttttttttcctattcaatcttttgcattatagcttattctttttgtatgttgttaaggaaatctttgcctagtccaaggccacaaaggttgccttaatgaattcttctagaaattttataattttaggttttacatttaggtcggtaatgtatttctatttaacttttttttcctttttttttttaagagatggtcttgctctatcacccaggctggagtgcagtggcaccatcatagttcactgtagtcttaaactcctgggctcaaaatcctcttgcctcagcctcacagctagctggaaccacaggtgaatgccaccatgcctggccaattaaaaaaaattttgtagagatggggtttcaccctgttgctcagacttgtcttgatctcctggccttaagtgatcctctagtcttggcctcctgggctgctgggattacaggcatgagccacagtatccagcctgtttttatataacttttrtacatggtgtgagatataggttgaggttttttttttcttataaatgcccaattattttagaaccatttatttaaataagtatcctttttccattgaattcttttggagctatgttgaaaatcaattgatcgtgaacacatggattttttttttttttttttttttttttttgagccagagtctctctctattgcccaggctggagtgcagtgggtgatctcagcttactgcaacctcctcctcccaggttcaagtgattctcctgccttatcctcctgagtagctgggatcacaggtgtgcaccaccaygcctggctaatttttgtatttttaatagagacaggggtcactatgttggccgggctagtctcaaactcctgacctcaggtgatccgcccacctcagccttccaaggtgctgggattacaggtgtgagccaccgtgcctggccaacacatgggtttatttctgcattctcttctgttcctttttaaaatatatctatcctgtcacttctaccccactgtaattttatagtaagtctataagtaagaatatagcrtagtatagttctccaactttgtttttctttttaaaaattgttttatctgttcttggtcctgagggttttactacagattttagataaatgttcttttcatacattttgcgtatgtgtgaatataatgggggaaatcactgagttaatggcaatatgcattttaaattttataagatagctttaaatggccccaccaatgtaaactctccagcgatgtataaatttgggtgcctatttctttataccctcacaaggcagagataaggtgaaccccaggctcttcatgattatgatgacttcacccctrgttccatttttgaaggataatgaggggtttttacctagaaggaggtctttcatattcttcacactggaacatctacaatacacatctttcccttgctagtaatgctctcacagggcaaagttttggtgatagtaaagtctttatttctatattagcactgagaagggaaaggaagtaaagaagagggaagaaaactggtggcacagaggaaagagcataaaaatgatgtggtaaaagctaaagaagaagtggttttcaagggggagggagcacttactagaacaaaatgccaaagagttgtaaagtaacataatgagaggagagtattcaatggaaatggcaatatgaaggtcatgtttatcattcttcactggtgtggtggtgacaggtgaaatttcagcaggctgatmatacaaggtaaggaartggaaacaatgagtttagatggtttgaagtctggttaagacaggaaggaaagagataatatctaagtagagtcatatgtcgggtcaatagatcttaaaatacagatagaagacagtaacacattttgtaacytgaggtaacaaaattatgttgaaagggagagattaaaaatgcatgtgggtgtggctgggtacagtggttcatgcctgtaatctcagcactttgggaggccgaggcaggcagatcacttgaggccaggagtttgagatcagtctggccaacatggtgaaaccccgtctctactaaaaatacaaaaattagctgagcacgttagcacatgcctgtagtcccagctactcaggagagtgaggcacgagaatcacttgaacccaggaggtggagtttgcagtgagccgagatcgtgcgattgcactccagcctggatgacagagtgagacttcatctcaaaaaaamcccaaaaaatatgcatgtgagagaggatgctttatagaccaagattcttgagtcagtggatgaatatgaagctgactggacaactggaagaagtaaccttgggtagaaagagtgccccttccccatggaagaaggaaagatgggtgaggattctgatgggtttattacaagtgatagggaagtaaactgttrttacctggtgaacttcattttctcagtgaaatcaaagacaaggtcatatactaagaaggagagaggaaataataggtttgggggtctatggacagcagaatttttgaataatcacaaagrggaaagagaggcatctgcctagagacacgacattgctgggcagccctgcgagcttgggtgaggcagggggccgaacattttcagtgatttcaatctgtactattgcacggtttttggcagcagccyacatgggatttgtcataataacagagaaatcaaatagcaagaaggatggagggagaggatgttacagaatggtttcaggggaagagaaaaggtgtcagaaaagagaagtagccagaagtaggcaagaaacccaaataatagggtccctgaagtgagggacatgtataggaaaakatttgggaataatagtgtaggagatgaaataaaacaccacagtgaacatttttgtacatgtattctgttttctcatgttttgaaagcatgagccaaaaacgtatgccaaaacaaaaatgttaatagataccactggattactttccaaaaagactgaagcagttttactgccactggcaacrgatgagggtactagtcctaggtccttctcagctccatgtgttctcaatgttttaaattctggctaattattattattactatttttgtgggggaagaaggatgttatagctttgtcatcatttgtgctttccacactattagtggctttgagcatcttctcaagtaagttagttatttgtatttcctctgagttacatgtttatatcctttggctattcactctatcagggtttttttctttttttctttttttgtcttttttcttwtcaatatgtaggcactctttgaggcacatgccacctgcttatttgtcagtcatatgtgttgcaaatattttatattatttgttttcttaaaacattatggagtgtttttttccttctattcatacattttaagttttaaaaaaatcgtgtgtgtgtctgtgtattttagagacaggtgctcacttttttgcccaggctggagtaccgtggtgtaatcatggctcactgtagcctcgacctcttgtgctcaagtgatgctcctgcctcaacctcctgagtagctgggaccacaggtgtgcatcactgtggctggctttttttttttaattgacaaataaaaattgtatatattacaatgtacaacatgttgttttgaaatatatatatacattgtggaatgggtaaataagctaattaacatatgcattacttcacatatttgtgtgtgtgaggtgagaacacttaaaatctattttctttttcttttttaaragagacgtttattcagcctcacgatcagactattccatttagcaatcaacagcatgggtgcaaaaaaaaaaaaagtctacattaaaaccctttgttggaatgctttatactttccacagaacagaaaccaaaataacctgttatacaattagtcacaaacacagtcctcaagttttttgcccatgcacatgagtatttgcgtaaaacatgtcttctttgtagcagctaggccttgccaccactgtgcttggctgagttcacaaatctgttgcctgtagcttccctgccacttctctggctctcttctcctgctaagctttgtttcctaattaaaatcttctgccactgccatagctgctgctgctactagaaccaccataggcaccttggtttcgtggtttggcaaagcattggcctccaccaccacaggggccagagcttctgactccaaagattcytcccttcatgggtccaaaatttgaaaactgattgttgtaattgccaaaattcattgtagcttccaccacctccaaaattgcttccatcattaccaaatccrttatagccatccccattgccaccatatccaccacaaccacagctgccaccaaagccaccatgaccatgaagttttctccactaccaaagttgtcactcccaccaaaaccacctccatgaccactaccaaagtttccagaaccayttcgacctctttggctagatgaagcgctagctctctcttgctttgacagtgctttcctaacttcacagttgtggtcattcacagtatggtatttctgaatgacagtcttatccacggagtcatggttgtcaaaggttacaaaggcaaagtcccttttcttgccactgccttggtcagtcatgatttcaatcacttcaatttttccamactgttcaaaattatctgttcttcagtgtcgtcgtcttcttctttttttttttttttttctgagacagagtctggctcttgtcacctaggctggaatgcaatggtgtgatctcggctcactgcaacctctgcttcccagattcaagcgattcttctgcttcagcctcccaagtagctgggattacaggcgtgtgccaccaggcctggctaatttttgtgtttttatagagacaggtttcaccatgttggccaggctggtctcaaacttctgacctcaggtgatccacctgcctaggcctcccaaagtgctgggattacaggtgtgagccaccacgccaggccttttttttttttgagacttagtctcactctgtcacccagactggagtgcagtggcacgatctctgctcactgcaacctccgcctcccaggttcaagtgattctgctgcctcagcctcccaagtagctgggactacaggcacgcaccaccacgccctgctaatttttgtatttttagtagagacgggatttcaccattttgtccaggatggtttcgatctcttgacctcgtgatccacccgccttggccccccaaagtgctgggattacaggcctgagccaccgcacccggcctcagtgtcttctttaatgccatcaacaaacatatttttcacagttaagtgggcacctsgtctttgagaatcttctcttgagaaagctctctttggttccacaaatcttccatccacttgtgtggccttgcattcgtggcygcatccacctcctccatagtggcatatgtgacaaacccaaagcccctgcaaccttggtgtttgggtctctcattacggcacagtccgtgagcgttccccattgctcacaatggctcttcaggctctcattggttgtttcaaagctcaaccatccaatgaagagcttcctccgctggtcaggctctttaggagactcagacttagacatgacggcagaaagaagagagaytttaatgatgcttcctcggtggtgtccaagggcagaaaggcaaaatctattttcttagcaattttcaagaatacaatacattgtgtgtgttttttaaaattttttatttatttatttatttttagttggagtttcactcttgttgcccagactggagtgcaatggtgcaagctcagctcactgcaacctctgcctcctggattcaagtgattctcctgcttcagcctcccaagtagctgggattacaggcatgtgccaccaggcctggctaatttttgtatttttagtagagacagggtttcaccatgttggccaggctggtctcgaactcctaacctcaaatgatccatctgccttggcctcccaaagtgctgggatccacggcccctggcctgaatacactgttattaactacagtcaccttgttgcacactagacctcttgaacttactcctcctctccaactgaaattttgtatattttgacaagtatctccccaatcccccctcctcattttaagtttaataaagtcaaaactgtcattttttcccccttattgtggattttggtattccacctagaattgcctgcttgggattttacttgtattttcccamaatttttttctaataagtctgtatttttaattaattaatttatttatttgagacagtctcactctgttgcccaggctggagcgcaatggcatgatctcggctcactgcaacctctgcctcctgggtacgagcgattctcatgcctcggcctcccgagtagctgggattacaggcacaggccaccacaccctaatttttgtatttttagcagagacagggtttcgccatattggccaggctgatcttgaactcctgacctaaggtgatccacctgccttggcctcccaaagtgctgagattacaggtgtgagccactgtgcccggccctctcttaagctggctttaattattatttggtttcacattttgatctttaattaatttttgcarttgtgataactaacttggaagagagragacagactgagttctgggcaaagtcttggatcattgagagggaaggaaaaggtttgaagatgaaagtgatgagaacgggtagtggatggggtgggcaggtggcacgtgcctcaaagaagctattttttgggtattgtttttattgtgataaagtgtacataatataaagtttatcactttaaccattttcaagtgtataattcagtgacattaattatattcaccatgttgtgcagccattatcactatccattaaaggaaccattttttttttctttttgacatggagtctcgcactgttgcccgggcttgagtgcaatggcaaggtcttggctcactgcaatctctacctcccggattcacatgattctcctgcctcagcctcccaagtagctgagattacagcagcccaccaccacacctggctaattttttgtatttttagtagagacggggtttcactatgctggccagactggtctcgaactcctaaccttgtgatctgcccgcctcggcctcccaaagtgctgggattacaggcgtgagccactgtgcccagcctaaaggaactatttttacatgataaaaaacaatggtatggagtcagcaaggaaaaccacaataacacaaatgctgactttcctctcttccactacttcyactctccttgcaacttagtagcctcattttgagaggacataattttaagaaacagttggcttgtagttaaggcaaagaggagtggggatgttctatgtaaaggttgataagatagggtaacctgttttcaatgtaacagggattgcagtgagcacaccagatagcatctcccggcagggggtagtgagagaatggtcaaattgtggaggcctagcttgcaatggcatgagactgtgggcagaaattaattttaacattttagaattaatttttgttggggatttccctgcagggctgctgcacgtggtgagggctcaacccctcaggcactcctgtgaggcccctggtcacccaggggcacctttaggctgggaggggcaaaagccctttgtcttcagagctgaaaaactcagtctctcatttagctttgaaaacaacagttcagttcctcagaatcaagataaattttaggagaaaaagcaatagaraattccctttagaatgcatctctgaattagaattaggatccttaaacaacaatttcctaggagaaaaccagctcagaataaatcaaggactgtcaamcaaagggaggtctggggctcaggaggacttacccgttccaccgggggagaagcttgaactcagtgggacttcaacgggcygctgctggtaccttagctctggtttcgggcaactctttcagggtcctgartcttctctgaggcctcatgtatttgggcaccaaaatattgtcaacaaaaagagtcaaactctataaaatatttgaagatttattctgagctaaatatgagtgaccatggcccacgacgcagccctcaggaggtcctgggaacatgtgcccaaggtggtcggggcacagcttagttttatatatttcagggagtcatgacacatcaatcaaacacacttaagaaatgcattggtttcgctcagaaaggtgggacaactcaaagcaagggcttccaggctaaaggtaaatttaaatcttttctggctgacaattggttgagtttgtctgacccgtattaatttcctagtgctgccctgacaaagtaccataaacttggtggctaaagccagcggaaatgtatggtctgacagttctggaggcccaaagtcaaagtgttggcagggatggttccttctgggggagaatctactcagtccactaatttaaatactaatctctagtggaaacacctgaacagacacacgcagaagtaatacttaaccagatatatggatatttcatggccctgttaagctgacacataaaattaatcatcacagaagctcacctatgattaattgatttttttgagggtgcaaaaagctactcagtgatgagtataataaaatattagaaagagtgtttttggttgactcagaattttggctaaaatctaaagctgagaacaataggtgttaagaaatcctatattccaaagagagttcttagcttaccctacaggactttccaaactggtctaaggacaattaccaacagcccatatcaggaaaagatagagactgattgaaaccacctttgcgaaattatgacagtaagagaaaactgacatagttgactccattttgcttctaagctacaagatgtcttcggtgattcctcagtgtaggccaaactaacttcaggaggcacttaatttatactttaaccttagagcaaagatgataatagccctctcctaaaactaaaccacctctgtaaaactaatgaaaggccacaggttaggattaggaattatgagaggggcctgaattctgctaaaatgtaggcaaagtgaaacgataaccagccattgttctggaggtcacaagatttgtaacttccccaattactcctgtagatgacatcaactgttatagaacccaagattggccttttgagatttttttcagactgttaacgtttctcatgaccagctgactcgggccagacctgcaactcatgagtcaatcagtcctgtagccctacccagaggccaattcagtgcatgaagactattttccacactcctatgattttaccccaatcaatcaatattccccattctctagccctctgaccaccaactatcctttaaaacccccaaaactttgagccttcagggagactgatttgagtgatatttctggttctactacatgagttagcctcctgtcaatcaaactctttctttactgctatgccgtagtctcagtgaattgattttgcctgtgcagagggcaggaagaaactgccggtgattacatgattgcagagacaaattccttgaaagaatttgtgaatcaaaagattgctggggtctgggtgtagtggcttacatttgtaaccacagcactttgggaggccaaggagggaagatcgcttgagcttaggagttcaagactggcctggggaacgtagaaagtcatcatctctaayaaaaataaaaaaataaaagaattagctgggcaaggtggtttatatctgtagtcccagctactagggaggctgaggtgagaggatcacttgagcctgggtgatagaggctacaatgggctacaatcataccactgcactccagctagggtgacagaatgagactcttwaaaaaaaaaaaaggggattactggrgtatttcccctcccaccctgattccaagtgagaggggaaacaagagggcactttggggaaattgggcactgcttgctgaaggcagacagagtcttactycttggctctatgcttgctcagctatgggagcttgtaaatttgagacagcatggagaataaaaaagtgtttggaagaacctgacctatgtcccttactgaagaggacaaagacacttttgtgtgactattgtttagagaggcccagtggtgagaagttagcagaagttgctcctgatgacagggtaaggtggggtggcttcaaggctcagcttcactatttggtgagtgggtatatgagctcccctcatcccagaagtagcagatgtgggtttgcgtcctctacaaagggctttatccaagaggactccctatcggtgggagatcctacaagaaagaagccatgttggatgcttcactagaagttgagagctaaggtaaagtcacaggaggcctcccagagagcatctcacctgtatcagggaatgatgcagtgcagaaattcctcagggatgtatctctgtgtaggatctcctaaaaatccattgaagaaccccatgagagacaattggtatttgtgtattgtatcagtcaggtttcaaccacagaagcagaaccagtagaagagatacatacagtcatgcacagcataatgatgtttcggttaacaatagatcacacatatgccgtaattatatccataagattatagcgaagctgaaaaattcctagtgacatcctatctctagggacatcatagctgtcataacatcacagcacaacacattactcattactcacgtgttcgtggtgatgctggtgtaaatgaacctacttcactgccagtcatgtaaaaaccatagcacatacggttatgtatgatacataatacctgatgataatatgtgcctctgttattgatttatgtacttaatataccatactttttttttttcttttgagatggagtttcactcttgtcacccaggctggagtgcaatggtgtgatctcggctcgctgcaacctccgcctccccrgttccagcgattcttccgccacagcctcccgagtagctgggatttacaggcatgcgccaccatgcccggctaattttttgtatttttagtagagacgggtttcatcatgttggccaggctggtctcaaactcctgaccacagatgatccgcccgcctcggcctcccaaagtgttgggattacaggcgtgaggcaccgtgcctggccattatactttttactgttattttagagtacattctttatacttatccattaaaaaatttgttaattgtaaaacggtcttgggcaggcccttcaggaggttttccagaacaaggcattgttatcacaggagaggacagcttcatgcgtgttactgcccctgaagaactcccagtgggacaagataaggaagtagaacagtgatattgatgatcctgaccctgtgtaggccttggctaatgtatgtktttgtgtcttagtttttaacaaagctatttaaaaagtaaaaaaaaaattaaatagaaaaaaacttatataataaggatataaagaaagaaaatatttttgtatagctgtacaatacatttgtgtggtaagctgtgcgttcatacaaaaaagtgtagtttggagatttctcgaagaacttaagacagaactaccttggaaccaacccaaatgtccatcgatgatagactggataaagaaaatgtggcacatatacaccatggaatactatacagccataaaaaaggatgagttcatgtcctttgcagggacatggatgaagctggaaaccatcattctcagcaaaccatcacaataacagaaaaccaaacaccacatgttctcactcataagtgggagtcgaacaatgagaacacatggacacagggaggggaacatcacacaccagggcctgtcagggggtagggagctagggggagggatagcattaggagaaatacctaatgcaggtgacgggttgatgggtgcagcaaacaaccatggcacatgtatacctatgtaacaaaactgcacgttctgcacgtgtactccagaacttaaagtaaaaaaaaaaaaaaaagacagaactaccattcaactcagcaatctcatcactgagtatatacccaaaggaatataaattgttctaccaaaaaggcacatgcacgtgcatgttccttgcagcactattcacaatggcagagacatggaatcaacctagatgcccatcaacagtggactggataaagaaaatgtggtacatctacaccatgaaatactacacagccataaaaaataaaatcatattctttgcagcaacatggatggagctggaggccattatcctaagtgaaccaatgtaggaacagacaaccaaataccacatgttctcacttataagtaggaggtaaacatttagtatgcagggaggcagagtggaacaaaagacactgagggctacttgagagtggagattgggagagagtgaggatggaaaaactgtctattgggtactgtgctcatacctgggtaacgaaatcatttgtacacccaacccagtgacatgcaatttacccatgtaacaaacctgcacatgtacccactgaacctaaaataaaagttaacacaaaaaggaaaaagtttattaagtaaaaaaattagaagaagctaaggttaatttattattgaagaaagagatttcacttcacggcagctgtggcctgactgtgaggcggctgaccagcctcagctgagagtggagtggtggccgtggccctccttaggagatcaccatatcacctcttactgtggccttaccatggcgacctatgggcagacctgcatgtggccagtgtggatttcttcatcatatgttaaccttggcaaagctgccagagatatttttaacaaaggatttggtttggggttggtaaaactggatgtragaacaaagtcacgcagtgctgtgggattttcaacatctggttcatttaatgcagacactggaaaagcttttgaagtcttggagaccaaatataaacggtgtgagtatggtgtgactttcccagaaaaatgagacactgttaatactctgggaacagaaatcacaattggaccacctttgtcaaggtttgaaactaatatttgatactaccttcttagcaatcacaggaaacaaaagtggtaaaatcaagtcctcttgcaagagggactgcataaaccttgcttgtgatgttaattttgattttgctggacctgcaatctatgcttcagctgtctttggttacgagggctggcttgctgggtaccagatgaccactgacagtgccaagtcaaagctgacaaggaataactgtagtgggctaccggatgggggacttcgagcttcacactaataacaataatggggcagaatttggaggctcagtttatcagagggtatgtgacaatcttgatacttcagtaaaccttgctcggacatcaagtgccaactgcactcattttgtcttgccactaaatatcagttgcatttcactgcttctatgtttgcaaaagtcaacaactctagtttaattggagtggaaggaaagagacttcatttacactcagactctgagcctgctgtgaagcttgcactttctgctctgctagataaaaagtgcattaatggaggaggccaaagacttgggtttgtcctggagttggagacttaatccagctgaaagaaatggcaatggatatcagaagatttggctttaatatactttcattgtgatcagcaggctcttcccacaaagaaggtgatcaaaacaaaggctctaaacaagagctatattttaaatatttaaacagctactcgttagctggtttctagttgaattggttatgtatytagttaccaatatgctgcaaccgtgcagtcacctacacattatttaagtatatttaactgttamatgcactacccaccaatcatgaaataaactttatgaaaaaaattttttaaaatgaatttactatagcttgagtatacagtgtgtataaagtctacagtaatgtacaataatgtcctaggctttcacattcrctcaccactcactgactcacccagagcaacttccagtcctgcaaaccccattcgtggtaagagccctatcgaggtgtaccatttttaatgttttatactgttttttgatggtaccttttctatgtttagatacatttagatacacaaatatgtgccattttgttataattgcctacagtaacatgcagtccaggtttgtagcctaggagcaattggctacaccatataggccaggtgtgtggtaggctcttccatctaggtttgtgtaaatacaatctatgacctttgcacaaaaacaaagttgcttagggttacgtttatcagaacatatccctgtaattcagtgatacctgtgttaaaagatgtactgcagtggctcatgcttgtaatcccagtgctttgggaggccaagacaggaggattgcttgaggccaggagtttgagaccagcctgggcagcacagtgggaacccccaatccttacaaaaaataaaaaattggctgggtgtggtggtgcttgcctatagtcctacctattcaggaggctgaggctggagactcgcttgagctcaggagttcaagatggcaataagctgtgattgtgccacagcactccagcctgggcaactgagcaagaccctgcaaggaattggctcatggctaggcaattccaaaatccataaggcaggctgccaggaagggcaggctgggactctctagcagaagccgaagctgctgaagctgctgtctataggtagaaattcatgtttatcagggaagccttaattccactcttaagacctttcaactgatattgaatcaatttcacctagattatctaggatactttcccttacttaaaatcaactggttacggactttaacgaaatctacaaaataccttcaataaatatctagattagtgttggattgagtaacaggggactattgcctagcaaagttgacacatgaaaaaaccatcccaggtaacttccacacaaaatcatggccagagaacaatagtaccagagcaagacttttccctcttctttgaattccccatctttgaggctggagggctgcatcactcccccactgctggtttgtgagagctgtatgtagaggaaaacaaaaattagccgggcgtggtggcaggcacctgtaatcccasctactcgggaggctgagacaggaraatcgcttgattctccacccaggaggtggaggctgcagtgagcagagatcgtgggctgcactccagcctgggcaacaaagtgagactctgtctcaaaaaaaaaaaaaaaaattgaaacaaaaaatgaattggttataagaataacattttgatttagattggattaaactttctcagtcaaatgagactgttagagtagcttaaatttattagaagagctaaatgatttgtctgataagttgtccaagggtatggaggctctggttggagaataaagctctttcctgattgcaatatatgaattctgttcattcaataagttggtcatatgtataaagtagacgattgctaaatataacattagttatcaccttcaaagcttatctcttcgcctccgcgtctattctctttgtcctctctcatttgttgtttttgatggctactctatgcttttactgagaatagaagaatgagaaaaccagcttagattgcgtatgtgaaatactagaaagtgagattgtattttccttctctgatgactttacaaatagaatgattaaaaagtatttttytctaataatttgtgtacacagaaacttaggattgacaaaacgatcttatttgttcttgacatatgtataattttatgcttttttaaaaaacttttttttctgttcatggccttttcctctgtttcttcttcctcatgacaccactttaacaactgatgtcttactacacattattctcattatctcattataggatttaactgccctctttcggtcaatgccagtaattgcaccattaatgacagttgctaaagcagtcagtccagtgacttttcagagggtgctgagattacagattctcttccaggattctttgtttgtttagtagccaatcaagggtaaagtctcttctattcaatcactagaggaaaaaccattttctcactaccttgattctagaaaaatttgtgcattcttttgataatactcagacacaaatarttctttagtggccattcaattattccctttgttactgtacatttccaagatagattatttgattagcaaaaatgcctgcgcaatgcattcaggttattgccaggtatggacactactagaatgacagtgagtaagagagaaaaaagaaatgatacctttcagtaagaaggaaaatggaactatcaataatagaaggctaattagtaaagaaaaagtcaagagaagataagactgagaaaaacttcagattcttaataaaaagaaggcactcaattataggaaagtaaactttctgaaaagtaggagagaaktaggatagtggtaaatttgctaccattttgaaatggtccataatcatgaatatataatttcagtatatggcacagactcattacagaatcacacagtgctaagttcctaggccttgtctgtcctcgaacaatagtatataatttaacttctctcgcctcatcttgacagataaataccatgctatccatttttctgtttaagcgccttctgtgttgggctatccaagtcaggaaatctttccttagtattctgtaggacccattaggttgaaatcaggaggtttttcaccatttgatggtttggatctataagaaggacactttcatattgttcaacccaaatatttattgtcctgtcatgaaatagcaatgatatatttggaatgtcagctagcttttctgtccagtgcctccctcccatcttcatctcrgatattaaattttactaaaacttacttttatttagaatgtaattcttctgaatcactttcagactttctgtttttatatgtggttgtgtggtctgtgacatcacaggacattttctgaaagggtgcctcactattgtctctggggttgttttccaaactattgaaaactattctgcagatcttcatgctcaaaatgttttgatcttacaagaacttatcactgaaagatttcaaacaacaactagaattcagattcctttttcaactgcttattaaacggttcattgattgaaacattgagagattgtagttgttcaatgggaatgtcaatgggaagacaactaagtttatgcatgaagagggaaaggcaagtgaatcacgaccactgcccacctgacagcagctgtgyaaaatgctgtgacagactgtttccaaagatgcacatcactgcgtatcttccaacagacatgccctttaaaaacaactttattgccaggcgtggtggatcatacctgtaatcttagcactttgggaggctgaggcgggtggatcacctgaggccaggagttcaagaccagcctggccaacatggtgaaaccctgtctctactaaaaatacacaattagccaggtgagatggctcatgcctgtaatcccagctacttgggaggctgaggcaggagaatcactcgaacctgggaggcagaggttgcagtaagctgagatcgcgcctctgcagtccagcctggcgaaagcgtgaaactccatctcaaaaacaaacaaacaaaaaaacaaaacaaaaaacttggttgatatgtaattgatgcactataaactgcacctgtttgacatgcgtattttgatgagccacaggattttttgccatgtgtccttgatactgcttctccaagaatttgagtctatttttactattcttgaatccagtccagccctgtgactcacttgaccagcagagtgctgtggagctggtgttgtgtgtcttggagagctaggttatagaagcctggcaacttctactgtctcttggcacatttgcacttgggacccctgacctgccttgtaacaagtgtatctacttgctggagagaccaggtagagaggacctaagtctatttggagagtgagaggtcaagttatcccagcatcctaatcaaatcttcaggtaattccagctctagctatcatctaactgcttgaggtaccccatgcgagaccactcaccttaccccagtcaaccatagaaccatgagaaataagaaaatgataattactttaaactgctaagttttggagtggtttgcgtgcagcaatttatcaccaaaacagagactggtactatgaaaggctgatgattttacaaaaatctaaaatatgtggcattggtttggggaccaggtgatgagaagaatctggaagggactctaagaaattctttgtaaaggctrgaaggacaaggaacacattttttattgggagctagaaaaaaggtcgcttgtgtaatgtagtggcaaaaagtttagcaatgcttcagcttgtgataaggtggctaaggaagtatctacctaggatgttgaatataccagctcgtttcttttagctgcatgtgataaggtaaagatggagatgaactaaagaagtaactgctcagttttcaactagaatctagaggcaacacatttctttgccagattttttaggattgaaaacaaaactgtttctcatctccattctcttccagtaaaagattattaaagtaataaattacaacagagcaaaagatcaaattcagggcactgccactaaaagtatggcctcagggtcaagatttcaagattacagctgtagacctttgtgtagacctcagaaagatttaaaataatgyctcctgaaccctctcagctaggcaaaaagtctactaaaaatcccaaggacgtgtttcttagaccttttctgttaaaggcttcttagaaacttaagagcattgttacccagcacttttcttctcagtcaaaggtagagagggacctgtcytatgatttatcagtgtggcttttgtttactggaatggttatagattgatagaaaagaagtccatacagcttttaaaagaattctgctgccttgtactgaaagggagagacagttgaaaataaaaaaataaaaagaggcctctgagtcttcaaacttttatagtcaggaagcagtttgatattgaccagcaaatatgggcaatgtcttatagaaaaggaaagataacttaaaaggaagatcttagaacccagaaagcagagggaagaggaatggagaagcactttgatgattgcaggactgggccctcatggaggaatggcgatgtgttcccagccagaattgctatgatgagtgattgctatgtgcttcctgttctctcaatttttttgaataggaatatttatgcccttatcctttctttgtctcaccatcttttttgggtttgtgtgcatggcagatatctttttttttttttttttgagatggagtcttgctctgttgcccaggctggagtgcagtggtgcactcttggctcactgcaacttctgcctcccagattcaagcaattctccctgcctcagcctcccaagtaactgggattacaggtgcccaccaccacgccggttaatttttgtatttttttagtagagatggggtttcaccatgttggccaggctagtcttgaactcctgacctcaggtgatccacttgccttgggctcccaaagtgttgggattacaggcataagccaccacatccggctgatatcttgtttcttaagttcaaatgtcttcgggttgagatatcttgtctcctgtgctcaaggagtagtacctaaggaagttcacccaaaggactccattcacatctgatttaggtgatgaaatcttagacttatgcttaagaagatgaggcttttgaggaagaggctaagtgcattttgtatgtgggagagagatgaaatttgtggccaaatggcagctcataacaatgtgtgtttccaaaggtggccacaataatatctccaaccacatgctcttttgtaatgtgatcttgctactcctccctcaagaggtgaaatctgtttcactcttcttgaatcctagctgaccttatgatgtacttgactaatcaaatgtaatggaagtaatacatgacttctgcggccaattcaaagaaatcttgcagcttcttcctatagtttttgaagctcttgttcttgggagctctgaaatgccatgtaacaagccaagctactctgttggagagaccataaaatgaagtcctgagactacatgcagggagagagagaasaagcagtctctcagaatcccagtggagtctccacgtgactccaatcccagctgccatctggctgcaatttcatgagagactcttggcaagaccatgagaaaaatcatccaggtaagccatgtcaacccatgaaactgtgaaatatatgaaattgttgttttaagcaaattagattttggggtggttttttatacagtaacagataaatgaagcagatattaatttattgtaatatgtgtcccaatttcaaggatcttaaaatgtaaacaaagtacaacttagaattgatgaaatagaaaaaaagaaacgcatgcaaattatatgaataggtaatttgtagaaaaagaaatcccaatggctagtatgaagagacgctttactcctctagtaatcaaagaaggaaaagtttaaacaatcaaaaaataagaatttttactcaaaaaaagtacaaacaggcttggcgtggtggctcacacctgtaattccaacactttgggaggccgagacaggtggatcacttgaggtcaggagtttgccaccagcctgaccaacatggtgagaaaccctgtctctactaaaaatacaaaaatgagccaggcgtggtggcgtgcacctatagtcccagctacctgggaggctgaggcaggagaactgcttgaacccaggaggcagaggttgcagtgagccgagatcaccctattgcactccagcctgggcaacagagtgagattccatttcaaaaaacaaaaaaaaaaccccaaacaattagaaacctagatagtggtaaatattggcaagaacacaggggaaatgagacctccttgtatactactagagggagtatagatttgtgtagcattctggttgaatagtaaatttaagttagtatatatcattttattcaacaattcttatcctggctttataacccagagtaattatcacataggctgataaattgacatgtattaggatattcagagcattgctgtatacagtagaagtatcataaatatctgtcactaaaggagtgaataaaattttggtggctgcaaattattttagtggaatactatacagaagttagaagcatgacacaaaacatgcaaatagcaacacagaaagaggctgaaaagtattgaaggacttctggtttctggcatgacttataaagagcttggaagtcaccactgccaccctcacaacaaggaaaaaaaactgaaatactgaaaatcaacaacttttcttagatccatcaaagaattgaggtaacgggcaaaccatcactcagaaaactgagagagagaaccacagttttgcgagagaagataccacagctgtcatcggacctgtgaggcttagatcctatttaagaagtctttagagaagcccaaagacaaaaatgacgacagaggaaattttagcctctaataaagacacagagagagtaaacacagccgaactcctagatagataaacataaaacctcatgataacttacttcagtttcttttacccaatatataataatctagatttctacaaaaaattacacagcactttaaaaggcaaaaaacacattttgaagaggccaagcaagtacaacaagatgaagatatgacagtgattttggaattaacaggctggaaatttaaaataatgattattatgctaagggatctaatagaaaaagtggacaacatgcaagaagagatgggaaatatcagcagagagactgaaactctaagaaagagaaagaaagaaatgctaggaataaaagtacagtattctattataaagatacatgcacacatatgttcattacagcactattcacaatagcaaagacatggaatcaacccaaatgtccatcagtgatagaccagataaagaaaaygtggtacatatacaccatggaatactatgcagccataaaaagggatgagatctttgcagggacatggatggagctgaaagccattatcctcagcaaactaacacaggaacacaaaatcaaacaccgcatattctcacttataagtgggagctgaagaatgagaacacgtggacacggaggggaacgacagacactggggcctgtggggggcaggtgggagagcatcaggaaaaatagctaatgcatgctgggcttaatacctaggtgatgggttgataggtgcagcaaaccaccatggcacacatttacctatgtaacatggtctggacatggctgaggaaagaatcagtgagcttgaaactgaaaatttcccaaactgaaagccaaagagaagaaaggctgagaataaaggaacagaatatccaagaactatgggacaattatgaaaagtataatatacacataatgggaatagcagaaggagaagaagataagggaacaaaaggaatacttgaagtaataatgactgagaattttccaaaattaccaacagacaccaaactacagatccaggaagttcagagaacaccacacaggatacataccaagacatctgcacctaagcatgttatgatcaaactgcagaaagtcaaagacaaatagaaaatctagaaagaagctagagtgagggaaagccttgcttacagagagcaaaggatgagaattatagcagatgtctcttcaaaaaccatgcaagcaagaagagagtggagtgaaatatttaaagcattgaaagaaaaaagtcaccaacctagaattgtatatttaggtaaattattctttaaaaatgaaagaaattaaaaactcagaaaaacaaaaattgagagaaattgttgccttccaagaaatgttaaaagaagctcttcatagaaaaggaagatgatataggtcagaaacttggatctatgtaaagaaagggagagcatttaaagtctttcattttcctcattcttgttcttcatttttwaattatttttatttttttatgagacggagtcttaccttgtcacccaggttggagtgcagtggtacaatcacaggtcattgcagcctcaatttcctggactcaagtgatcttcccacctcagcttcctgagtagctgaaactacaggcacgtgccaccatactcagctaaatttaaaattctttatagagataaactcttgctatgttgcccagactgtctcaaatccctagcctcaagtgcttttcctgcctaggcctcccaaagcattgggattacaggcatgagacaccacacctggctttattttttattcttaattgacctaacagataacagtttgttcaaaagatttgtagcaacaaaatattattagtagcaataaaacttatagacatgtgaaaggtgtgacaggaatgttataagggacgggagtgaggtattggctgttctctcttataaggtatgtgcaccacctgtgactcagtgtagtgttatttgaaaacagacttagattagttgtaaatgtatattgcaaactctaggcaagcactgaaaatgtttttttgaaataagtataattgatatgctaagagatgagacaaaatgaaataatataaatttctcagttaaaatctgagaaggcaaagaacaagggaaatgaataaaaaacaattaaaataaggtagagattaaatctaaatatatgaatgattaattagaatgtgaatagtctaaatacatcaatttaaaagacagactattagagtggataagaaaacaagactcaattatatgtagtctacaaaaaactcactgtaaatataaaggatagattgaaaataaaggatggagaaaaatatgccaagttaacactaataataataataaggctgaagtagctatattaatttcagacaaatcacatcttagagcaaggaaaaaggggccaattctccaagaagtcataacaatcctgagtttttgtatacttaacaacagcggtcaaaatatgtggaggcaaaaaccgatagaactgcaagggaaaatatacaagtccactattatagttggagacttcaatacccatttatcagtaactgacagatccagcagaaggaaaaccagtaagcatatagttgaattgaatagcacaatcaatcagttggtgctaattgatattcacaggatatttcatccaacaacagtagaatacacatttttctcaagctcacatggaacattcttaaagrtgggtcatatcctagttccaaaacacaacttaataaacttaaaagaatagaaatcaaacaaagtatgtgctcagaaaacaatggaaataaattagaagtcaataacagaaagatagctagaaaattccagaatatgtggagattaaataacatacttctaaatgacatataggcccaagaagtcttacgagaaatttaaaaaatatgttgaactaaataaaaatgaaaacaagtaactaagaaacgcttcctaacccattctatgagaacaacattaccctaataccaaaactagagaaatacaagataagaaaagtacagattaatatctctactgaacaaaaatccaaaaatcctcaacaaaatattagaaaaccaaacccaacaatgtgtaagaatagttatgtgcaatgaagagtgggatttattctagatatgcatggctagttcagcattcaaaaatcatttaatgtaatccatcacatataacaggctaaagaaaaaaacttttggtcatatgagtaaatacagaaaaagcatttgacaaattcaacactcattctggataaaaactctccaaactcaactgtatatagaacatctacaaaaaatctacagctaacgttataattaatggtgagagactagatactttcccctcaaatcctgaacaagacggggatgtctactsttactactcctagtcatcattgtcctggaattcctagctaatgaaataagagaagaaaataaaatgaaaggtatacagactggtaaggaagaaatgaaactgtttttgttcacagattacatgattggctaggtaaaaaatcttgaaggagttgaacctttggrgcagggttacctggcttttgattttaaaagaacaaacaagagaaaaacagaatttgagaaggaagaaagccaattaagagacagaagtttatgctgagagggactttccccaggctaaaatgattcttttagtcyggacagagaaaggtcagtgagtcccttcagagcagggacctactctagtttctggtactctctgagtaagtatcagggcttcagaaggaaggtctgcatggagcacttggaaggttgggttccaggcccagctgcttgttcttggtcaaagattcctatcctctgggcccrcaatgtggccacagagtggtggatctagaatggtcatgtggactacagacagatgccggtggcggagtgggtgccatatcttgatcctgtatttggtcaccaggtaggaaggacccaaaatgtctgagataaatttcctgtcagtccaatggagctggggtttagagtcatattttatttacaaaaaataaagggatgtggtatttcttgtagaatacattgtttctaagaaaataaaacttaaagcaaaaatcagctatttccakggttgtgaatgcaattctgcccatagataaggatgatttgtgctagtaccttattttatcttctcatttcaggtttctatggttattttactcctctcttctctgttcccattgcctaagtttatttttatttttattttttacgagatttttaatgaagtagcagcactcaacttttttaacctttgctgccaccctgtggctatcttttattactgtatatgaaaggggcatcttggagcttctgctaagccatccaaacaggaacaagtaagtgtaggggaagcatataaaaaacgtatttgaaaataatactgctcggtatctggggcatgaatctgatatatgctatacgtgtcttatgtatcagtatatgtctttcagaatgctattagtctgtgtctaaccttatcayagtactcccccattcctcacttcaaatcaagatgcataactacgctgggaacacagtaattgttgatcctgacttgccacctagtgtcaattattgattttaataaacttcagaaaaaaaatcttcgtaggaagctgaacctgaaatctacagtagacttaattattaaaatagagctctttgtagactttcagttggtctaaaacgtgtcrcattggtgcaaagcattttggctctccctaagcggtaagaaatacagttttaagaagtggaatatccttatagcccatttttcaggaaaattttccatgagaaataaggatgactgtaataatctccttgccacctgtctctctcacactagctctgccacttgttatcatcctaaacaaaatctgatcttgccgctgtgttgtctctaaaagatttcattagcttcctattaatggcagtggctgcttgctatcatgccccatgcagccagtgggagcttcgcctcttctgagttggggtgggggctccccmaggtgctgctgcagccctgcaaacctcagtcctccaaacctcagctgcagacccaggcttcctgctctatgaagcaggcaggagccccgtcctcctgggtggggctacagccgcccaaatgcgcttgtggatatgagcctccctgtgctcccggagggggccgggagtaggcaggatctgctcttttgggtgcagctgcagctgcccaatcctcagctgcagacctgggcctcgcgctccacggagcaggcaggagccagggacacgtgggaacctcccccctttcaagttgccgaggtgggagctcccctggcgcaggacctgggcatctctgcagtgtgcaccctcatgggcccaggaaggtccctcccacactcctgttcgcaagctcaggggtgtctgcttccactgcctggcctctctctgctcctggcactggcttggatcttggaatgaggacttgggagccatgaatggtggcaggaggcagagtcctgggaggaagggggcgggcccccagtaaggccccaccttcagatcaggaagggcctgaaggctgggggccaggctgccagtcccaccaactggagtggggacttgtagtgcctcttcctgcccacccatggtgcccatggaccaatcggcacacacttcctcccctccgaggtccataaaagccctgggctcagccagaacaagataggatggagagaacggagagaggactcaatgggaagaccagctgcagaaaggaaccaccctctctgctcagagcttcagagacttccagagacgggattaccagctgcagagaggagtaactctttccaagaggccagctgcagagaggagcagccccctccagggcttcctctctgctgacagcagatgtcaggatgacctgtctacagagatgacacaatgggaagaccagctgcagagaggaactaccctctctgctgagagattcagagacctgcagaggcgagcaaccctttccaggaggccagctgcggagaggagcaatcctctccacgcttcctgtctgttgatggcagacgtcaggacaacctgtctacagagagctagccactgcaggtctcctctgagctgttctaacgcttagtatagctcatctttgtcttgttcacccttcacttgtctgcatacgggaaaatcaacacccccaaaaatcccctaagaccattacttataaaatmacatgaaaacttctgttaacacgcttgataaatgagtctcaactgatttctctagcctcactttttatcactgccatcaacactgtcctgacttttcaacattaaaccatgtctaactcttttagcataggccccaattgagaactgctctgttttctgtcctaagccttacttagatcttttcattgcaattmgacaaaaatatcagagtattaagagtcagagaccaatcaacaggatgttctctgttccttcgtttcccaccaaatacagcactatgcacgaaggtggcattctctattgtgtccatttgttggggagccctgcaaatctgggccccagctgatgcagctctcttgtgattgagatttacaacaggaatctcatgtgccttatataagagcgtctgcaggcatggctggatccaattctgaggatggagattctctgacccttttattaaatacaggatagtggattattcataatcttggactccattgtattatccaattataagtctattggctctttcgaggacactgagaggctcttttctttctctactctgggaagaaagaaggtagggccacataatctttaaataaagagactctaagcmagaagttttgtaggtgttaccttttctcctccctcagcatagtctgactttgggaagggcaaattcaaatcgtgagcagcactggtcacagtctaccagtgccacatgcctcacacaagaarcggacaatcacgccatgctgatgccaacaggtctcagacatgaactcacccaagggtctcacagatgcctttcctgttttctttgccccatttttcttttttctgctttgcttttacatactttctcttcttttgaacacatcygtccttctgcattcagcctcccaccatcatctgatatctcaaaagaagagacagccgtctccttcctcacagctgagtagcactgagaagtagttaagggtatggactctggagctggaatgcttaggttaaaatcttgcctcatttttcacttggagcttgggaaagtttctgaacttctccaaacttctgtttttcatttaaaaatgggattaataatagtatctacatcataatgtgattgtgaggataaaattacctaataccagaaaaatgcttaaagcagtgccaggcagatggtagatactcagtattgccttttaaaaaattaacccttctatctcttttgtgcttctacattttttwaatctccttagaaaacttgttcctgtacagcaggtcctccaataagattgttcctgttcaacctcgttttgttataatgttgatgagacaatggccagggccacctgtctgtgtggagtttgcgtattctccccatgtctgtgtgggtttcctctgggcacttcgggttccttgcaaatcccagagatatgcacattaggttcgttggcacatctaaatggtcctagtctgagtgtgagtgtgggtgtgagtgtgcctgcgacggggtgtcctgtgcagggttgttcccaccttggccctgagctaccaggaaaggctgtgaccacctgtgaccctgaactagaatacacagcttggaaaaagaaacaaagaatgaatacataatttcacaataatttgtgaaattaatggctaagaatgggatccatcagatgtctaccctgtgaagtagatgataatcatacagatacatggcaataaatgatgcatgatgaaaatgctcgcgaccccaccacatttgttctcatttgttgttgaactgcatgctggtaggaggtgctacttcctaccaaaactttggtttgtaaacatttcttccttgatttaacccatcaccactacggaaaccatccctataaactttataaaattaatcagggaagaagggagggggagaaatgaaaataaacccagcttgcagcacactcagcattaagcactaggtcagcctgtgctcggacctgcttcctcctagttgtttgctgcctgttgccctagaatcacacagaccctagatcgtagttccccttaactgctctacagataacaacttgaacattataaaatgcaaagttttccatttgagatatcctttcaggtgctgcatactaatgaaactactgacatcaactggtctgaaggaccccataggagctgactcaccaaagaatgcagtttccatgtcctgatgaattcattctccttaccccagccaatcaatggtcccaattctccagctcctcaccctccatgatccccttaaaagccccagcccagaactcttcagggaggtgaatttgagggtcccctcacatctcctcacttggtgctctgtgaacgttaaaccctttctctgctacaaaccctgctgtctcagtgtaactggtctgttattgtgcactggtcatacgaatctgttggtcatgtaacactatgaatgctgtcactcagtgattcaccataaattggggagtcgccttgtttttatttatttatcatgtttatttcaatgttcaatattagaaatgttttgggtcttcatttagaagtttggtgatgtttctgtgatcagatatatgctgtagaaacagctcattttatttttaaaatttaaatataatttttattaccaaggttatgtgcaaaattttaaaaaggcaaattttcctatgactctttatgaaaaataatagttcatggacttctttaatctttaatttttatggatacataatagttgcatgtatttatagggtacatgtatttttatacaagcatacaacgtgtaatgatcacttataattgggatattcatcacattaaacgtttattatttatttgtgttaggagctttcctaacacaattctactattctagttatttttaaatggagagtaaattactgtttactatagttgctctattttgctactgaacactagatcttattccttggttatattgattagcctagggtaaaattggttttgttctatgtcatgtcatttaaagttgcagtttctaagaacctatcaatggtgttaagagaggatctactatacaggttgagcatctctaatccaaaaatctgacatccaaagtgttccaaaatctgaaacttttcaagtgctgaagtgatgctaggaggaaatactcactggaacattctgggtttccagtttttggattagggatactcaactggtaagcatacttcaaatatttcaaatctaaaaaattcaaaattcaaaacacttctggtcccaagtattttggataagggatacgccacctgtacttatttatacttctccaataacacgtgattctgtcacacacataaaactgatatccagatgtttttcaacccaaagtcatacaaatggtcagtggcagattttggaccagaagttaagcatttctaattccatgaaattgtcgtaatattatgactcccacctaaacawaacttattaattaattgattgattgataaattttcacctttctgcaatacggagcttctatctagacaggccagtcattttacctggtgctaaaataaaccatttcttctgcttttgcaaaaaatgtttccactcagatatactctacactcttgtcactaatcttcagtttagaagttttttcttggagtgaaactttcccagattgccattacattgctttgcatattctgaggttctgcagtagtgaggctgttgtgaattgttcctaaatttatgctaggtgctcttacctcaatttggatgccattatttgtttattgcaaatacagggtacaatraaaagcagtaagtgcgcatggagtaaatttgcattaaatgaagaaggaatcaattatagagtctctagaaatacatatttatttgccaacctcattcagtatctgtattgcagggacaaaatatccttttaaaaagtcgtgggtctggggattccagccaagtcttgtttatagacacaagcctcaaacattttcttgctctgtgcctgtggagagaagaggaaagcgaacaggatgacttcgggcttgccaaggagtgaatttaattctaattggatatggacagcagcagggctttgctaaaggagaccaaactggttatggctgagaatggaatccatcagatatctaccctaatcacagggtaatttcatttacactcttctgataagaaaatcaggaaaccttccaggaagttagtgttcctctccaaagctgtatagttctgcgttaccttgcagtatgataaatctgatatcaactaataaaagatgtagatgattttgtatttaggagractgcttttgagagcaaaatgaaggcttgggatatgtagagcaaactgcctatcggctgcaggggacactgtattcagcaaatttgcttcatctgaaacacacaatgggagaaaagcttgagaatgggagcttcaacgggacagggctatgtggagaggctttgacctatttaaggactgcaaaccatactgaatcagggcctgcgtgatcacaaaaatgtcagctcactggggaaatatatagacatggtcaaggaatttccactcttgataccattagtataatccgttactctggtggaaaatcaaagcctgctcatgctacagtgttcaagcaaagtactaggggggatcacgcgggtatgtgttctttcagttcttgttccatatttgcttcttttttcttgcatgatatttcttatatgttttcctcatctgaaagacttagcatamttctctccataaatcagtataatacccacgatttatattccagctgaaattttacttggggggtgtgtgtgtgtgtgtgtgtgtgtattttagggatggggtctcactctttcactcactgcagcctcaaactcctgggttccaatgatcgtcctgcctcagcctcctgagtagctgggactactacaggtgtgtaccagcatgctggctgattttatttttcaattttttgtagagatgggctctcacttagttgcccaggctggtctcaaacttctagctttaagagatcattctgccatggcctcccaaactgctgggattataggcataagccactgtgcccagcctcttcatttgctgtttaaagaccactcaacgctatagttctcacccctctcttagttcctactataattatttgtatagttcttaggctcttctttatttctttgcattgctatattatctttttaagatttatgtatgcctttatttataagcacttctacgtaaaactcttggtactttggattattttgcacgactgataggcttacatatcaatatacatgtatattacaggtagttttggcagtagttttgtaggccaaggaagaaaaaataagttatggagacagattaaactgaaaacaagatgtacaagggtttaccacacttttattsctttaagaattgaggtttggcctccacttccacccwtgttgctactatctcaagtgaaataactcagaaacaggaggtcaaatacttcacattctcacttataagtgggagctaaataatttgtacacatggacatagagagtgggataacagatactggagactcagaagggtgggagggtgacagggcaagagggatgggaaatcacttaatgggtacaatgtactctaattgggtgatggctacactcaaagcccagacttcaccactgtgcaatgtagccatgtaacaaaaccatacttgtaccccctaaatctatataaagtaaaaaagaaaaaaaccccaaacacattggcttttattttatttttccatcaaagacaccacactggaaagaactgagtttatctagkattctgttttgctcacctgtcttatagtaatcataggctttcacaaaagcaggtttcagctttcttatggggttgtcttgcagaagagtgaaagaaaaggtcagtgttcaatccgtaacccaagaaaggaaggagtaataatgcggaaccagggaggcctcatctctttttccttagcatcagtcttcatcctttgaaagataattttttagtgggctaataggattcattctctaattcattgtgctccctaatggctcacatagggagcagttggagggtgatgtggattttagagtaggaacctcaggaacttgagcagaggctcccaaaagtagattagaagtttattagtcttttaaacgattaaaataatacatattcctccataatatccaacacatggctctgcctatagtgagagatagattctttatactggcaagctgactctatctatattaatattaatatttccaaatattcaggaaacaggcgtacatcaggggctgttcttttgctgcaaatgaagttgatggaattacactgtgatacractgactgtgagtaatagatctagactgatagcatatctgtttatcatctgtatctaatctgtcatctaccttatttatctattatctatctagctatctctctatgtataatttatctaacttctctcatacatgtatgctaaggtaaggttgatttaatcactgacaacccttggaaacacttcctatccttgattaccaactttcaacatggcttctggatgatgaagcttatttatggaaaagaatgtttatctgaagtatacagaaatattcatatgctcattttaatataaacaaacatatatgttttaatataaacatataaatattcatatgctcattgtaatataaacaaacatatatgttttaatataaacatataaatattcatatgctcattttaatataaacaaatccatacctactggcctcccccaaccctcttgtctgtgacactccaaatcccaggaagcttgcgatgaggaatgaggatgtaaaatatctcacgtgaacagagaggatgtgcttttccaaatggccttcctaatgactgctcttctcgtaccacgtgcttgcctggtgatgagatcccctagaaggactgttcacctgggtctgtctagcaaggctggcaggggccccacctggtccacagaaatcaagatatggttgttgtgcacttctgtcctgctcacgtggctagatctttcaagctaaggaaaataagagaaatcaccagtgttactgaataaagaaagcctgtggggtacaaagagacaaatagactatgagattgaagaagtctatacataaacaaagctggggttaaattcatttaaatgagttcgaagacacttgtccagtaagatgaaaacatatacagagtattatgaataccaccacattagatacaagattgaatattcatatgattaagtaacaggcgtctttagcatttgtttgaaggtgagggagaagtgtcctcacattggatagctagtcatctgagatgatttgcaaagccatctgtctctacactgccattcatctcagctttctctacatttcacagtacttaaagactatgccaatgattttggtacttaattatatcttgccctgaaatgtcatttgacagttttggttacccatgtgtaatatttttatctagaatgtatcagcacctagcacaatgctaaatatatatttggtactatatgaattcaatttccttagattatgaccaatgttgctttgacattattaggataccattgttttattcttacattggattaaaaaaatccaaacacctagcacctatttaccattttcactgtgggtttcaatggataaaaccagatatcaacttggatacatccaagaytagacagctccctgtgtaactatagatataagaaagaaaaataagcctcagtgtcttttgaatcttgctctcagttaaggttcaacataagccctgacatctttatttatttttgtttttatgtttaattttatatatgcatgtatgtatgttgagacaggttcttgctctgtcaccgaggctggagtgtggtgacatgatcactgatcactgcagcttcccaggctccagctatcctcccacctcagcctcctgagtagctgggaccacaggtgcatgccactatgcccggctaatttttgtgtttttggtagagatgaggttttgccatgtttcctgggctggtcttgaacccctgaactcaagcaatccatccgccttggcctcccaaaccaaagtgttggggttacaggtgtgagccactgtgcccagccagccctggcatctttttttttttttttttttttttttttgagatggagtttcgctctgtcgcccaggctggagtgcagtggcgtgatctcggctcactgcaagctccgcctcctgggttcaagccattctgctgcctcagcctcccgagtagttgggactacaggtgccygccaccacatccggctaattttttgtattttgtttgtttgtttgtttgtttgtagagacggggcttcattgtgttagccaggatggtctcgatctcctgacctcatgatctgcccaccttggcctcccaaagtgctgggattacaggcgtgagccatcgcacccggccccagccctggcatctttaagtagctttgctaaccattcctgtgtccttagtggtctttcaactgctgggaataaatagcctttactgtcagtgtgaatggttctgaaaactaactgcatgatagaaccacctacagagttcattaaaaacatagatgcctgttagcccaacgtggtggtgggcgcctatagttccagctcctagggaggctgaggcagaagaattgcttgaacctgggagcagaggttgcagtgagctgagattgcgccattgcactccagcctgggcaacagagtgagactccatctcaaaaaacaaaaaaacgaaaacaaaaaacaaaaaacgcagatgtctgagcacatccccaaaaataattaattaaatctttattgatgagacctggatatctgcattttaaaataaattctacaaaggatgctaaccagattttagaattgctggtatatgtcgcttctttataacttatatgttttggattaatgatgatctttttcgtcacgtgaagactatcttcacaattagactataagatttctctaggtaagagacagtatatttatatttcctgtggttactcgaatatgattttgcttaattaatatgtcttgcttttgtgaaacacatttaacttgtctactgatgatggatcaaattgtgaatattatttccttttttcatccgagaagctaggattaaattcctttaaatgaatttgaagaattttgtatttataaccagagtcatgggttgtattccaagtaaagctttttttattttttatttttttatgagataggatctcactatgttgcccacactggttttgaattcctgggcttcatatgatcctcccatctcaatctcctgagtagctgccagataaagtttttgaaaagtgttgttgaattgggaatcttttttctcttagaaaaatagaattaatttttttttaatagagatggggccttgctatgttttccagatgtttgccaggttggtcttgcactcctggcctcaagcaatcttcctaccttggcctcccaaagtgctaggattacaggtgtcagccaccgcacctggccattgtgcctggccaaaaaatataattttaaaaagaccagaaagacttttctttagaggtaaagatgaatgagcctatgttaaagtgtcattgaaagaaattattaatggtcagtcgtggtgactcacccctgtaattccagcactttgagaggcttaagtagaaggatctcttgagcccaggagtttgagaccagcctgggcagcatagcgagaccctatctctacaaaaaataaataaataagatgaaaaagaagttatttattcttcgatcatgatggcaggcaatcaaagaatcttggaggcatactagttagagcttttaaccccacaggtcttcattgtccacatcggtgatgaccatttttttagtagacaaggcaagaacttaatgaagagaattactttacgtttcttgaatttactactgaagagttataggtagctaatagctaatattttcgtagctagtgttgggacacggaaaccaaccccccaaaatatggtgctttgatgggctgaactgtatagtatatctgatatatttatatagtgtataaaaaatcacctgacacaatagatggataatatatctgatatatttatatatcgtataagaaatcacctgacacaatagatatgtaatatatctgatatatttatatattgtataaaaaatcacctgacacaatagatggataatatatctgatatatttatatattgtataaaaaatcacctgacacaatagatggataatgtatctgatatatttatatattgtataaaaaatcacctgacacaatagatggataatatatctgatatatttatatattgtataaagaatcacctgacacaatagatggataatatatctgatatgtttatatcagatatattatacatttatatattatacatatacatttatatatatacataataaatacattgtattatacatatatgtatatattatacatatacatttatatgtataatatagttgacatatttatatatttatatcggatatattgtacatttataatatatttattatattttatattatagtatattatcatttataatatattgttatatgttatatgatatatatttatagcagacatagtaaatatctattgtgttaggtgattttttatacaatatataaatatatcagatatattatacatttaaacagttaaacacctaaacagcccaattttatgtggatcagtactactaacggcttagggtaaaatgacagctacagcrtaactagaatgttaaagtggcatgtctcagacaacgtggatggacataaagtatttgagagaatattgcataatagaaaaaaacattgtaaagactaaaatactaaataagacctttttttcccgagcaataatttgcccaggctggtctcaaactcttggcctcaaatgatcctcctgccttggcctcctaaagcattgggattataggcatgaaccactgctcctggccagaattcttgattaaacaatagggtctaaataaatttaaaccccttttattctttttattcttacagggtagactcaaatattctatttctttccaactttatattcttgtcataacaacccagtattctctgaggcaaatggatgcttatgaccaactggcctgaaatgggggaatatagggttagtggtgagtcacatataagaaaatgcaagagaatagcagtgtatcatatttcaaaataaaatacaaactatacataaaactgaccccaacaagtatccatttcatttcctgtcgtgtatctatatgctttcctggaaagaataaacttcagttcacaaaatcagatgtagaagatacatcacttttaaaaattctacgtaattttaattccaagattcccatgccaccaggctggtgggaaatccagttttagttgtaattaggccttttctccagtattacatatgaatttgagtgtaataccccaaaacttgagaaggccattgtatctccagtccactggggcaatgaatagcttgagcacctgatcattataatgacccagatgtgtatctttttcttttactctgcggtgagtttttctaagggaggaatcctattttgtttaattttgtattatagcatgggatattgtgcctggcagatagtaggcaatcagttagtatttcaggaataaacactcttggtcagtgatacagctaatgatttgcaacaagcatatccttaaagtaccttttcagtaacgatttccatatgaacaaagaaaaaaactagaaccaagaggtaaaattataatcctgttgtcttgttcccatagccatactctgatttcttttatgttctgtgccctggcttgatacttaatttgacagctaattataatgtttattaagctctgaaatatactttctcctggcctttttgtctgaagttgtttgaggtgtcaccatggttggaagttaagagcatggaagctagacttcttggtcttgaattctagctttgtcactaacttagtaactttgggcaaattacatgtctctgcttcaatttcatttgttaaggtagtacctatttcacaaggctgatggtggcagcagtggggcgtccagagctgccgctgccatcacgccagctgcagcagggaggggcgggcagcggcggcggagcagctgcgggagccgcagtggctgctgtgggacatctgtgcctcgcgtcccctgtgccttgagaccccaaagcagccgactgcgccgccaccatcctcgcgttgccgggtggggcgacgtgctccccggccaggagcctccaccgctccggaccctggccctatgtcgccgctctcgcccgccgccgccgcggagtgggagtggggaggaggggaacagtccttggagccggccccgggagtactcccggagcctgccgccctggaagccgccacgatggaccgggctgagtcgcccgccggaggggaagcagtgtagtcgggcacggaggggcaggcagagaggggccccaaggcggagctgggtccggggcggagcggtgttcgcacacaaagcgctggggctggacccagggttcggggccaaggcgagaagtgggagcggggcccgctttggggacccggacagcggtgtggccaccgcgcacacctccgacagcgccgcattcctgggccttgggaggaggctctgagtagggccgcctggggcgcgtcttcagggtcctcccggcactggggtgaccgccgagctagacgcgcctgagggctgagccccagggctcgtgatctgctcccggaggcgccccccaggcagggccgtgagccgggcgagggagagtcctgggctgcccctgagccccggggccacgggaagaacttgcagcgacgtcatccctgccccggacacagtcccgggcccagggaggacctggaacattcccttcctcccccscccccccgcccccgcccatcagcccagcctgcaaggaggcgccaccggacctgcacactcaggagcaggtgagccagggacaagcaggagccccgccccttccgaactggtggagcaggagctcccagggtgcagctgcagccaccttgccgcggctgtggacattttctgtgctctcagaggcccagcaaagtcccctgcccactgcaggctccagggtgcctactccggctgcctggcttctctccactgttagcacccactctgaactcagagcaaggtcgggccgagcctgggtactgtcacagcctggccgagcgtgcacacgctcaggacagtgctgatacgccagccccctgccgtctcggccccctttggaacttgggcaccaacaagcgtgggagggaggctgagaggggtctgaagacagctggacactgacttkcaggcgctccttggcatgaacagcctgggagcaggaggcagacaggttcctgggtggaaggggatgggtccccagtgaagtcccaccctgaagctggtgagggcttgaagcctgcagaccagagaggtaacttgtggtgctgctccctgggcccactcatggctgcccatggaccaatcagcatgcatttcctccctctgaggctcataaaatcccccagactcagctagattggaagagaggatgggaagacaatggatgacctacctgtggagagaaactacccattccagaacctcctctctgctgaaagctgaacactcaatgggaagacctgtttgcagagaggagccagccactccagggtctcckttctgctagaagctgaacactcgttgggacacmcttgctgtggaaaggacatccttactgtggaaatgagctactaactgcaggtctccttcctcttcatcttccttatccttctgttccattgctcagtaatgctcctcttcatctgtctcattctccacttgtctgcttgatgcaggagctgaggagctgcacagcaaggttaaaagagctgtaacacaaacagggctgcaacatgccccttgctccccacagggagagaagagctctggccctcggagaagcccagacctgggagctccttgagcccgggctgtgactccctctttggggccctggttggcgtcactgcattcgccagtgccactgttggaagctgcttgtgatgcgcctggtccagggggaagctgtttgttgtgtgcctggtccagccacctcatggagagcctgtgctggcacctggagctgcccaacctgggcagcagcttgtgtgtgtgactgcacagtggccacgcttgctcacacacccctagcacacccctctgctccacccgtctcaatctcccttggatccgggatccaggttggtagcaagtgcgagtgggcagaagcagcccagtgggcccagagcaaaactcaggcaaaggtgccactagactggccaggaaagcgacaccctaaagatcccataatgctgatatgttaattctattctataagcaccacacagaagtgatagcttttatttcttattttgtctagcctggagacagagctaaggattccttgaactgcaaagtcttttccagttcttagtttatacaatccatactcaccttctgcctaactaagcattgtcatttttgtgccaaatgaagagtaggactcctacgattgtcctcagactctcttggctcaatcctcctgctttaacctttcctacttcaaaaactcctgaagttttgcttccccttctatagaatggaaatatatgtcgcaatacttactgcaaagaaaattatatattttaaaaatagactaaagagatgttgtgagacatcagacatcaatcagatgttgtgagaactgatttctgcatcagaatatctccttgactttacagctatcctttaatcctggctcaaagttccagaagaaagatgatccaatataatactcctatttggactttgagtcatacacattccttcttctgagaaaacgtgcttctgcatgaatcctcccttcattattttcagctcatctattattgaatctgaaaccccaggttaactgactgatcactctcatcagtggcagattttgktgtaacataggacacatcactcccaattcaggtcaagtcccaattatcttgcctctcaatatgacmtgttcaatgttgtatttcattctacttcattttaatgtaaaaagtcttttctggtgaagtcagtcttttattttctcataaaaattcaccctttgggtttttcatagggtattcccataaccaaacacactttacactttcctagtacataacccaatactttcttctttccccacagtccttacatgaagcctactcagaccgacatcactgtatcatttttttgtattctgaagtccttcagcacttgattcctttaagtttaatcttggtattctattgggaatcatatggaaatgtacaatgatatttattgaatgaacaggaaacagggaaagacattgaccagaaaaagtgtttattcatcaagtctttaaagatacaaaaacacgtgtcttctgkggagctcwgaraacaggactccagcaaagcacttttcagccttgtggtcttcaagcatttccaagatctgtgacattggaaagaaaaaaaattaagacagatttgggtctccatgagcagagagtattctttsccttagttctgggtagcatagtgcccaaggaaacctaatcagtacagwgggaaaccaaatctattccaaatcattacccataagcaatcctatggactctctgaggtttgacagagtcagcggccctctccaataaatgtgtttttctataataatgtgcagtgtgagtaatttgatgtttttgacaaatatttacccagcgttttatgaaggagaaggtttgggggacaagctgaaggagctctgactgccttttggaggagtgtgagtggcttacctttgctgcaaggagcattgtactcagcaattgcaaactcatctgaaaaaaaaaaaaccaacaaaaaaccagaaatcattacatgaagtgagaaagaaagcaaacatctgtgggatacaggccaaggaaggagtttgttgtgggaagaacagtattgtaccagaaacataagcatcattcatctgatgtgttgcttgctaccttatattctcctttcaaatatagtgttttatatattcttttatcccaaactcctgaaggactcttcagatgttctacttacttaaatctcatattgtcatacagtccatttatctgatgaaaagggaactaaatatcccacaggtgttttgtattagtagttgataaatttataatgtaggttgtttctataatgtatgtataagagacaaaaagaggrgcatcagacttgatggagacaaaatgaagtgataatgtaattacttaatgtaataaataaccccaacacatctcctaaacctgaatttctgtgatcaggaattaaatatttctacgtgaaaatcactctcactcacccgtctcgtagtaatcatagactttcactatggctggtttcagatctcttactgggacatcttgcagaaccgtgargaacaagctcagtgtctgatttgacacctggaaagcaaaagtcaattaaatgacctttcaggaagctttcttctctctttgaattagtttaagtattcacctgttttttgggggaaaagctttattatcctacagcacactatagggtccttaattaaattgtgcagaaatctctcagaggggatgataaattctccagattatttcttaaataactaacataaygcatatacctctgtcaatgccaatacatagctctgttcatgggggtaaatgatatatactttttattggaygactaactgtgttcattttttaatatccagagatttggtatagtttgacttctctgtcttgcaggaatacttgcgtagactcaaagaggdtctaaaaggttgatcttcccaggcttaagtttcataaaatttgtaaactataattcccatcaacttatgcatgaacaaactctcctaccacacatatctataaaatcagattggtttactggtgaactggtcttattattttatggttcaagtccttgtggagactgacagttttttttccctttcatattgttgttgagtatgttgataattaactaataattgactaatcacaagggctacttccttrtattactgggtatccaaaaaacttgtcaacataataaacacattttgtsaagatytcttgcttatgggattttaggaatattcatatcccaagatcataataagccatttctacctgtaatccctggtgaaatataaataaaggagagaagaacattcttttagagttaacattagaattctcaaatttctagcatggaagtgatgtttctaaaatgcatttaccttcccagatgttyccttagaggattattatctacgtttttttgcaaatagactggaagttctcttaccttatcaaggtaaatcaagacatggttgctgctgacttctgtccggctcacatggttagatctttcaagctgaagaaaattgaaataccacaaatgttaataaatagatgaaacccctgggggatccagagaaaaaatctttgtattgccaaaataaccctgagggtagaattcttcaaatgctttttgtaaggaaatatataatgtaatacaattaaaaatgaaaggcataaagggtttactattagtataacacacgactaatgtgtaaagttatttatctgaagaaaagacagctaagtatcctaaacttggtagttactcatatttcaaagttcaattcagtttctatttcttcataaggagtttttttcctgttttgcttgctctatttttcttttaacttctgtaatacttatagtttatgccaatcagtcattttcatatttttcactggttcgtgttcatatcttttatcttcttagcaaaattctaagctaagaagaaattgaaaagcaggaacctgctgacaatctttttcttgtagtcatgggtcctagcrcagtgctctgcacatggtcagcattcatacaaacacatgtgattrtatttctgagctggaaaaaggataaggctttgatagagattgactttaatagtattttgatattagtattgtcttatgctggggatacatacatcattaaataaaatagggcagtctggggttatgataaacctaccattttcactgttggcttcaggggaatgaagccagagaccatcttcacatcaacgatcgccatgttggaggcagagcggctccctgtgtaactgaggatccaggggaggaaaggattagggttttctgtgtttttaaatattttcttcttctatgtccatgttaagcattccacagctctaaaaggtacacgtaagtcttcccaaatatcttatcccagtggtttgtaaaagtggtgtgcgtagaatttttaggaagcctgttaaagccacagagaccaggccctactctagacctgatgaatcagaatgtctagtgtatgggggctgaggatctgcattttttttttttgatggagtttttcgctcttcttgcccaggctggagtgcaatggcatgatttcggctcaccgcaacctccgcctcctgggttcaagtgattctcctgcctcagcctcccgagtagctgggattacaggcatgcaccaccacktccgactaattttgtatttttagtacagacggggtttctccatgttggtcaggctggtctygaactcccgacctaaggtaatctgcccgccttggcctcccaaagtgctgagattacaggcrtgagccaccacgcccggctgaggatctgcattttaagaaagctctacaagtgatgcacaggctgtttgtgacctctaatctatgccagttattttatttatttgtttacttttattttctttcagctgacaaaatgatgtatattatgaataataaatttcagtctacattatttacaaaaacaacaataatttataatgtttacttaaacactggctttcaacaaaacacttagaaacacctagcgtcttgtcccyyagagtttgcatccgaaatttggactgcttaatttattttttggcatatatatacaccaaattaaatgaaaaaaawatatatatatatacttaacttttaggttcaggcgtacacatgcaggtttgttatataggtaaactcgtgtcatgggggtttggtgtacagattactttatcacttgggtactaaattttgcactgaattgttgtttttttctgatcttctccctcctcccatccttaaccctcaagtaggctctggtgtctgttgttctcctttttgtgtccatatgttctcatcatttagctcccacttacaaatgagaacatgcagtgtttggttttccattcctgtgctagtttgccaaggataatgacctccatctccatccatgttcctgcaaaggtcatgatctcattctttttgatgtgtgccagttatttgttacatgtattttgtcctaacttttttcctgaatagtatctccaaccaagtaataatatgtttgtggagagagagttttttatcagatctgcagctatttaaatattgatgcatataagtgtatcttccccccaaattaattatatcatatataacctgagatttattattgccagtaggaattctaactaaggagtcactacttccttctattcaaacttttcaataattcttcatctctatcttcaataaagcaagaataatataggatttcattacataacaaggaattcaggtcagaggcaatgggtaatatttacttagttgttattgagggaaattattaccctttaaacaatgaggttgcacaatagtagatcctggatggacaatgtaaaccccatcattgagaaattatatcaacttaagagaatacattgcattttttgtgaatagtgcaaatatctactgttgcactgctttacttaaagaggagttcccgaaagaagactggtggttattcttaggattaggtgatagagtcagaaggtcttacctgacacttagggagatttggaagctggtgtgggctttgggttcatcacaagtttgaggcagagtctgcactcctaaagcaaaggggaactcttccttttctgggagaatattgtatttcaaggatgtctatagaacatcaaagacaaaatcagttttttgccctttcccagaattcctgtccaygtccctaaccctttctctgatctgtcccattgttttctgagttaggacttctcagagagaacagctgctgtcctcatctgtcctgtcctcacctgcccaagagtctcacctggaggtagacacatccttctcctgtcacyttcatgctgtattccccaggcagctctggcaatgagacctgctgcagtaacaggcggttgttgttgtccacttggaatttgctggaaaatgtccctgaagactggatagtcacctgtgcagccttcccagtcctggtaaatgtggctgctccatatttggacagagcatggagagccaccactgtgtcctgttagagacagatgagtgagagaacccattgggcattataaggctttgagggctgagatatttttcaaagacccatgtgagggactttgatttcctacttccctcactacttaaatataggagctgtaatttcaagattgattataatctttagatagttgaagaaccataacattcacatatctaccttggactgtatgccctacatgtttattttatttatcagaaaattgatccttttctctctgtaagtatatgtgggacatggaatgtggaaaacatgtgaatggcaatcagttattggcatcagctatttgctaacatgtctttcttgacaactatgctcatatctgccaccactcaagcaaagttcagtctggctctctcccatattaaactttgctcagttgctgaggtcagtgtcctggagagaacccaaggttctttgcagcmatgagcagagtcatgcttcagtttctccaaaagaaataaaagatgagtattataattatcttctggatttaatgacatttttatttggctttccctttttattggatgatttcctgttcccagtgaatgtctgctggtatgtatcctcaacaacattaaacctgcttggcctccttcaaataatatgtttctaataaatgaatgataacctttaacaaaattacttagtttttttcattcatatgataaaagattaatacaatggaaataggatggaatgccattttgtcacattttttccrttttagggtatataagcaaacatccraattctctgaagataaaactttctgctgtgtacatatcaatgaattgttcagatacatggttatatagctagatttaggaggttggatgaataaagacagttctttatgctcctgatgaataaatgtttgtgtattaagaggtgaatagggggctggacgcagtggctcacacctataatcctagcactttgtgaggccaaggcggatggattgcctgagctcaggacttcgagatcagcctgggcaacatggcaaaacctcgtctctactaaaaatacaaaaattagccaggcatgattgcacatgactgtaatcctagatacttgggaggctgaggcactagaatcgcttgaacctgggagatggaggttgcagtgagccgagattgcaccactgcattccagcctaggtgacagagcaagactctgtcttaaaaaaaaaaaaaaaaaaaaggtgaataggggaagcacaaaatgtgtagttttgagaaaagcctattaaaggggacctaagaatggagagatttgcgaggagaggttgttggattttgagtagagttcctttgaacagtttgaaagagaccctagagctttcaggagaatggcaggagacatctccttcattctgctggtgctccactgctgcttgaggaaggcagtgttgttatgggaaataggagatggataataacacagcgatggggtgccggrattctgagcatttccttttggcyctctttgactttgatttgcttttatttccattatccttggatactgaaaacttttcctcatttcaagttactgwcatctgtatttttttcttcttggatgtgtytgtttctttttcattcaaatcttttgctacctgaaggtgaaataaaaggttttggcaaatcaccaacctgggtggaggagaaaccgccctgggcattctgctgcttcrtgatccacttcacgatgttggttgcagaggtcaggtcctccgaggttggggctggctgggccgtgagataagcgaggagcacataggatgtcatctccacctcagcagagggagcctggggttcgtaaaaatgccccactggtgccttgggtttctgagggcgctcccaatggacagagttgtcttaaagatgagaaaaagatatttataagtgcctacatatttatatttaattcaaggtgaaagtacccaagccagtgctgaaatgagaattgcatgcccattataatcccctgtactgtatgtagatgcttttcccttcatgtaaatctgaatttggtgtgttttagcccagctaaggcagatattgatgctggagtcagaagcctatgcctatctatgttttcaaatcgttgctatagtcgggttggtgggagaaagaaatggcacagcagttgtctcattgagtctggctatttcctatttatgatgttatattagactatagctggagtttgttacatttcctataaagtgtgtctttatcagtttcttgtgaggatcacagatcacatgaaatagtagagtttgtactcattaaattgaaaaaaaaaatacagtaatccttgaaataccaaaggctgacatggatgtgaaacaatgggaaccaawatacactgctgtgggaagccaactgctctttggcaatattcagcaatggggaagatgtgcttagcccactaatcagtcattatgcttctcaaagcataatttggagaaacacagatgcacaagaaaacaggcacatgagtattcattgcagcattktttttartagcaaaacataaaaaaaatccatgaggagaaactcgatgtgtaaattatgactaatttatagactgtaatatattatgcagcagtgaaaattaatgagctgactctgcacatactkgtataggggtcttcatcaacatagtgttgaacttagaaaataaaaagcagacaaacaaaaaactaagctgctgaaatattcaaaaatgtttctcttgtttcttgaayaagagagaaataaaaatcttgtttctctcaagatgaaacacaygtgaagattctaaatattagttagggatacatatgcagcaaaaatataaggaaatccatggaattgtaacracaaattcaggataatgattgcctctggaggtggtagtgatacacaagggatttatttttcccaygtcggtaattttctatttcttaatctatgagagagytgtacagtgttttctagttatagcttatgcccttttgtatatctattataaaatatttctcaatacattttaagaagaattaatggctgtcaaaggaaaaaggtagactgttttaatggacatcttgtgatttgcattttattttctatttcttcaacygytcatatagaccatggtatatgtagaagtactgtgtgaatatgagtagattggtcaacattattggtcttatgaaatgggcttaaaataccagaattcattcaaggagttacttccatgattattttcttatgtttaaggttatataatgtaccaggtaagggttgggcatatattgagaactgatatgttarttgtaataactagtacttttataggatttgctatgtgacatgtactctactaagtgttttacgtgtaccaattcatttattacaacagctctgtgaggtaaatactattattatccccattttactgatgaaggaactgaaacacaaggaagttaatgactttcccaagctcacataggtagcacattttggagctagtctccagagaatgctcttcttaccagcatactatagagatggtccctgacttacaatggtcccacttaagattttttagactttacaatgagtttgtcaggatataaccccatcgtaattgagaagcatctgcacrgcctcttgtcttytgatttctgatttgattaagaaatcctagattttataagatgcaatatggacaaaatatatatgatatatagaaaagaagagaggagacagggatcacaggaggtaggagtgagggatttttgccatgcagttcttgatacagaggatgggccaggagaaggatctcaggtgtgctctcacctttcttcacagcttcctcattaagtgacttgagtacttccttcctcytgtcctggttacctgccagggcaaaagcataggccagcagtgctttggtatatacatggctgccatggtccccttcttgtgctgtcttccaggctgactccaggcaaaacagggcattgcggacaacagggtgctgtgaaggcagaacaagaagggaactaagctatgtaaacaggcatattagcattcccaggcaaatacacggatcacagcacagaagtttttcaaaygcatttttccaacgattcctcattcttatcaatagatataatattatttttatctgttattctcacattcaaaagatacatctttaagattcttttttgagtggtggtggtaaatagcctaggggaattactgggaaaatttaaacctttcttaatgggctgaccaaattctctgtagatctgggaagcactggcattgcatagaaagaaagctgatgctttgcttttaataggatagtatttcagacagcaggtcagcagtttcattgcatccagaactctccttcagcagaggaatggggtggtacctacagtgactgtgagaggaatctccagaagggcgatggtgatataggcggagagggtcacttcatcttctactcctccctgtgaatacragagagagatytgaataattcaacttctgagaatgctattgattagttctttctattctgctgtgtcatggaattcatccttacccatatccatccctataggrcaaagtatcacaatcaacttttgttctatcccctcttttttggtgccatccaggttttattttcctctgaggctttcccttagaatttttcacattatcacttcctatcctcatccttgcagatatcataatggacaaatcaaaactagctccagaatgattcacctttatggcattgttgagcagtgacccagagctcctgaaacagccattgtccttctgcctctgggagagccatatgagggcttgggtaatgtgtgcttcatcgatgaagatgtaggctcgagcttgggcaaaagtcttcagaacaaaggctgtgagcctgaccagggaggaagcaatcatgatgtttatgttgtcaaaatggttttataaccacttcacagcaacaggcttcatatgatgtgagttagctaacaaaattcttgtgtacttagagakcttatctccttgattaatctttagtctgcctgattaatctgctagatgtagtatttccttgctaactctctctttgccacagggagtctwagtatatttaattttattttagttccgagatacatgtgcagaaygtgcaggtttgttacataagtatacrtgtgccatggtggtttcttgcacctattgacccatccgcttagttccctcccgtcaccccacacctcccaacaggccctggtgtgtgttgttcctgtccctgtgtccgtgtgttctcattgcttaactcccacttatgagtgagaaatgtggtgtttggttttctgttcctgtgttagtttgctgaggctgatggcttccagcttcatccatgtccctgcaaaggacatgatttcatttctttttattgctgcatagtattccatgatgtatatgtaccacattttctttatccagtctgtcattgatgagcatttgggttagttccatgactttgttattgtaaatagtgccgcrataaacatacatgtgcatgtgtcattatagtagaatgatttatattcctttgggtatatacccagtaatgggattactaggtcaaatggtatttctggttctagatccttgaagaatcgccatactgtcttccacaatggttgaacaaatttacattcaagtaatttgaatgtacttatttttgttagttacttgagtaaggctttaaatctctcttatctttagagatttccttctgcagatgacagaatcttctcacatgcagctcttacatgcagtaaattttaatattgctttactttagggatttaaaaaaatgttttatattactgtttccttctcaattgtttcctcttattaatgaattcattccaagtcaagctgaatgacttagaatgtgacaatataagctgaagttaacatggtttatctggaagttatatatgttcactggcaatatcattttaaaactcatggttatggtagctactttagaaagaatagccatttcagaaagaaaaccttggtacattattaataggatccattytggaaacaagcctaacataacatgtatttggatatcaggttttcttctgattaccttgctaatcttggtggatttatctagtataacaaaccatcggtctgataatacatatctgatagtgttgctgtgaatataattgaggtaatacatgtaaaagagctggcacacaaaaagaagctcaaaaaattgttctttccttaccaggtgttgccctggttcctgccatatcgctccccaaaggtgctgtaggagccatcatagtgtttgtagttcaactgtctctggtaacctggaaaggaagattaacgaaacagcacaatggattaatgtgcatgctgagggtggagaaattactaaaagtaccttggcttctcttgtgacatttcttaaattttgttgtcatagattaggagtttctgagccttaaatattttattggaggttggagagtggatagtttccttgaaattaactatcatagcagctatcatagtgagctaagctaatgtatcataatattcataagtaactgaaacctactgggaaatccagttgaaataacattcaagttttcccttactcaagtaatcactcaccagtgttgagatagccaatggccttggacttgayctctggagtaagctgctgtgtttcatttagataatccagtacatagatgttaggagcaaagaggaccatattctgctctccayagccatagggcatctggagaagattttgtgtgttttgcatggcagagcctaatatgtctcctagagaatgggagagatgggaagtcataaagcttggagattatcatctatcaaagtcattaagcagaaataattagttgagcttagaaattgagaatttttaggaaggatgattcttccagggatagaagtatgattgaaagcaataaacaagcccaaagaagaagagaagaaagaagttaaaattatagtattatttttagtaaatatttatgggaaataaaaatagtataatagaagctgttaatgcccggatccactaggggctggagactcacccaaaactgagacagaagctcgggcagattcttctaccacatttggtggcagtttcagggataattcttcagaaacctcaccacctagagaaataagcaaatcagacatatgaaaattatttctgcattatatstttctaaacagctctatgacccagaagctaggactatgccttatacctaaactcctcctgaaaagttgtccgcctttaatacaacagtaatatataaatatcttaaaaatgggctactggtttcctgtgattttcagaatttcttcttcaatgatcttttcagtaatttatgtagaatcgcatgccaaataagacaacaaattgtaagagcctggtgatgttgtgattcagttgctgtcwwctgatggctgacacaagacggttatcacaagatgatctatttagttcccaccaccaacttccttactcaacagttgtatggagaaaacaccaacaacaaagccctataagtatacataagtaaaattacccacaaaaggtcctgaattctataataatgctatgttctttcttcaaatttcatatacaaagatagtatttttatggaaaacctagaaaattgagggtaaggaagtgaagacgaacagtatttgatgcattgaaaataaaataattactactcatgaacatacatttacttccattttaatcttggtaaattatatgaaatgaaaatgagagaagtatrgtatttattttcatactgaatcccttcctcataaaattcatattaaaatgtttcttaaaaaaaagccataagcatagttaaaggacaaatggctaagcaaaataaaatgcttgactcactgaaaataaaataactgctaytgatgaacatacatttactacaattttagtattggtgaattatatacaaatgaaaaatgtagcagttatcttccctttctcataaaattaatgttaaaacttttgtaaaaaaacagatgccataaacaaagttaaaaaaatgaccaagtgaaagaaaatatctgcaacatattcaacagataaagaattagtgtcatacaactgagtcagaaaaaaactactcaaaagacaaatagccaaagattataaaggcaattaataaacatgcaaaaataaggtcatccttgtaattaagaaaatataaattaaaacaacagcaaaatttttttttctaaatttttggcaaaaattaaaattaaaaactttgatggtaacagatgatggcaaatataacactatggaaatgtatcctggtggaagtataaatgcatttaggtaataaagaggaggattttcgttttgtagttcaattaaaattcagaataaagcaagatgatggactagaaagtctcaggatcttcctccctccacagaaagtccaactagctgctatccacagatcagaaaatctattttgaaaaccccaatacttggaaacaagtctaggacacctacattgttcatagaactgagtgaagacaaattagaagagtaggaagaatggtctcactttgaccatgtcattgttcccactcctttaggttagcacaatgccagatagagaggagttccctggggtcacagtttctacagcggggaagagaaccaggggtagacatcaagattctcaagtattcaaagacacttctcaggaagcccactctggtctcatttcaccgggaacacaggaagtaatgaggtcaggtagaaacaaagaaggacagagctcacagtgaccagcatgtggattttggtagtgcttctgtgtttctgccagctatggcacccattcagagataccagccaactgcatagcccatctgcaaaactgagctggtcactttcagaagcatgttgggaagttcaacctagcttgagtttccagatggccagtctgtaagcccagcttcagaggttatgccagtgaccccacccaggtagcagacaccacctctgtgtatttcatagaagtgtaggggttaaatatgcttgacctgggagtctaaagggtagctcaactcagccaaaacctcactccatggctccattcacaagggtggggtagcaatcctctattatgcacatctaagaagtatagtatttatttctgcccatcccaagcaacaactctacctaacctcacagcccggattgtgaccctgcctaacttcaggtcccaaatagcagaatcatccagccaggcaacacatcttgtgactggcctgaccagaggccattgtagtacccagccagcagctccaccagatagcagagacaaaacagtgatcttgccagagagcaaggcccaaccagtggccctaccaaacataagrgcaaaggcagtggcccagccaactagggaacccatgaaaactctgcctgctcaaggttgtcaccaactgatctttccagaattataggctagactaaatagcaaacctttatccctgccaaagaatacctataaaaaccagaagaagtggctttctcctcaaatgcacaaacaatgcaaggacacaggattatgaagaatcaaggaatgatgacacctccaaaagaaactggccaagctcaaaaaattgacctcatagaaataaagatctatgaaatcactgacaaagaattcagaataatcctcttgaagaaattcagtggactacaagaatatataaatacaaaattaaatgaaatttgcaaaacaatacaccaacaaactgagaagtttgacatagaaacgattgtgaatagtgccacaataaacatatgtgtgcatgtgtctttatagcagcatgatttataatcctttgggtatatacccagtaatgggatggctgggtcaaatgtatttctagttctagatccctgaggaatcgccacattgacttccacagtggttgaactagtttatagtcccaccaacagtgtaaaagtgttcctatttctccacatcctctccagcacctgttgtttcctgggacatggatgaagctggaaaccatcattctcagcaaactattgcaaggacagaaaaacaaacaccgcatgttctcactcataggtgggaattgaacaatgagaacacttggacacaggaaggggaacatcacacaccggggcctgttgtggggtgaggggatgggggagggatagcattaggagatatagctaatgtaaatgacgagttaatgggtgcagcacaccaacatggcacatgtatacatatgtaataaacctgcacattgtgcacatgtaccctagaacttaaagtataaaaaaaaaagaaatagaaacaattatctgcaacttagctaatattgtaaaataaaaaataaatagaaacaatcaaaaagaaaccaaatagaaatcctggaaataaagaatacaatgactaaaattaaaaattcaaagtaagctcaacagcagacttgatcaagcagaagaatcagtgagctcaaagatagagtatttggaattatccaggcagaagagcagaaagacaaaagaatgaagaaagcctatggaaattatgggacatcatcatgaaatcaaacctttgcattaaagaaagtccagaagaagaagaaagagactataaagcacatttaaagcaataatgaaaaaaaagagtatagaatcagaaaaaaaaaaaagcagtaagggctgaaaacttccctaattaggggatagatgctagcatccaagtacaggaggcacagaggtctccagtgaaattcaaatgaaagaactgctcactaagacacaataattaaactatcaaaaatcaaagacaaaaaaaaattctgaaaagcagaaggtgataaagaaacatatcacatacaaaggaattccaatacaactatccatggatttttagcagkaacccggcaggctgagggagagtggaataatatattcaaagtactgaaggaaaacaaaaataaaaacaacatggaatcaagaattcttcatccagcaaagctgtctttcagaaatgagggagaaataaaacattcccagacaaactaaaagctaagggagtcgtcaacattaggcctgccttcaggaattactgaagggagttctttaagctgaaacaaaaggcccctaattaataatacaaaaacacaaaagcacaaaatttaatggtataagtaatatagagccatattcaaaatactctatgactgtaatgatggtatttaaagcaattttatctctagtacaagggttaaaagacaaaatattaataacaagcatagctaaaaataaattgtcaataaatacacattacaaaatatgtaaattctgacatcaacgacataaaatgtgtgtgggggagtgaaagaatgcaaagttaagttgttatcagcttgaaattgactgtaaaccycatagtaacagcaaggcaaaaatctttaatagaagcacagaacaaaaattttaaaagattcaaatcataccactacagaacatcagaccacaaaggaagacagcaaaagaggaacaaagaagcaaaacaaccagaaaacaacaaaatggtagtaccaagtcatttttaaattaataattaccttgaatgcaaatggactaaattccccatttaaaagacataaagtgactgaatggatttaaaaaaacaggaccgaaacatatgctaattacaagagactcacctaatttttaaggacacacatagactgaaagtgaagagaaggaaaaagatgttctaggtaaatggggactaaaagagagcaggggtagctatacttatattcaacaaaacagacttaaagtcaaaaactgtacaaagagacaaaggagaacattatataatgataaaagggtcaattcatcaaaaggatataacaattgtaaatctatacatatccaacattggagcacctaaatatataaaacaaatattaaaggttgaagggagagatatgttgcaatgcagtaatatcagggaatttcaacatctcacttttaaaaatggatagattatccagaaagaaaattaataagaaaacgttgaacttgaccaacactttagatcaaatagacctaatggatacatacagaacatttcatctcaagcacacaagaaacattctccaagatagatcatattttagcccacaaaacaagtcttagcaaatttaagaagactgaaatcgtttcatcgtatcaagtatcttttctgaccacaatactatgaaaactagaaatgagtaacaggaggaattagaaaaaattcacaaatatatgaaaattaaatgacatgctcctgaacagccaatgggtcaataaagaaatttaaaaggaaattcaaaaatatcttaagacaaatgaacatggaaatggagcataacaaaacatagcataaagtaaaagcaattctaagaggaaagcttataacaataaacaccaaaaaagaagaaaaatttccaataaagatactaatgatattcctcagagaagtaggaaaagaagaacaaastaagctcaaaattggcagaagaaaggaaaataataaagattagagcagaaataaatcaaatagagactagaaaaagaatacaaaagatcaatgaaacyraattgtttttttaaaaagacagacaaaaacttttagctaggttagctaagaaaaaagagggaggccttaaatatataaaatcagaaatgaaagagaaattatggctgataccacagaaatacaaaggatcataagagactattatgcataagtatacaccaataaattggatgatctagaagaaatgaatgcattcctagacatatacatactaccaagactgaatcatgaagaaatagaaaatctgaactgacaaataatgagtaargagattgaatcagtaataaaaagttttccattaaagaaaagcctaataactgttggcttcactgctaggttctacttatcatttaaaaagaatgaataccaatccttctcaaactctgccaaaagctggaagaggaaggaatactttcaagctcattttatgaggcaagcattaccctgataccaatgtcataaaaagacattacaaaaaagaattacagaccaatattcttgatgaatatagatgcaaaaatcctcaataaaatactagcatagcagctaagcatggtggcatacacctgtgggtggctgaggtggtaggaytgcttgaactcaggagttcaagtccagcctggggaacacagcaaaagctcatcacttaaaaaactaaaccaaccaaccaaccacacgaaataaactagcagactaaatccaacaatacaktaaaaggatcatctacctagtcaagtgggatttatccctgagatgcaaaaattgttcaacatatgcatatcaataaatgtgatacattacatttacagaatgaagggtaaaaaccataccatcatcttgttagatggagaaaaagtatttgacagaattcaatgctcttttatgataaaactctcaccaaattagatatacaagcaatgttyctcaacacaataaagggcatgtatgataaacctatagcttacatatttaacagtggaaaattgaaagactttcctttaagatctggaacaagacaaggatacccactgccaccatttattttcaaagtagcactggaagtagcagcaagagcaatcaaacatgaaaaagaaatgaaaaatatccaaattgacaaggaagaagtaaaattttcactgttggtgatgacattatcttatatattggaagctcaaaagacttcaccaaagggctgcaagaacttataaatgaatgcaataaagttgcaagatacaaaattaacacataaaaatcagtagtattttctgttcactaacaatgaatgattgagaaagaaataaaaacaatcccatttacaatagctataaacaatatgtagaaataaatctaatcaaggaggtgaaatgtacagtgaaaattataaaacactgatgaaagaaatcaaagagaacacaaataaatgaaaaaaatacaatgttcatggattggaagaattaatactgttaaaatgtccacactacccaaagcaatctacatattgaatgtaatccctaacaaattactgatgtctgtctagttatggaatcataagtgtcatcaacagatgaacagataaagaaaatttggtatatacacatagaattccrttccattttaaaaaacaagaacattctgctatttatggcagcatgattaaatctggaggagattatgttatgtgaaataagccaggtataggaaaacaaatattgcatgttctcatttgtatgtggaagctaaaacattcaaattcacaggagcagagagtagaatggtggttatggaggatgaagctggagtaaaaggaaggtggtgttcaagggacacaaagtctcagacagaaggaatacatttttttctttttgggatctattgcacagcatggtgaatatagttaataatagtgtattttatgtttcaaacttgsttagagaatttcaaatgttcccaccacaaaacataagtatttcaggttagcttgatttaattatttcacattttattcataaatcataacatcactttgtatgctgtatatatatacaattataaatggtcagtttacaatgtaattaaagaacaacaacaacaaccaaccaaacaaaactatgcatatctatgcatatgctctctgactcaggaatttaacattttggatctaccctagctgtacttgcatatgttcattaagaggctcttattataattaactaactaattttttaaagctagtgaatagttgaaaaaaccaatataggaagactaaaacactaagcagaattgtgatgtatttatattataggcttaaaagcaattccaaggaaagacctagatctacaatttaacataggtaaatctccaagacaggatgctgaktgaaaaacaaacagtgatttatagaatgaaacttatacagtttattatatgtaaatcacacawccacaaacatatacatctacacacattatttctaaagataaatggatggcaaagtactgaaaaatgttcaggggggtgacattaacctttaatgtgatgttctgtttttttttttaaagaagaatatatttttgtaaaattaggtaggcacatttgattatgttggtaattaaaatgaaatttagtaaaactatttgatgattagcccttacacttaagagatacatcaaaatgagtaactcagaaacggagaagtcatgataaaaggattgaatgrtaggtaatcagttcacttaaatgtagaaataaggctaaatgacaaggaagttatgtttttagggtacattttatgtgttacatcttggcaacagatgaatagataaagtatttagtacgaaaaacatactaaatttgtaggtagtcagagaaaggcaatgaacctatgtatgatgttgattcaatgttggtttggggtgagaatgcattgtgctgataaatttcttagtgtattaaatttttcctgtaagtttcttcagttccttctcaaatgtttgatagggcattaggtacgggataggcatcaaacagatattaatatgacaataatggtaaaggccatgacaacttttcctttgggaaatagcaatcccgttatcaaatactgttggctatgtaaaactcagtgttagaatgccctaaattcagccgtccatagtttgcattattaattatttaaggaaacatcccttttggtaatattaattttgattctacccactttctacctatgcccataccatacactggtcagaaagtcatttggtgtttgcacaggtgctgcaaaagatcaagactcagaatgcaggcctagggatattctgatcaaattacttggccttcctaagaactattttccacatttgtcaaatgcattgatggtgcttcaggtcttagatcacagagaaagtgtaggaataatatataaatgttctttgaactttaaatgttagactttaatgttttttaaattatgatggttgactcttacctgatggacaaagtagggagttgaatgttgtttccttctctagtccttcaggctttaggtaaaagaaagaaaagctagtgagaatggactgaccttcagaacatgtgttttaatggagggaccacagatatttggatagtgaagagaaggatttgaactgtattatctaagaaaattctgtacatataagcaatatacgtaggaggtagttcgatgcatgaacaaatgaaggaaaaattaagaaagtaaatcaaagggaggctgtgcatggtggctcacacctataatcccagcactttgggaagctgaggtgggcagatcacttgaggccaggagttcgagaccagcctggccaacgtggtgaaatcctgtctctactaaaaatacaaaaactagctgggcgtggtggtgcacacctgtaatcccagctactcaggaggctgaggcacgagaattgcttgaacccaggaggcggaggttgcagtgagcagagatcctgccactgcactccagcctggatgacagagcaagactctgcctcaaaaacaaaaacaaaaacccccaacaaaacagaaagtaaatcaagagagagataggacagagagatacatgagaataatattataaaatatccatatattattatattacccacatatattatatattattgtggactatatattatttaggtttacttacttcaaccaacagaggcttgatgactgtgtctttccttccgtgttcaggaactgaaggcacctcagtcccacacagctcttgagactctagtgcctctgcgctcacagtgaaattcacatttcctgwaaaaaaaggccagtagaaatgaatagcatcttccccttcctccatgcctccaaactcaagatttagaaatgttcaatgctctgtaaacttttgttttattaaaacacagaagcaggaacggaaacatgcaaatgagaggtgaatgatactgagaattcaaggtggagatgttgaggatatccttgtaggcatcttagaataaaaggcaaaggaaaaaaatcgcagcatctagtggtcttttcctgaaggaagtagcactcamtataaggttcccactgccatatacaatctttgagtagasaattatctctagcagttttttgctcacctaatgactttggggttactgcccaggacacagtttgccgcccgtttgcacagatgcagtgaggcrcttgttccttctccactgggacagctaggaaggcrggagaggcttccagctgcacactgacctgaaaccacacataagaaagggagtagagagggaaggagaasagagggagaatgggtttgaagtaaagcatcttgaggaattggttagatttcaggttgcctcacattaaagatgatataaatgaagatcaagtacctgaaatatatttaagtggatcttaatgtatcagatttacacaggtaaatctgagttattttggaagcaacctgctctttcacatgatgggaccagaggaagggaaaggtaatgatggcatgctgctctacctctttggtctggaactttgaccattcccccggatctcccggcagaggatacaagacttataaacagttatggtttcagcaaaggtaagatgctcacaaacgacttttaaaattaggtttaatataatgaatgagctacgaaaagttaaatatatgagatcgtagaggttgaaaccttgtagaatctgtcatgagaatagagtactgacttttgtcacccctgtcagaattcttcataccacacaaatactaactttgaagggttataagggctagaaacttgctttatggtgcaatttggtatttggagatctcaaaacctgtaacttttacaatcatgaatatctagtaagcatattttgcatacaagagtttgcagtattcctaggaatgcaacttttaatttacttgatggctaccttgtatttaatttaggaaagagatccttacccggatgcatttgggaaggtagtttwggaccgtggccttgagtgtgaaggcctctccacgaatcacagagtaaggcattgtgagctccacaaagaagggctggaaggctcggagagaggcagtggaagagataccaagtccagcatcttcagacaggcagaaggcccctgccttccactcggtgatggtgtcagggactgttactcctacctcagccacacctgctgagctggagaggagtgtaagtgaagaacagwaagtaagcagttaaatacatcctttctagggagagaatccctaggaatkattctactgccatgacttaaaaacactcaatagaaataccaataatggagagtataatcaaggattgagatgggaatataagtccttttcttccaactgtttttaattgtagtatatcagaattgtagcataatcttttacagacaatatagttataaatttaayatgcagtttgagattgttcttaagttctcttctctaaaatgctatttcactgagggctgctttataattttaaattctactactattgtgtatagtgggcctgactgaatctgtatttaactcaggattgctaaccagtgagggatctcttacaggcaatctgtgcagtccttggttgtattaggtccttatgcccattttctggaaatcttagaattaaatttgcacaaaattttttagctctgatgcaattagattagtaagacttcttagctgatgtatttatgttaaacatctcctgaaattagcaatgcgtttgaaagaagtacttcagtactgaaaaattagctaacagctcccagtttctccctggaasggcttcgtctacccactttatcagttgctgactgagtgttgggcttctaactagcctgcactgggaagcagaaggagcagggaaacgacagacttacaggaaggctgaaaagcagtaagggcacttcccatgcctccttcccctggctcgccccacggataaaaccaggtctgaacatacccctgggaataatttgtctatgcatcaagcaccccaatgtttacagctcgtacctaagggtctggctcctaaatcacctagctccaggagtagatggagctctgcaatcaggagtctccctagaccacagtgaacacagaggtggttttaaataggcctttgagcaatgccagtggctaccygcccccaccaccccttggctcaatacagagagaacaggcaaaatctcccatttctggctgtctcctaagggttgggcttctaaacagcctgcatctgggagtgaaagggagaagtaaacaagactccaggagcctgaaagggagtatatggccattccggctctttctctccacctgccccactggcttgtttcasggataaaactctgtttccagtgtctctctggaaggaatttgttcactccccttggtgcaaatgtacattgccacagccattatggaaaacagtatggagatacctcaaaaattttaaaatggaaactaccatatgtcccagaaatccctcttctgggtatactcccaaaggaaatgaaataagcaccttgtagagatatatgtgttttggtgttcattacagcattattcacagttgccaagatataaaaacaacctaagtgtctgggtgaatggataaataaattgtggctatgcgtaatggaatattattcagccttaagtggaagaagatcctgccacttgtgacaacatggatgaacctgggggagattatgctaagtgaaataagccagacacaggacaagtactgcgtgatcttacttgtatgtggatgctaaaagaagttgaatacataggaacagagagtagaaaggtggttggggttgcagggatgggaagaagcaggtcaaagggtacaaagttgaagttacgtaggatgaataaatttagaaatctaaagtacagcatgaggactgyagttgataatactgtattggatactgaaacttggctaagaggatagattttaggtgtgcttgctatgcacacaaaaataggtaacaatgtgagctaatggatgtgttaatttgcttgactgtagtaatcatttcactatgtgtatgtgtatatatatatatcaaaacatcatgttgtacatcataaacatataaaacaataaaaacagaaaaactagcaaagagttgaaaatagtcagggacctctattgttgcatattgcatatgcaggaagttacttactttaccaccaccaaatcccagatccatgtctcagggaagtactttcgtacggtctccgtgtgaggctcttcaacatgcaccaggcgtgcatggcctcttcccattacatctgactctatggtgagtgaggaagaagacattacaataaacatacagataaagcttatgagagaatgtaatagttgccaccaaaaaaaaaaaacaaaaaacaaatcgtctgatgaaatagagaggaaggaggagagggcgcttgggtcatcaaggaaagcttctttgaggaggaaatatgttggwtgacttaacaagccaggagaggccgggcgcggtggctcatgcctgtaatcccagcactttgagaggccgaggccgagacggcgccactgcactccagcctgggcgacctgagcgacagagtgagacttcgtctcaaacaaacaaacaaacaaacaaacaacaaaaaaaaacaagaataagctaggagtgagctgggggaggagggtcataagcagaggctatagagactttggcagacagaggcttggattgtctgtggggcacaaggactctgtggagtcctatgtggctgctgccgctgtgctaagtggagagtgttatgacacaaggccgtgaagaggggcaggaatccaagtttccattggtgtgctcctctgcaggagcaaggaaaaactgacacacatgttatgacagtggctttgagaaacagtttacaggagggaaaagtttaataataataaagactttttattctctatcgtgtcagaagattacagttagtttccttcactctattcaccttctattaagggtgtgctggtcaatatttcacaaccagctctctggaaaaaaaaattgtgcatatatatatatatatatatatatatatatatacctatacatgcataaatttactatatatcttactgataaaggattatacaatataatttataaataataaaatatgcggtaggcttcatagtgaattccatagagccaactgattctccttaaatgctttccttgatttttgaccctcttttctctgtactcaacttatcctcaatcatgatttgacaatatgggactataaataaatgcttgattactattcagttcatcaaagaagtagctcatgtcattgatgaatgtgtgtggttccaacataaatattggctgatgttttggggaagttgaacagcttttttacctgactgatggagaatgtagtgttgttgtgtgaacatttctatttctgtttacactaatcctacgcttggaaactttctctttcctttcagcctaacacatgtacctccatttactagaatttgagtttatattactatatgaccttgagcaataaccttaatatgtatgactcacatgtcctttttgtttgttaatttttgtcacattgtatcttttaaaaaatttaaaatttggtgaatatattaggcaatatatatttattaattttttgtttaccataaaaacctacaygtagaccttcaggtccatgcatttcatactgttgaagctgtggacacattttgggtttacgaatctttgagttggtgaatgcctttaagcccatgtcctgcaaagaaaattatcatctaatcagtaaatatatattataaaatatacataggtagctacttctttttattgaatttgacaagcaatccagttaacttaaattaaacttttaacattcacatctgtagaagggatatttatatacttaaggatgtaattttattcttttcattaaactctttcaacagtaattattttgtatatgtgattttaataaacatcacagagcaattaattcctgtgaaaaaagaaaacttgaataatactccaaaaagttccagcttagttcagcagcttttcgcagatctgctgctattagtagagaagccacttacctctttatatcccattaccctcaactaggacatgaaggcattcaaatacagactcttttccatgtgtaatattttaagaagcttaagatcagaccatctgcaacataaggagtttacctctaggaagctgtacatatccttttcatttgtacttgatactggagtatatgtgattccattaatatagacattatgacgattgatgcagtcttcatygtcctggtcattcaaaggcccagggaagccagtgaggtccttttctggtagcaggttgtaaacctgtacaaatacgaaagacaaaaaggcaaacttatttgtgacttttttttttttttttttttttttttttgagacggagtctcgctctgtcgcccaggcyggaccgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctttgtgacattttttaagttcaaggagaaaagaacaggaataatgaacatccgtctttctttgagcgctctcattgctttgatgatttatagagggtatggatcattttcttgacacagtgttttcattttgaagatgtttaacaattttaggaaaaaccaaacactccatctaagtactcatctaagtactaagtactacttcgttacacagttcagaggccaccactagactcaacactggaatgaaataaaactttattaattgaaaaatcgaggtctgctgtatttgtgacattgcacaaagctttgagatgatagaaggaaatgatagttttgtgcttatcttgtggtgagcaactgactcagtatatagcaaagttaatgggtgcatgttctaaacaggcacacgaataggaatatcctctctccacaggacacgatggcattttcttaggtattattagtggaaacaaaatgctccagatcttcatataatacatacaactttaaccgtaaaattctaggcatgatgctttcaagtccatttgaaggtgagaagtaagacagacataaaaattgtgatagttacattgcattatattcgtaggagtttaaaactgattgacaagaacagatgagcaaagtgagtggtgtgatgaaattagacactttctcaaagtatcttaacatttctcatttcctctccctgcttttattgtggcatattgcataattattgtctgtctcatctatgggacagacaatgtaagttccatgagacatacatttttatctttccagtagctcactgcttgatctctactagcacttagtataatacctagaacacagtgggcattaaataaatgtgttgaatgaatgacctacactagtagcagcaaagtgtttcattggtaagacactaatcaaagcttgagaagagttggtgttttaactcaggtctactactaaatccctgaaagcttctgctttattattaataaataggactgtctgccttatctacccatcagggttgttataatttgaaaaattctttgagaattataaaattatattataaaagtataaaacaygtatattattttcccacatatcctcttgagatcctactgttgaaatgtacttgatgcttcctttagaagtattctaatattttcagttaaaatcccattagaaggacaaacaagtaagaaayatttttttataagtttctatttcaggaaaataaaaatataaatttctctttgttaaattatggtagtagaaaaagcttcagtaagaggttattacaattggtctcatattaaaaatttgaagatgtgagcaaactactattagtacatgctattaactagtttttgttgttccaattcagcatatccttttggtatttcttctattagctccatattttcaaagagttcagttatcaatgtcaattatatagtagttcaatttccctaagttttgttcctcagagataatacatatgttccctcagaaattatgtgtagcttgggacagcaattatttcaactgatgtaattctttttttttttttttttttgacaccaagtcttgctctattgcccaggctggagtgcagtggcacgatctcggctcactcaacctctgcctcctgggttcaagtgattctcctgcctcagcctcctgagtagctgggatgacaggcgcccgccaccacgtctgactaatttttgtatttttagtagatacggggtttcattatattggccagactggtctcaaactcctgayctcaagtkatctgcctgccttggcctcccagtgttgggattacaggcgtgagccaccaggcccagccataattcttataaaaacggaaatctgatatttcatttagcctgtatagcctcagtgcaggtatatgtatcacttytgttaggctttttgaaatgttgaaactagtttgacaactcctattactggttgcatggagctctgggattttaaggactttgggtactgtatggtctttttacattttaaatatataattttcgaacggcttccccggttgctcagttaatcctttcttttattttgcataactgcacttctcatatagcacttttcacaatctgctctgtattctctccagccttgcatatacggatgtcctgacacaatcagaagatttgaatttgtattgctatgtgctcttgagcaagaagcttaacgtgtctgaataacgagtccttttttggttgttaattttcatcacattttgtccttttaaaaattcttttatttgattcaatatattgtattttgtttatttttttaactgcagaagtgagtagttatatatatatatatatawaattccttaccaatgaaagcccacaagagagctcaaagcaattaattcctagataaatataattttaattgatcttatcctacttatccagtcatttttccttgctctgagcccctggcacggcccttcttgattcctgaggctgccaggaactcaccgaggacgccgagagctcagcatcaggcttcatgagcagcacgctttggtccacagcacggagggcgcagacggactgaggagccgctgtgactcgcaggtgggcgtgtgaggctgggagactttgtgatgggctgaagctcaaatccacctgtgaaattggaacaaaaggtcagaaaagcaaatttccaggtttacccatgcattcrctcgcatttgcagagtgttcctcatgtacaatgtataaccactctgcttgacttcgtggagggttggcattgtgtcaatcctgaagctttttgttccctacacttctctttcattctcaagaatcacttgagccagtagaattatttctaattattcttataaattactagtcatgaaatgccatttttatctttgatacacggcaaggtgctyattaattgtggtgggacatgcatgggtctaggtgctcttgcatttttcttttggctccttagtagtcttaaaaacttgcttacatatttcccaacgtttcatcatagaagaagggaataacatactctgaactgtgtaattggtaagaggcactgctaggagaagtttgagagttttgtataaggaatcaagtgattctgcttcttagtgtgactctgccactaccttgctgaatgwctctggggaatttgtttaacccttttggccctaatgttcacatgtgtaaaacaaatgataacaatagtaacttctagttttacatgttgaagattttatgatctaaaacacacaccttgttggccagacaattttcaacatcatattttgcagaatccccaatcacgtccccggtaggtaaaacagcatagatgagcaaccgagcgacaggagcaatgtctgacttcacagggattgagatggaaaaatggcccttcactggggcacaaagagaatgagaggaagccatcataggttaatgactatttccattagtagatgtaacagacataataaacagtagatgtaacaaatggatgattacctctaaggactctagctttagaaaaaaaccctatcaaagccctctctcctctcataaatcatatactctgttgatttttcaccagctttaagcttcagctcacccacctaatgttctgatgctagttaagggtatgaagacatccaattcactaccatttgatctaggcctcatactagaagagggaaatagaacctgaagttatgagatgtaagagtaagagttcaacacattgtattcatgctacatgctctttaaccttctatgagccaatatttggttctttctccataagaggaacaccatgctccttcagaagttattttttgatgcctatgtagattctttagaggttgcattaagtttccttcagtctgctatggtgcttctgtgttgctacaagaactaatgagagagtagattactgatacttttctagcaagttatcttttagagtctactagactaggagcaaccttcaaaggtttatattatgacatatttgctcatggcaagagtccgcttcagtcggtagaagtacccaatttaatgcttcataaatcataactatcttgaaagggaaaaaagatatttataataatataaatgacataaatgactcagcacaagacctggtatatacaacataccttgaaatcgtacattttctccaccccattctctaacacaattctcattttgagaagaggttcaagaatatttatggtttaaaaatctggaataagcatagattatacacaacaatattttatgtattttatttttccccctttgttcttatttatttatttatttatttatttacttttatagagatggggtctcactatgttgaccaggctggtctcaaactcctgacctcaagagatcctcccatcccgttctcccaaagtactgggattacaggcgtaagccatcatagctggcccacaccaatattttaaataacgcaaagaaaataggctgaaaaaaaagacaacacatatttgataaagggtgagaaaaaaaccattattgttttccctccctcaactttcttttaattaatattagatggaaatggtctctcrttacttgaaagtattcctgatattcccagctcaggaatggaaaaccaaacatcatatcttctcactcagaagtaggagctaagctattaggaagtggcagctaagctattaggaagtgggagctaagttatgaggatgcaaaggcataagaatgatacaatggactttgtggattcagggggaagggtggaagggggtgagggataaaagactgcaaattgggtacaatgtatactgctcgggtgatgggtgcaccaaaatctcggaaatcactaccaaagaatttattcattcatgtgaccaaacaccacctgttcccccaaaaacctatggaaaaaaagggaaagtattctgatacttccgtggtgtaaggctgaatgggtcagaatggggcagcaatgcagagatgatggaaatactcactgtcttcctgcttcacaagcagtccatgagtcccagttcggacaatgcctccctttgccattatctgcaaaaaaggaaataaaaagaaattaaatgtgccagagagaacacgcttcagtctcacttcaatatacttgttttattgagtccctgcyggcaataattcacctcaagagaaatcaaactttcaaaaggaacatggataagaagttgaagtaatgacatctaaagagcttcatgattacttgctccacagagagcttttgtctacagtgaagtcaacgcagtaacctcccttctcaccagataatagaaggagagcttcttcagccccagcagggtgcctccattcagaatataatgtgcctggactgtctgagtatggccacagggtagttcatgagacatgggctyaaggtggacaaagctcttgcttggggagaacacaagataagcagtgtgatgtgcctcttcgtgttcttctgayacccactggtagccrtaacagggactaygatccttgtaattgacctaatgaattagaaaaattatattatttttagattatacgtcataaagattaatgttctcacaaaactacgtaagtttactgtcctaccttaactagtagctagaaatcttttgwtccacaatgaaaagtgggagaaggacccctgattttstttctctgcttcaaatgtaggcatgctttgtgactttacactgcagagcctcctgggattgagatttatatttcttaagagcataaaaggaggcatcctttgctctgattagcttgcttgaaatttctttgactgctttacctgtgcaattagagacactggagctatgaaacttcattgaggagagtaaataatctctagaaatggaagaactgtgctttcagaaagcagctgcctcttttagggtggattttgaatgggtattatgaataaataaaatattgtaaccttaggggtctgagaagacattggtagaaagcattggtttaagagctgagctgatgaattagctgaagtctasctcttctgggctatcttaggctgattgctattattattatttttttgagacagggttttgctctggcgcccatgctggagtacagtggcacaatcttggctcagtgcaatctctgcctctggggctcaagtgatcctcccagtcagcctcctgagttgctaggactacaggtgcatgccaccccacccagctaattttttgtatattttgtagagacagggtttcaccacgttgcctaggctcgtctcgawctcctggcctcacgcaatccacccacctcagcctcccaaagtgctgggattacaggcgtgagctaccgtgcctggcctaggctgactatttttaatgctccctgcaatctggattctaatacctcagaggccctatttgggttatatttccaacttttcttcctgtagaagttattccttagctcctttcaggcttcctctaccttcatccccagctcccaatagcactagtgaatccttgagcaaaacattttgttcatatcttaatgtatattttggtgacaacayatatatgatcaccccaaacagggaacaggtagaaataataatttcattgtcaagactagcacagtgctggcacgtggaaagcattcaagacactttttgaaatgagtaaacattcaaattagagggaggtgcttttatgccatctattaaagctaaataaataaaatgtattatttatttctctataacaaggtaaaactctaaagaggcaggcgttttccattaccatgattatgtaatatatattaaatatgtattgtatatccatgtatctatagacatgtctacatctctcttgatgaatagaggactgcatgctataccgaataacttatattggtatgaacaggtcatctggagaaaattagaatagcaagacaaaataaagtaaggtaataatttttggagtatatatatttaaaactaaatgctaattatgttagaattggcttttatagtaaaagtatctaacagttaaagggggcttactaagtgattcaacatgtatkatttcacttaatcttcacaaccaccccaagagtcaggtgttagtattgcaatcattttacagataaggaaatgaagcacagaggttttagttaattccttaaaatagggttgagccagtatttttaaccactttatctgattcagattctggaattcacacttttcaaaaaagttattataaacacacacacacacacaacataaaattaccatcttcattattctttagtgtacagtttggtagtattaagtatatctgttgtgcaacagatctccagaacttttcatcttgtaaaactaaacctgaataccaataagaggaattccccatttctctctttccctagcccttggcaaccaccatcctgttttctgtttctatgactttgactactttagaaaccccatgtacgtgaatcatayagtattggtctttttgtgactagcttatttcacttaccataacgtcctcaaggatcattcatgctgtagcatgtgacaggattttcttcccttctcagrctgcataatattctgttgtatttatataccacattttgtttacctgttcatcccttgatggacatttgggtagcctcgatctctcagctattgtgaatagtgcggctatgaacacgggtgtgcaaatagctctttgagaccccgttttcgattcttttgaatatatgtccagaagtaggattactggatcatttggtaattctattttttaattttttcaggaactactatactgtttttcatagtggctccgccattttacgttcccagcaacactgctaaagtctaacccgcacttttaatcacaatatactgccttcttttcataaactttaaaaaagttaaccttcaatyggtttctaattgctagtttttttctctccatagaactagacacagtttggaaattttctcacccttaggttgcaaccttgtttccaaggctacttcatgtcattggtaatttctttccaaacttaccctaacagtaagagaggtacccataacattggtggtgttgatagagaactgtacaaggccatgctcatccgtggtagcattggagtaatagtttgcttcatttcctctgatgaatatgactttatttggtatagggacgcctttcccatctactaggcgcacctgaagattaaaagctgtggattagttatattggtaataactaataggcaccaaacatattcatttatcacattttttagtgcctcctctatgttgaacatggttccaggcactgaggacacagcagtgaaaaaaaaacgaagtttcttccatcacagagcttactgtctagtgaaagagatagatgctaaataaatatatacataacatacactaatttagtagtaatcaatcctaagaagaaaaacagagcagtgtgaagggatagagagtgatagggataataacaagagtgacctgaaaaatgtcttctagatattttggaagtgctgtgtattattatatataactcttagagagtcacagagcactagagtaatatgataatgaaatattttaatctattaatctattaactaaatttatttgtgccccaaacacctattttggagtggaccattaacttcctatagattagtgtctgaagtctcataagtgcacaagtaaacaattgccaatacattgtcctgtgtgtttctccagttgccttagacatggtctctgcttctcaacctagatcttcagccttttggaaggtaggcagattttatgacacacttcccatgtgaaaaatataaaattgaaaagaggcacacagtattaaataagttgccaaatctaatttactgctaatattgtattggcagttgagtagtccagttcagattgtaaaggtggcaattctttttcagtataagctacagttggtagcaggaagaacaataggctgacccccatcagtactcataattgatttacaaaatctaagtttgccagtgaaatgttggctgcatgtacaaagacaagaataggcacataattctgattttcttctagctagagagtcttatgacaaataggatatttaacagcaataaaatgtacttacaaagtacactatctttctgagaaatttacaaatgagctacactttcattttaggaagttgaatacattttggtgtcatgacataaccaagccttctagaatgtactccactttgttgagtctatgcctcttttacacccttcatagctgaaatcctgtaacatttacattaagaaaatgatacacagtaaatacacattgaggcacatgtaactgtgatctcagacttctagagtcataaagatccatttgcacatctgctgacaacagaaaaattgtaagagaagatttttttggtagataacatgaaaattcataattcaaaaatctgagaaccttaaatagcagtgttttaccccatgttcactgttttagaaatatacttgttatagaaaaatagtgtaaatatactatccatgaaataaacattattgtagaatctttaatacttcaaaataaaaattaaaaccacctacccacctgtttccatacaaagttagtgttagcatcgtaatgaaactggtcagcatgaattttgagattcttgtgagaaaatgtcataaaaacctgagactgcctggtaaaccatgagaaggagattgagtgacttgtacaatgctgtttcaaaagaaggggggaaaactctactaattttaataaggccttaggataattacatacatttcatacacaaatttacagaagaataaatctatttttatgtagttttatacctttggttatactaatcaagccttggtgatattttatacttttggttatattaaatgataacattaaccaggcatggttttagcacaaaccataactattgtgctaattaggtaacagtacatgggttgatgagtgaactggaraatactccacctgcccaaagaagggaattccctgtygaaagtgtgagtccactttcacaaatgagagtttggttatggttcttgtgatttcactggactgccttccagtcaattccaccactgaaaaaagagaaaaaaatctgttatttttgggaagaatgatgtctctaaaattctatcacctccccccaacttacaattcattatttggctaagaaaatcaatgcctgttgtgttttctcttatacccatgtwgtacacaaacctgttccttcttcttggatctgggcctcagtgtgaagtttcatttcatactccttcctcttcagctggaagaccttggtttttacttgctgatagaagcagccatggctgtttagctaagaagggagaaaataaaatacaaaaatataatgcatattatactaaatagatcagtggtcagataaccggtgtgatttttgtggggggacaacatcatgtaggcattttctatgacgaggacacaataaaatattctctagcaactaaatattaaatttcacaacaatatctcatgtataattgacagatgtattccttggtatctgaaattccctagatatattgcgatagaaatgtcttaaaatttgaggagtaattttttttgtacaaaggatgcataatatttatacatatttatggggtacacgagatattttgttacatgcagagaatgtgtaatgatcacatygcgggatttagggtgcctaccaactcaagtatgtatcatttctatgtgttggaaatagttcaagtcctgtccacttgctattttgaaatacacagtacatctgctcttgaccattagaactcctcatcaaagtctggttcctcctccataatattcagctgtggctgggaagcggccttctatatggggactgtgtttgtcaactctctggcatcttggtggggccatgtgataggttcttgttcacagagagagcagaactgatggcctggccagctaaggcaattaagaggtgtatggttttttccttcctttgtagaagtgaatgcccatggaggctttagatggctcagygtctatcgttctgaaacactcacaatgggcaattacgagaaataaataattcccattgtgctaagttcatgattttttttgaaaaattacaatagccaacatggaattctcttctagattgttctcttcctgcgtcagaaaaatgctgcaactcactgcttttcaacaatgcctttatcgctattctctagaaaaaatagtgttcaacctacctgtccactgaatttctcacagaaagcctgtgaatcttcaccgtggcagtcggaagcgtcactatactttctgcaaatgctcacagtcacatgtccagggacaggcttcccatatgtgtatctgtcatgagavcattcccaaaggaatcagagcagacacygaacctccccattttctagctatttatatctcccctttagctacagtatattccctgtctgtacttccctctgctctctgctgggctcacacaatattgaagacaagagtcactaatggctcttatagaaatctccattgcaacatgctgaaatttacattcttcttttatcatttcttttttttcctcgtttttttttagttttatcttaaaaaagtctttcttattataaaacttaaacccgttcttaaaagagaaacaataccagcaagacgaaacaaacaaaacaaaacagaacaaaaaaaacccaaacgccctcaagtctacctaggaatacaaactattagtacgatagtgtctcttcttccatcatcctctccccatgtgcagccatctctatatcgagtttcacttgtttattttattttattttattttattttatttttgagatggagtctcgctctgtcgcccaggctggagtgcagtggtgcratcttggctcactgcaacctccacctcctgggttcatgccattctcctgcctcagcttcccaagtagctgggactacaggcgctggccaccatgcctggctaattttttgtattttttagtagagacggggtttcaccatgttagccaggatggtcttgatctcctgacctcgtgatctgcccacctcagcctcccaaagtgctgggattacaggcgtgagccaccacgccgggcctgtttacttttttacaaaagtgggattgtgtcgtaaatatgtcatagacaattgctgggtttccaagtgcatttgtctcctttcctatttgagaatgtcctctgtatgtctatttgcaagatcacaccagttatgaggaaccaggaacttggccatcactgtgagacagaactggagcaggggcctagctgaatagtaggtgtattacatgtgtgatctttggrcaggactatacctgctcttcctgctactgctactgtgtgccaccatggatgggaacataagatccaggaaacaagacttttcaaggttggaacagactgtcttgagaaatcacgttcagtctcttcgtaaaaatgtcagtgcagacaggtatgtagacccgccttaggtggactagtgagttagatgagatttcagttgtatgcctatctctacaaattctgaatctaagtgatttttccagtaagcatgcaaggtcaggtaaatgatctgttgatgattgaatttcccctatagccatgtgttaattatctccctaatatacgtttggttatttttggttaaggcagaaccaatacccttcaacactatccacccttcccattttgtgtgtgtgtgtgtgtgcagttttgtcactttcagaatcaatcctattagcataacctctctagaaacagtttcttacctcatgatagaataatactgataagaacgtgaaagaaaataaaaatagaaaagcaacaggagaataacattctacagatgaggatgctgtcaaagcacttaaaatttttgtgttgccactgctcccggagagagtagttaaaatatcccaaatggtgagtctcttttaaataatcccccacaaaagatttttaaaaaatgaactcacaggccacacactgatacattcatctcttcttccaagatggtgattatctttggcactgttacttgtacttcaaacttgggaagaactgttgattggtgataaagaaggttggtgattggttttcaactttgggggaattcctattttcaggttccctgtaacagttccctaataatattttagggctctgaaaaggtagctctgctctccaatctattcttatctatcctcctctcaaatgaagatttcagttgagggactatgagagatcactgtgtgcttaattaattatggaaaactccattaaaacaagaatgttttaattttgggggttggtattaaatattgctacagaaaataacgaagctatgtkaagtcctattcacagatcactgatgtcctcattggacttaggtgtaattaattctactccaagcccaatgtcacccatgggaaatggaaagactccaaatgaacttaaattccaggacctaagagtttaaatatgaagaaaaataatgcttgatgacttttcatgatccataccaaattcctccacggtgaaagggtgctctgtccttccacctgatttcttctgtaccaccaccttgtaggagccctggaagggctctgatgagaggggaaaagaaaattgcttgaggccaccctctaactggaaactctgccattgtgcgatgcgatttcctttgggatcctatatgagtaaattaattataacttacaaaagcacctggagcattggagctaataaaagatatctatggaaaccctaagttatctacaaaaaggkcaaatggggtagtagtaaagggtgagtagaggagatgagttatagccatctagctctatgggagtttgaaggcttctcctttaatgacaagtttctgagatattgtaaaaacctctgaaataagaacattttccctatatgtattgctttccttttaatatggaatgtttcatgttgcttacctgaatgtatactagtggaatctgaaagacaaaagaaaaaagaagtttataattattttcaaatattcttaaatctcatttataagcaaagcagctagtatttgctagcataacagggtgagtatagtaaaaaataatttaattgtacatttaaaaataactaaaagtataattggatttgttcgtaacacaaagaataaatgtttgaggggatgggtactccatttattgatacaggcatgcaatgcatgataataatcattatccatgattggataatgatatggataatgataatgattatcatccataatcattatcrtgcactgcatgcctgtatcaaaatatctcatgtaacccataaatatatatacctgctatgtttccacaaaaattaaaaacaataaaaagtttaaaaaatctaaattagtttcatatagaataattccctctatagtgaaatacagaaatattccagattaaattttatagaacttttcattaatctattttaagcaattaataaataatgttaagaacttactaggccttcagcaacaaatatacatgtaaagtgccatttactaaaaatggattaacatgtcttaagtgcttatagcatcctagtgaagwtcaatcctttgctatgcaattttacaggttgagaaataaacacttatgtaactataagtaaatatgttcagatgtaatcattaagatgggtcatagaattcttaygtagttctaagaatgaggaggaatggacatatttcattaataaatttagtttaataaatattacttttaaaaatgaataaacattgataagaagctactatgaatgtttattcatttttaaaaactaatctttattaagtaccttctcatgcgctgtgtatcattctaggtattgagaatataaccacgcacaaaagaacaataaaccatgttttaatggagcttatgttataatagaaataggcagatttttaaaaatcaatacgtatagaatggtggtaagtgcaaatagaaaaacaaagccaagttaggctgacagagtgatgggtgtggtgcctcattttagacagaggagtgaaagtagaagctgggagaccactttgaaggttattgtaatgatcttatttagagatgacattgactaggactagcttgcagcagtagttcagatgataagaaatagtctgaatatattttaagccaacatgattttccagtgaagtggatgtgggtatgagagaaagagaaacaagaactaggccataatcttttgtctttggagctagaagagaagagttgcctctttttgagataagaaaatgtgaagaagttaatttgggagagaaaaatgaagactttgggttgatgtctgcattacaatagaaagaactgtttcttatcacagataccaagagttagtcttgaggaacaaattaattaccctgactttcctttatagtgaagattttggtagatgtgtatagaaaaaatctaaatctttaaaatgttttttgagcttaggttctttgaggatttttctgtgtctgctattgaatgtatctttctaattgtcctaattaagaaccatccgaaaagtaaatttaattgtgtgacaactgactgagtaccagcaccaagacagaaagaattacctactttctttacctggaatgatgttttagattaggatcttgtgctgttgtaatgccagaagttactgttaatgataccagattcttcctctccctggtcttccctcagcacaaaaaacaggttcccagcctgtttatacagacaatcattttatgtagataatagaaaactcaccaactcattcagggggtgaaagttttcatccatggagacaacacgaaatttcactgaaacagaaatatttttcatgagcccccaaacccaaagtaggcctgtaggctggtaagacaagctattaaggaaccaagattataggaactttgcctggggaacatccaggggaagaagatctttcctttttgaagktgtcctgtctgtaggcttcttcatacctgtctgccctggtttgtagattgatttgtctgtctggacaaagaccagactgtcctcgttcttaaccatcactgtggtccgcttcttaaattcttgggttggtcctttcacttggacagtgaggaacattacctcctcattggatgaagactttgggacctgaaatacaggaccgatcctgaaaccccattcagcacccgcaggtctcctcccctatttgctgttgcactcttccctggagatcttgcccttcttacttaacttcactcccttgttctcagcagggaaagttggcatggacaggaatcacttctgccattttacaaatggggagacaggacacaaggtggaggaaaataaatcagtaagagaggttgtaagtgagattcacaccttcatacagctcacagaaacagtcttgattcaattatacgctgagctttaccaggctgatattacatgctaaaagggcatggtcgaagcatgttttacaggctatggaaaaaaaccccgtattttactgacactaggctgtaagcatctcacatgtggacaactctgaagagatattacacctttgctcagggtaatttctacaatttttactcttagaagtagtgtggagtgatgtgttcctgtcagtccaccacgggtggctcatgttgagccttggtctagtttgctttattaatattttttccatcttaattttaagaagtcacattttctttttttttttttcctttctggctaatagggtttctatgtgattattaagctgacttttagtttgcctgtaaatatttgtctcccatggctggakagtcatgcattgctccttaatttctatacttagtttgctacatttggattccttcctgcagttcttascaacctcccaaagcctcatctgacagaatactagatccctatgaccctgactaaaagaaccaagtatattaagtcaaacagccacactcacagcgaaggcgacacagtggagtacgtcattctccgcctccaggtcagtgaagaggctcctgtttcccctgacagactccaaggaagcacttacagtcactgtctcattcaggtagctcagaaggacacagcccttctcagtggtctcagtgtggagcagggaggggaccagaaccatatactgcctgggaatgagacggttcagttagaggaaagtgaaggaagagasgcattgctatcaacagcacttttttccatcatcataattatcatcatcagttctacaccaagagaagatgyactgatgagcatgaaatttggcygttgaaggccatgcataagaattatttcccttttccctcacatgccatggcagtgaacattttacttgaggtaggtcttaaacagattaaaacttgtaggcatgcttcactttaaggaacaatttgtgaacatctgaattcaaataaaaatatgtagttacatttgttcatgttgtaaaatctatttttaccttcaagttgctgtaaaaagtaagcaagctctcagtcatgcggacattacaaaaactaatcaaattatagaattttcattaaaatatatatacacacatacatacatacacacattcagcagccctgtgaaaattgtatggtaagcactcgcttccactccacagatatggaatctgagcctcaaagaaagtgagccattacttcacagtctcagttgtggtaagcagctaataaggtcttaagagtgttacctaaccatggatgtttgcattttaaatatttgcctttcagctcatgattagacaatggctccatccaaaaatggtcctctggtgattgactttagaccttggtaactcatgtgcagtacagaaactttctcagtaccctgacatgtaatttaagatcaaccctgtagtttttatacatttttgctcacagaactcctaaaataatttttggactctgtgcactccttacatattttcaagtaaacatatttttatcatgattttaagtaatagcaaaagatattatttttgatgatattttaaattaatacttagattacttttacaattttctcatgaataataaacactgtagtataagatacctactatcactatttaaaagtacattaaaaaattcttttaatggtctgatatttaatatctttctcttcttttttcctttttgaatttgaatttccatgccaattaccatacagaaatttatcctaaatttttatatttcaaaaaatgttgtgaattattcttacttctttattgtcaagcatctatacatatacgtatgtatacttatgttcacatatatacatatatgaatacatatacataaatacatatatatgtaacatatgtgggtaggtaaatttaactttaactcctcttttaaatagaatgtaaccataaatttataaatattaaacatttccttctgactgagctatgttcaaaaatacttgtatataactgatcaaaacaaaataaatacaaagtatgattcatacatattagatataaaattaaaatacttttgaagcacatctttaatgagaatgatgagytgttttttcccccagtgaatttatgcatccatggattgcaagaattaaacaacattaattctgttactatttttgttttgtgtagctataagtgctaagaagaatggctcacataaaagtaaataaatggcaggtaaaacaattgcatcattgttaccacttcttgcaacttctgcattacatgccaaaaatcacctagtactctattatcaagaatcccttctcatcactcatcagctggtatttccttcagttcctccttcagttgtgttgaaacaaagaattcatcaccacctcatctgcaaaaggatttctcttctgacattagagtcccttgctttttcaatatcaacaccagtatttcaaattgttcctttatttggcactctatagatttttatactccagggcattgttccatgtttggttgtgggagagaattgtctttatttttataaaatagaaaatggacccttgagaaagaggaaataagaaaagataaatagcatggtctcaagtagatcaatatgaatgtgaatatctaaaatttattcttttaaaaagctaaaaatttctgacaccccttaggaaggctttgcatattagagcttcagagagttggggaagaatgattaaaagtaagcaagtaatgagtaaactagatttgtaaaatctggaaggaatcttagagataagaagatgacagtatcataggaaagaaaaaggaakgatataaagaaaaatctgcaataaatgaargactctaggttcatgcttcacgctctctgtgtggaactcacggttttccagagactgaggcgtctgtgggcaggaggaccaagaggagaagaaccagacttggatgaaggagtttgttcttccccatgttgcagaaagaaggagctggaggagamcagactgtattgtaccctactccctacaatccatctggtcccaaacacttcccaaagcaactgggctttatgctgctctgtgtgcaaacaggaagttccacccacacaagayctctaaacaaagttgaggtctctgaacattctctggaaaggtcattgatggcctatttatagtcaaggttaattcctggcgggctaaatagaatccctggagggctaaaactacattcccattcccgtaagagctcacttttaccgtacagcagctaataagcttttcaacctcttctctccctcactcccccacaactcctcacaacgccttttatggtgcttctcacatctcttgtatgaatagctggcaaggaaaactacaatttaagcaacactgggcaggctcaaaatagatatttcactacaagtcagtgtggctgcaagttctccattagatatgcctaacctaaatgtttgaagccacatcagaattcagtagtcctctttgaaaatggcacgaattaaaccagtagctttttgacattagggatattactgggttgcagatgaagagccaggccctggaagaatgatcatagaaaagagtttcctgttttaagaaagtgaaacaaagaaacgtgaagtaacaggacttcaaaaacaaattttgacctattgtgcctaacaaacttcccaattgcctttaccatcgactacacagacttccttactgccttccaaatatgatactcctctgcaaactttaagtcatataaatgatttcattaatccatccatccacccatgcatttattcatccatctattcatgtagctattcagttgctttgtaagtattttttgatcctactagggctagacatcatgcaagattctagagatagggtggtcaaataagtatgaaaacaggcacttaaagattttacattcttgttggggcaaaaacagacagaaaaacaactactgtataaaatacaatataacacctactgtataaaatacagttaaaatacaatataaaactactgtataaaatacagtagccaaacatattattgcagaagttcaggatgctctgggagcacataagagagcacataacccagacctggaaccttttaaaaaaattttgagggaaagcaaaatgtaaattaagctctgaagtatgagtagtggttgtctcgaagaacaaagagatgaaaagagctttctaagcataacgaatgacagatgcaaaggagggagaagaatcacggcacatgcatgaaatgaaaactatttggtatggaggaaatattcctttctgatacttcaaatcagaaaggaatttgtcaacaatattaaggtattcagaggagtactcagtggattgacttcaggtttgtttcctggaaagcttgctcttattgaaatttgaaagggcagctagaaagaggtgatccaggatgcaggaagaccagatgggagctggtgtaataatataggtgaaagctgatggcattttgaactatggaatttgtggtggtattgaaaagagcttgcagatttatatcatatttaagaggtaattatagtgctcagtgaatatatcaatgtgaggaataaaggaaaatgtgtctttccattttcctggctcgtcacggagtgaattgtgttgcctttagctgggtgagtgaaacagaagaaacacagattggtgggagcagaaggaggacagaagggctgagggttgggaagatggagtaagtgcttgtgggatattcacgtattaatattcacaggagtttgacatttgaatcttgagcttacagcagtgtggtctactagaaatagaatgtgatcgccctgtgtaattttaaattttaaattttctagtaaccacataaagagaaacattaaattaattttaatagtgtattktatttaatccaatatatccaaaatatgatcatttcaacatttagccaatataaaattgttaatgatatcttaaagacttttttttcataatttgttttcacaagctggtgtgaattttatacttacaacatagatcaatttaggctagccatacttcaagtggccaatattagacataatataggtaatatttttcagattatggtgttagcatctaagtgggttgtaacatcatgccctgtgagtcatgaccaggattttaaaaaatgaaagagaatataataaaaaatacagtgtatcagacagaataagtgagaatagtgatttgggaaacatctgtttcatatacatgcagcagaggctggtggttgtttcctgttaccacttctccaattctgctttaataatagaactcccgatcctttgctgggtgcagactgcctagttgacttctatgtttttaacccactcccttgaagctgggtatggcatatgactaagttctggtgactggagggcaagtggaagtgatacatgcaactttcagttcatgacttaaaaaaggaagggtacagttctgcgcttcccctttcttccttgcccaggctggaatgtggacatgctgactagtgataggtactgctgtagctcatcagatggaagccatgtgttaaggaaggcagaaccacaaaccaggcacagcctgagcccttgagtcatcaaaagtctacgccagttgggacctttatgtgacagagaaatgcattctcttagttaagccattgtattttgaggtctgttacagcattaaaatctatatcctaaccttatttttctttgtcactatttctgtctcaatcatctgtatcctttactctaagtgtcctaggtcacaattgtgaaaatgtgattacagtgtcacagtgggaactgcttattgaacatgtacaaaatcccttatttttggttaaagttaaagcagtctgaatgccactagcttgatgagatctgctgtacttatagagactatggatttatcagtttattgggcaagctgatgccatggaaatggatgataatacccacgtagaagatgttgatgaaaagagaaaaagagcccaagacagagttacagggaatgctcttgtctaggcaatgggcaggagcacccaagtggagcaagaagggccaattagagaggaagaaacacaggcaggagagtgtgaggtctctgagtcccacggaagggaccgctttagtaagagaatagtcaatagaagattgctactagaccagaatgatcatgactttataccaaggcatcaatgttaatagcacacaacattttaaaaaattattacaaatgatggtataattttataatgtattgattcataatgtaacataatttaaatggtttctaagaygctagaaataagtgagcatttacttggattaatgacttaaaataggagggattaatgttaatagcattcatttgatgcctcatgataaattacaaagatgatctgtaaaggttgtcattgataaattcctggctacccatgtcaagtgccgctgtgaaatcaaataattgattgattttttttttctgctgggtttaaggacaaggacattgggattcagctgtttcagtgccggtgtggggcagaagcttgctgagggtgatggggaatgtgaggaactagagccagtttggcagtttgtctgaaggggagaaaaacaacagagcagtacctgacggagatgccagggtgaaaggaatatttctttaggtggaaataaacttgaataagtttgaatgaaatattgcttctaaaaatgctgagtgggaggtacaaatgacaggggagaagttgagctttttggagtgagaagggatgatcccagagggaggtctctgaaggatgcatgcagcagatgtattaagaatgtgggtggaggaatgatccttaatgggagagatgccgcattcattataatcacagataaaaaggaaagtattactaaaatcgcctttcaccacgacagagcctcctattctttaggagagggaaaacgagcttgagagaaaaaataactggaccagttagttgccaggacacctgagccctacttctaacttagctgtgtggtcctgggtaactcagttaactgctctgagcctcagctttcatgccaatagtggggcaataatatctgtggtctcaccttaatggggtagtttcatacaagatgctaggtgtaacacagctttgacattctgatccttactataccagtgtaaattaatttttatagtttgaatgctaatggctgaggatgacatctatttcatctctgttctgggtttcgctataggaacagcatccatcagtgtttccaggaaaaatcaccaattgggttacctgagtagcaagttcttgacagaaaagggagcacacaatttgaaccagttctatacagttttgaagtatttagcaaatactgctagaaagctgaggtaaaggggtagagcgaaaaaaaggaagggaaaaagatagtccatggaaaagaaagtagaagagcaaaatacaggaaaacacataacagtaagaacaaacaaggaatatttgggaaatgagagaaattaggattaggaggtasgtgggccttaacaaaaataaatagaatcaaattttctccttgtattgctatagtgcttcccaggaactgaatataacttatttaattgtaccaattgtacagttagcgcacattgtccttgaaaagagaacacttaagcttcccatagtcctgacagtgacgataatgacaatttcatctggttacatattaactagtatcaaaaacaagctcagtaggtggcataaccatattcaccctattagagggtgtactggctttgtctttgacgaagtatcttgggcaaaatctgcagtgaaggaaatatatatctacagagatgtactcagtgatcaaagagcagagtttttctcatttgtgctatcccactaacrtgtgtgtgtgtgtgtgtgtgtgtgtgtgtgtgtatttttttttttcagagacagggtcttgctctgttgcccaggctggagtacagtggttagatcatagctcagtgcagccttgaactcctaggctcaastgatcctcccatctcagcctcccaaatagctaagactacaggtgcactccaccacgccccgctaatttttttcttaagctttttatggagacagggtcctaccatgttgctcaggctagcctcaaagtcctgrcctcacgggatcttcctatctcggccccgcaaagtgttagggttacaggcatgaaccatcatacccggactttctgctttttaatgagaaaaaatatttgaatatacaaagataaaagcacatcctcaggttgttttcattctaatatgcytccatcatttctcaaaattatcaaaaagcactttgggagactgaggcaggtggatcatgaggtcaagagattgagaccatcctggccaacatggtgaaaccccgtctctacttaaactacaaaaattagctgggtgtggtggcgtgcgcctgtagtcccagctgcacgggagactgatgcacgagaatcgcttaaacccgggaggcagaggttgcagtgagccgagatcacgccactgcactccagcctggcaacagagcgagcctctgtctcgaaacaaacaaacaaaaaaacaaaaacaaaaagaaagaaagaaagcgttttatctttttaatcaggatacacttggtcctttaggtttctaaagaggactgatttccacacataatccattttattagatcctatgtttgctacagaggaattagtgtttggactaaaacaatttactacaaacaatagaattcaatggctgtcctaacatatttatactttggggcatgccgaagtatttttgtataatgaatctgtycccattgtgaatttgctatgtatatacatttcaaatttatagatactatctcatcaactttctaaaatgccaacttaccttctcactagcaatgcttatgtgtatatattttcccagcactcatttaaaattttaccaatctgatggggaggggagcatgatctattttgtcttttctttttcaagttcatgattactggtgatgttcagcatcattgtcacttgtaggaaccctgttgcttataatttatctttgtttaactttctttttgtttatactgtatctttattttctgattaagaaatccttctgcatatgcatactgaaattgtaaaaatattatcctgcattttttcctacattaagtatttgtgtttagattttaatcttcatctgcagtttattttggaataggaagcaaggtgggggaaatgttacaggattacttttcctttgatgaacagaaaataagygtatgcgtgtttgtgtgtgggtttgcacaaggttggttcatgacccttaaccataggagcccctttgttcactgtagtgctcatgttcgctgtggaactttccagtgtcagaactttcattttagagagttctacttagtttgggagcaaacactggggttaaattttaaaagtaggaaagataaagttgtttgccaactttacttaattactcagatgatgctgatgataatgaggctaacaacaatagctacaacagtaacaggtaatgacagctagcaattacgtagtacttactatataaatgggctaagacaagttctaagagatttagatgttccaatttttgttatgctaaaagattattttgctaatagttgaactgtcggtccctaaacccacaatttacagtaatattataaaaatttattaaaaagtaattatggaatatattgtataaggtattattgaaagttctcaagttttaaatagtgtagctttcataattcatttattttcaaagcaagttatacatacgtactctcattatttaatttaaagtaatgcagtataatttgaaggttaaattacaagttatttataaagaaaagggtataaaaaggcatggtatttaagatgtaagtatcaaactggtttttgactttggcagtaattataaataactatttattaattagacatcataatgtaattttttccatgtaattaaagaagtggtatagactgctaacatattttaacttttattagaaaataaaacatgttaatttttattagataaaataatttgaatatatcttgttactggtacaaatattttaggacataattttataaatgaattttaagtgaccttatttaatcttgtatatagtagttccccttatccgaggggcatatgttccaagatccccagtggacacctgaaaccacagatagtacctaaccctatatatactatgwtttttcctatacatacatactkaggatgaagtttaatttataaattaggcttagtaagagattaacaaaactgwtaatagaagaacaattataacaatatgccaacatcactactcttgagctttgggaccattattaagtaaaataaggattatttgaacataagccctgcagtattgagatagctactaagtgactggggtgggggttagggggaataacagcagcatatacagcatggatacgctggagaaaggaatgattcatatcccgggtgtcaagattttatcacaccactcagaatggcacacaattgaaaatttatgaatcgtttatttctggaattttccatttaatatttttggaccctggatgaccaagggtaactgaaaccacagaaagtgaagctgcagataagagagaacaaatatactatctttcttgcataaagcacatcagcaatactaattgactacatttctagtttcagtttcttccttgtttgtgaagcaattagagtattttcctagatcctttacattatcccttaaactttatagtaatttcctctatgcctaattcaatggctttttttttttcgcggaaaatgcaagatgagcctagaatatcttatcctaccaaacagaaaggatgctgccaaagactattagggttatgtcgaaaggactcagctgccgcccttaacccatttcctatttagaaaaaaaaagtgcagctccctgccagcattcatttaattttagtaaacacattctttgaggctggagcaaatctgactgattttcaatgtgaaaataaaatataaaagctgttcttggagttatttctaaacagaacttgtctctaatcctagtgtaacagacatgtatgtgatgttaccttaggatcagagacaagaggattctcggggcaaacgggaaattcattaagatgtttccacttgccaaagatgggataccattgatggtagccgctgctgccataatgttggctgcagtggagccggtgggagctccgtcccttctgagttggggccagagctccccggtgccgctgcagctgcccaaaccgaggctgcagaccgcggcctcctgctctatggagcaggtaggagccccgcccaaactgcggctgtggatctgagcctccctgtgctcttggaaggggctgggagcaggcaagatctacactccccgtgcggctgcagcaccccgaccagtggctgcagacctgggcctactgctccactgagccagagagagcccgggacaagcgggagacctgcccattcccagttggctgcgcgggagattccctggtgcagctgcggcaccctcacaggtgcasgtccaggcatctctgcagcctgcaccctcgagagccgggaagaccctccccttctctcgaccctgcaggctcaggggtgtctgctcccattgcctggcctttctcctctcccagagcctgctccaatcttggggctgagcccaggggccatgaatggcagcgggaggcaggcagactcctgggcagaagggggcaggtcccctgtaaggccccaccttcaggccagggaggacctgaaggttgggatcccggcagtcagtccctaggacttgtggtgcctcctttggcctgcctatggctgcccatggatcaatcagcaggcatttcctccaccccataaaagcctcgggctcaggcagagcaagagagaggatggagggacaggaagaccagttgcagagagaagctgccctctctgctaatagcaggagacratgggacaaccagctgcacagaggaactaccctctctgctgagagcttcagagacctgcagagacttcgggactacagtgcagagaggagcaaggagcacccgctccagggcctcctctctgctgagagcagtagatgttgggaagacctgcctacggagaggagctacccactgtgggtctcctctgagctgttctaaaatttagtaaagctcatcttcrtcttgtccttcacttgtctgggtacctcattcttattgtgcacccttcacttgttcgtgtacctcattcttcctgtcattcttcctggatgcaggacaagagcttgtcgccagccgcagaagtttctggccagaaaatcgacacctcaaagcactaggtaataccttgagtttaagaaatacagaaaatacaatcaacttaagctcattaaatatatttaaattcatgagttaatgatatatttttaatccaattgatcacattattttcaattgacgaaaaattatgtagacattgtgtgcaacatgtcattctgaaatattatacattgcagaatggcttcaatggcatttttaacgtattcctctccatggactctttccaaagacttttaatctaggttttagataaaaactgagttttaaaatagtgcgtgtatgtatattttttgtttgtttgtttgtttgttttttgagatggaatcttgctctaacgcccaggctggagtgcagtggcacaatcttggctcactgcaacctccacctcccgggttcaaatgattctcctgcctcagcctcccaagtagctgggacaacaggtgctcaccaccatgcctggctaatttttgtatttttagtagagacggggtttcaccatattgggcaggctggtctcaaactcctgagcttgtgatccacccacctcggcctcccaaagtgctgggattacaggcgtgagccactgtgcctggccatgtttatattttataagttcgtgtactttattcctcaaatttataattacartaatgcaactggcataacagaatataccacaatcatacagggtgagcatataactcaactgttaggagcaaaagtatgtagaaatattagagattattattaatcacagtatttaatattgtactagtttcattttctgaagtggagaatgttatttcatccggtgaatctcttaagacctagcatttttactataactcatttgaatgttatataaaatatattctcttgaaactttatttcaaaacagtaacaactttagatttcatatttaggacacaatgtgtatgaagcaacttttcaagtgacacaggactttttgagaggaaaacttgagtttgctgtttcttctgtggctcattttataaaccaagcgagagtcctggtagaggcttaatttttttcagaagaatgcctaacttacctgctgcccatctgatttctaaatatggaactttccgacatagcaattaagaatacagggactccaggtctttcagtgggctgctatctagcccccatccaaagcttgactaacagaggtgatgtgtataaaataccatactgctccaagcctagaagtttcttttaagtatgggtgctccctccctgttcttgtctccaccatggaatacaatggactgcaatctgactttcagctgatcactgcctgaaacttctgtgcatagttctctgcctgggattctgctcccaccagtgaggacgccttaattttttcttttactcacytgtccatttagtctgtatatcatcacgagacaatgctgaagtgtattagactttgctaaaagggttagagtaattaattacagaaaacattataacacaagagggaaaatacagagctatatggtaaatataccttgtcccgcggtctatgagtaaaagctctagayactacattctttctaggcggtctgtcatggacacactcagctcctaatctcagttccttgttctcaccttcttcctatccctttattaaagcacctcattcttctcttctctgctatctttccaacaaacttttgagaatgtctgtccagtcctcctaggaattgattcatctctccacagcagtacatttttgccgtctgggttkttctgtctagaataatgccagggaacggcctttggtaggacacccagtggtgggcttggttagctttctgaggaatatggactgtgctttaaattctgtggcagtccatggtgagtttaggagcttgaagcctggttccctcttaagttctcctcaccagtggttttggtgttttatcagcccttttttgggtcccctcatagcacaaaacccactcatagcacaaaaattcttataattggtaataatgcaattaaaatttccgattcctcctgccgattgcagctccttgaaccgttctctgcctcaccctaacttcctgcagctttcgccagtcattggccacttagtcctttgggggctgggcagcggctccgtgcactttggagtcgggggcgccttcctagagcccagcatccactggggctccgaagccgtagcctgtctgtgtcctccacccactttgtgccctcatcctcctctggggctatggcagcggcgatgccagcgtcctctgcaggtccgacaggctgctgacgggcaccaagatcaccacgcagaacatccacgaccacttggttcctacctggacaaggtgcgggctctggaggaggccgggtgagctgaaggtgaagatctgcgactgggccccggggccccggcaattacagccactacttcaagaccattgaagacctgcgggacaagattcttggtgtcaccattgagaactcccggattgtcttgcagattgacacccgccgcctggctgcagatcacttccgaaccaagtctgagatggagcagtctctgcgaaggagcttggaggcagacatcaaggcctgcgcagggcgcccgatgagctgaccccggccagggctgacctgaagacgcacatccaaggcctgcaggaggagctggatcacctggagaagaaccacaacgaggaaatcagtgctgcgggtggccaggtcagtgtggaggtggattctgctccaggcattggtcttgccaagatcccgggcaacacgtgaagccagtatgcggtcataactgagcagatgcccaagatgctgaagcctggtcaccagccagactgaggatctgagctgggaggtcgctggccacacggagcagctccagatgcacaagtccgagtcgcggaccggtggcgtaccctccggggtcttgagattgagctgcagtcgcagctcagcatgaaaaccgcattggaagaccgtactgcaggaacggaggcctgcgttgaggcccagctggtgcggatccaggctctgagcagcggtgccgaagtccagctgggcaatgtgtgtgctgactgccagaggaggcctgagcaggagatcactgccgaccgcatcctgctcgagcgccagaaagatccttacagcaacctgcccacctgcaaggtccgctgagtggcaggctcctgggcttctgctctccttcagagggaggatcctgggtaggggatgggaagggagggacccttactcctggctcttccccttacctgctaataaaattttatggcccaagggggtggggggaagaatgcaattaacttccaaaccagtttttcttacaccagttttctctggcagaagctggagtggggtgactgggtctgcgggtatttcatactcgctgttacatgtttttgaaatatgtgaaatctgttctctttgctatgtatttaggctctaactatgataaaaccagaccaccagagtactacacacctggactatactatcttgacttgtaatggggtttcatgaagtggcttgcttttgaatgttaccagctagccataacctctttctttctctctttctctttttctctttcttcatcaaaagatagtttcaagaaataaccatgtttattactcaaaacctacacaggcacatcgggcatatcctaggcacttaataacaatcggtattcattaaatgaagaactatattaaattaatttcttaatttggtgctaaatataaatttttattgaaggcattcattatcactagttgatgatacatttattatttcattcaatacatataaattctgttggtgactacataagtacaaataaatggtcattactatttgaggagagagatagagaagaaagtaccttgtaattttttaaattttttctaatctttctctgactataaaaagtaatgtatacttattataaaatatataagtatgaagaaaatataaagtaatgtgtgagctacccaccaaattcataaactgaaagtattttcagtattattgtatataataatatatatgaagatgcaggtatgggttttcctttttcccattttacccatttttttttcccgagacggagtttcactctgtcgcccaggctagagtgcagtggcgcgttctgctcactgcaaactccgcctcccgggttcaggagtagctgggactacaggcgcccgccaccacgcccggctactttttttgtatttttagtagagacgggatttcaccgtgttagccaggatggtctagatctcctgaccttgtgatccacccgcgtcggcctcccaaaatgctgggattacaggcgtgagccaccgcgcctggtgaaccatttttaaatgtacagtttagtagtgtaaagtatatacacattgttgtgagacagattttccgagcttttatatcttgcaaatctgaaactctataactactaaacaacctattaaacacttcccctttctcctcttctctgtccctggtaaccagcgttcttctttctgtttttatgaattggcttggatacttcatataggtgaaataatacagtatttgtcattttgtgactagcttattttacttagcaaaatttcttcaaagttcatccatgttgcagcatgtatcagaatttcatttctttttaaggctgaataatatttgattgtatgtattcattcttctattgatggacatttggctcgcttttacttcttggttattgggactagtgctatgactgtggtatataaatatctcttcaagaccatgttttcaattcttttggatatacacccataartaaaattcctggatcatatggtagttctatttgaattttttgaggaaacttgacggtgttttccatagcagttaaaccattttacaatcccaccaactgygcacaagggtttcaatttgtccccatccttgccaacacttgttactttctgttttttttttatagcagccatcctcacagatgtgaagtagtatgtcattgtgattttgatttgcatttctctggtgattagtaatgttgagcaccttttcaatgtttattagccatttgtatatattctttagagaaatatctattcaaatattttgcacactttaaaatctagttatttgatttttttttcattgtttagttgtgggagttctttatatattgtggataataacttctaaatatattctttgtaaatttttttttcccattttgtatgttgcccttcactcttttgattgtgtcctttgatgcacaaatgttttcaagtttgatgtagtcccatttatctttttttgcttttgttacctgtgcttttggtgtcatatctaagaagtcattgacaaaccccatgtcatgagattatcctgtctgttttcttctagaaatttcatagttttaggtcttatgcttatgtctttaatatattataagttaaattttgtagatagtgtaaaataaaggtttaactttcatttccattgttcccaacaccgtttgttgaggagactatcattttctcaatgagtggtcttggcacccttgttgaagatcatttgaccatatacacacaggcttatttctcggctctttattctattacgatggtttatttgtctgtctttatgccagtgccacactgctttgatcattgtgtctttgtatatgctttgaaatcaggaagtgtgagtctaatacctttattcttcttccaaagttgttttggctatttcagattcctcgagattccgtatgaatttggggatggattttctttttaaaagtgagagtttactatacattttggtcttccattatttaaattaaaatatatgttggggacagctttccatgttagtatatctctattaagaggtaatttgaataattacattttataattttatgtatattataatcaatccgatagtgatatttaatcagatttttgttattctagttatcacttcaatgagcatccttgtttttgaggtatagtctgtaaggtaagttactagaggtgaaaaagttagatcaaagggtaaacactaggatgtaaattccacaaaggataagatgttgttcattgctgtattcccagtgcctagaacagtacctagcaygcactgtgtacaggtgtttgataaatattcagttaatgatgaaagggtacatactatatakacgtttatatatttgtgttttatgtatgcttatataaatatcaatataatttatatacatatatagtttatatacatatatatacacatttctaaatttctaagatataactcttgagttgaatctcayaaaaaatgagaagatattttccaagcagactgtggcagacactgctcattggctaaactacccacaacatccctctctctaggcatcttcaaaccagagtgactatggtgctgtttgggcaatgagatataagtagaaaactgctgggtagggcttatgggaaacatttgctttcttaaaaagaagagttgtagtgggcatacccctgaatgtccttccttgttcttacttaatggaaaatagatgtgatatttaatatttcaatgaccatcttgagacagcaaagtaacaagcagggggatgaaggtctgcatgttaaggaagtctgaaagataaaatgggccttggtcctcatcagcattattgggcaattctatcaaccttggaacaccaacctatggactttcctatttgtttaagcagctgctagttgcttttctgttatttattgccagagggattccagctgatacaaaatattttcaagataggtcagtgtgataaacgacatgggttgtgaaacaacatacagtgttaagtcatctgcaagtacagaaaggaggtcaacttgactgtggcttagggattaggctaaagagagagagagtcagagccctgtgtgccatgtgaaagaatctggtttccattctgcaggcagttgtgtagataatgaagtgagttaggcatgagagaaacatgattactctggcatgaatatgacacacacattggagaagggcaatatagtcagcaggaagaccattcagggggctaattcagtgttcagttggaagaaaatgagggcccaaagtaagattacaacagtgggaagagtgagaaaaaatatggatttcaaatgtacgtgatgtgacctaataactactttaatatatatgggcacattggagagagaagttgtgttactgcaaattatcacatctgaagcaccattgaggtaaaggacacaattttctaataaagtatttaaagaaaaaatttccacctgattaatgattagatgtatatccaattatgaaacactactgatcacaaaacacatcttgatttcagagatgtgaaaagatgtgcctctttgaatgaatgaaaactggtatagctaaactaatatttatagatactgtatgccaggcattgtgataggcaccttgcttatttcacttagtgaactcaaaactttatgaaaaaggtgtgggtttttttttcattttagagataagtaaaggatgattgtagatttcctactagggcaagtgctgggtttgttgctaataacagatagggaaagtagacatattgaatttgaggttcttttgagatatccagtgaagctattcaagtagggagctgggcacagagttcagaagttaaagaaaaaagtgattaattgggttcagtcaatatttaaaggctgacaatgagccaagctcttgaattaggtactggggatgtgtggcaagtaaagcaatcaagtggagagatggatattatttagtcagttcacaagaattttaatgcrtattttgtatcagatactgttctgtggttaacaaaaaccacatgttcctgccattggggattatacattcctgtggaagaatacagatcaaagtatataaacaaataaattaaataaggtaattccatatgatgataaatgctgtgaaagaaaaaaatgtttcttttcttccctgaacatccagggagatccaacatagattgtgcattcagtcaagacctctcttatgatatggcatttaagctgggaatttatccttgcaaaaagggagagggcaagttatacagcattataggcagagggaagcatgtgctaaactccccagacagaaataaagtattcaagattagagagagggccaatgtgctgacacatcatcaccaaagaggggaaaagtatgaggcaagagaatcacggtgaaaatagcaatctgggagctacctatacacactattaaaagttgtagaaatgaatgaagaaaatgtagagtgcaaagaacaagcagcatagatctaaatctagaagaatctcaacatttagagatctgataaagaagaagatatccagaaactggtctgtggaggaggggcctcagaagaaaaacagaaaagtgttattttacagaaatcaaaggtagagattgtcctaggaagtatagattgttgggtttaatgctgctggcaagaagcctgctctcaatatcaaccttggtagaattggaaggaagtctacagaactcttctttccctggttagactttgcctgtcttggtctcaataactatcatggcagaattgcagaattgcacaagggactacagaacccayggtgttgtggagaagaatgccacttccaatctctccatcattccccacctcaagtgcttgactccggtctcaagatggaggctataatccagacctcttcgtaagagaaaatcaaactaatgcctatacacccatacatctctatttacttcggttgctacaagaaaaagacaccaggtgtcttttttcttttaaaaattttattttattgtggtaagaacatttaacatgagatctcccttttaacaaattgtaagtgtacaatatattattgtcgactataagtacaacattgtagagcaaatctccagagcttatttaccttgcttcactgaaattttatgtccattgattacaaactccccgttccctcttcagtttagcccctgataaccactgttttactctttgattctatgaatttggctgttttagataaatcatgtaagtggaatcatgcagtatttgtctttctgtgacttatttcactgagcataatgtcctcaagattcattagttttgtcgtatacagaattttcttctttttaaagaagttcgcccttcggtgctggaaaggcaactgttgggatcttcagaggctctgcagccaggggtggaggcagctggggaggtcctagccatgtaaccaaaccgccatcgctcctctcttcctctcttctgcctcttcctgtctagaaaataacttttttactctaatgaaagaaaaaagtagctgtctgcccctcacaccctttcttcctgtcagccctctgctctgtgaggaagccctgggggctgctcagctgctgaggcagcgcagccgagccccggcgttcccgggccgccccacctctgcctccttgcatcccttctaccccagagccaccaccagggtaggcgagatggccgcctccatgtccttcgtctccaagtttctccacagcaaagggctcacgaacgggcaacagctgcagaccttcagccacagcctgcaggaactgctgacagaacattataaacatcactgattcccagaaaagccatacaaaagatcaagttatctttgtattcgcatcaaccatgaaatggatcccctggacaggcagcacagtggattggaccgagcagtcaggagctgttcaagcttttcccaagtgaactcacactctgggttggactcacgctcacctcaacctatgagatgtctgtcctgcagaattggagaagatggctccatctgtgtgctgtatgaaagccccaccagcagggggtagcactcaaaacagcaccgacatacaaatggtagacagctgaataaactgtaaggacgaatttctcttgggcagaaccagcccttccaaaaactacagtatgatgactgtatcaggttaagatggatcatcttatagtgcatggataaatttgattttggctttgggtgggctcctattggggatggattatggaatttaaaccatgtcacagctgtgaagatccggcacaagatagagtggtaaacatttttttaaaagtgacagtgccatagtttgtacagtatctttcaataatttaatagcctatgagtccaagtaaatgatcactttatttgctagggagtgaagtcctagagtgatttcagcttctcccagacatacttaaatttttacatcaattcctttaaagaaaatccgtatgtcaaagaacctttctctgtagtagatctcgcagaggaatttgaactatcacacttgaaaattattgtttacctttttggcagctcaataggggagctcaacgttttaaacatagtagtactggaaattttacgacaagacttttacctagcaaatatttctaaatgtacataaagacaagctagcaaacatgacctgggaaaatggtcagactttgtattgtgtttttgaccttgaaagtagcaagtgaccagaatctgccatggcaacgggtttttaaaaagacccttagaaagactgtttcaactgtggtgttggcaccagccagctctacgtacatttgctagcttgtagttttctaagactgagtaaacttctattttagaaattggaggtctggtttgtaactttcctgggtaaaagtattttcatctattttgtgaactttgttaatcatmttttatttggtaaattatgaatgggtatacatttgtacagttcgtgtatattgattgtggcaaagttgtattgatttctatattttggatgagaaatttttcttctgtaataaattgtttcttatcttggcatttaaaaaaggcaatattccattgtgcatgtgtgtgtgcatatatgtgtgcatatatatatgcatgtatatataatatgcatatacatatatacaaatatagatgaatatatacaccatgtttccatagcagttgcaccattttgcattaacaccaacagtatacaaagattccagttttctccacatctttgccaaccacttgttgtcttttatttgataataggcatcctgacatgtgtgaagcgatatctcattgtggttttgatttgcatttccctgattagtggcattgagcattttttcatatacctattggccatttgtatgttttcttttgaaagatgtctactcagatccttgcccattttaaagtcatgttattagtttttttgctgttgagttgagttgtaggagttgcttatatgttttggatagcaaccccttgtcagacacatggtttgmaaatattttctaccattccatatgttgtcttttcactttgttgattattcctttgctttgcaagagctttccagtttgacatagttcaacttatttgtttttgttttcgttgtctgtgattttggtgtcatatccaagaaatcattgccaagaccaagatcataaagcatgtcttttattttttcttatatcagttttacagtttcaggccttacttttatgtctttaatccactttgagttaattcttgtgtatggtgtaagataaacatcaaattttattgttttgcttatggatatacagttttctccacaccatttgttgaagggactatccattccccctagtgtattcttggtacccttgtcaaagaccagttgaccttttatgggtgcatttattcctgagatctctattctgtcattgatgtttatctgtctttatgccagcaccatactgttttgattactgtggttttgtactaaattttgaaattaggaagtgtgagtcctccagctttcttcttctttctcaagattgattttgttatttgtggtgttttctcattccctataaattttaggatttccttttctatttttttaaacaataccaatgtgattttgacaggggttgcattgaatctatagattgcttttgatattatggttattttgacaatagtaaatcttccaatcaatgaacatggtatatatttttatttaattgtgtcttaatttctttcatcaatgtttttgtttccagacacaggtctttcacttccttggaaaagtttttccttaagtatttaattcttttttgtgctattgtaaatgggattgttgtcttaatttccttttcagagtttattgctagtgtatagaaatgcaactgatttttgtaagttgattttgtagcttgcaatcttactgtatttgtgtattagttttaacagttttttaaaatggagcctttgggatttttaatacataatataatggcatcagcaaacaggaaaaagtttatctcttcctttctgatttggtaggctttaatttatttttcttacctaactgttctggctagggctttggttctatattgaataaaagtggcaagagtgggcatcattgccttgctcctgttcttaaaggaaaagctttcaacttttcaccgttgagtctgatattatctatgggcctttcatatatagcctgtattatgttgagatactctcctatttatagtttcttgagagtttttaacatgaaagaatgttgaattttgtcaaatgctttctctgcttgtatttrtataattatgtgattttttttccctttattctgtgaatgtggtacaaatttatacatactgaaccatccttgcatcctgggaataaatactacttggtcatgatgtatgatccctttaatgtgctgttggattctatttcctaatatttttwaaatattttttgcatctatattcatcagagatattggcctgtcattttttttttcttgtagtgtccttgtctggctttggtagcagtgtgctactggccttataaaatgagtttggaagtgttctctcactttttggaagcatttgagactgattggcacttttttaaaaaaatgtgtattagaatctacctgtgaagctatctgatcctggrtttttatttgttagaaggatttttgttattcattaaatctccatactaatgataggtctgttcaaactttcttgatttttacttttgacatgttttgtgtatttgggaatttacacaattcttctaggttattcgattagttgacatatttgttcacttatgatcatttttatttctaaaagagcagttataatgtatcttctttcatttctttttttttagtctaaataagggtgtgttaattatttttttcaaaaaacccactgagcctctttgatttttttcttttcttgttttatttatttcttctctaatttttgttatttctttctctgctaattttgagcttagtttgttctttttctagcctcttgaagtataaatttgggttgattattttagatctttgttctttgttaatgtaggtatttatcacagtaaacctccttcttaatagtgcttttgctgaataccataattttagtgttttttatttttgttttcatttgtattaaggcactttaaattccttcttgattccttctttcactcaatgacttttcaagagtctgttgtttaatatctatgtattttttatttttccagtcttccttctgttattgatttatagtttaattttgttgtggccagaaagacacttggtgtgatttcaatctttctaaatttgttataacttattttgtgacttaatatgtgacttatcctggggaaggatctgagtgcacatgagaagagtatgtattcagctgctgtttggtggaatattctgcatatgtctgtttggtccatttggtctattgtgttattcaagtctgctgttttcttatggatacagatttctgtctgaatgatgtatccattattgcaaatagtattgaagtttcctactattattttattgctccctatttctcttttctgtttttccaatgtttgctttatatatttaggtgttctactgttggatgcatatataattgtaattgttatatattcctgttgaattgacccttttatcattataaaatttcccttttggtctcttgtaacagtttttaactcagtctattttatctgatataagtgtagccactcctcctgtaagagttaaagaaagaggaaagaaacatgaaaaatggctcaacagtgaaagacaggtttattttggagaataaacctgagaggggattctgaccaattttttggtcaggaccactctctcttacagactaagagtatttaagggttttagggtaagagagcttatcacaggcttggaatgtttctgtgtggaggagaagtttattgtggggttggaatgtctctggtcagaggggaggttatcttgggrctgcatctctctggccggagaggaggttatcttgggatgggcatgtctctggctggggaggggtttattttcgtgttggaatgtttctggtcagagatgtcatttgtggtttatggtcatgctgacattagccattaggctgatgccctttggggcagtttttgggtagttgtctgtgaaatggccatgatcctgtcagttaaaaatctctggaaaagattaattaggcagggtaagaacattagtcctaggcatagtagtaggggggggcccaggaatgggatgacccatgctatggtttttttcccaaatcaagaatccatttggttgttttggaattcccttagctctttggccctttctttaagttatttagcagtgtttcttactcggcccaattggttgagatagaagcaacattccttacctaatgagaggcagaggcacatgtttggaaagggccacgtgttattttctgccagtaaccgttattaaaaaataaatcatggtaggaatggtttgcattattatacttggtttaattatttgcatacagtgcagcaagaataattatttgttacctaggccttttaaactggcattgatggaattttgttccatagaaggaatctgagataaggccttttaaagctgagcccagtcatggaattgtaccattaaatacctatgagttgggtgaattcctctcytcctgaggttccaagataacttgggggtactggcctgtcagaaagtgacattctttacttaccacaggtcagaaaccctgtacagggactgtgcacataaaatatgaggccagtttcccgagagttttattggctccataagtcaagtttgattccttaaaggacrgcacacctctccagtcaaagccttggtaaaataaccagtttttcaaatcatgttctgttacaaaataaaacagattcttattgcactgatggaaataactatattgccataacttaaatatactcaaaaagtaaaaaagattacttcagtctctaggggaccaaaaacaagacaacaattgtttatggatgacaaaaagttttatagtagccataaagttacaattgacaagaatatctgttacctttgtggcatgcaatattttaacataacaattataattattactgataacgtacactaagatatatcagaaatataggagtctcttataactttggaacacataccaataacatatgtatgcaaatatagcccaaagaaagccaaacaccattttatatttgacaatgcttcctgtatgattttataccaaataagctaaacctttatattagtgtgctactaatgttaaactcaatttttaatagaaccttgtagatacatttacccgattttaatgtttgaccataaggtaagatttctatagaccctttttaaccctttataatttttgttaaagagcaggttagtgctttaagagaaaccaaacccactgtgcttttattttaatgtcagtttacagaaaaactggatgatacttcttcaactttagccaatatatttacacacagaatttcctttacaattaaccttccaaaacttgcttaaaccttcatttttattttattcaacttaaaacaattctttaaccttttaatctaggtaaaaatccacattctcatgcctccttataatctttttaccaaaagtatatgtaaactgttttttcaatagtcttaaatacatgttacactgttaacttttagcaacctttacttttgttggtaagtttkggattttaattatgtactaggtggagagcctaggacccagacagaagttcagataaggtccgacttattccagcatttaactccatgtgtcctaggtcttacctagctgcaaagcaggcaagttgtacagctaagagttatatggcattttataaagcattcaggagtcctaatcacttttaaattgtacaacatttcttgcataaattcccttttataaattttttcatgacttacatggacagtctctgacatgcctcgactttgttgtaaacatccctctctttaaacaactagttaatttacttcaggacaggaatttaccatatatgattcttttttgtataaattctcttttctttaatatcaaagatgataacagtcctttcccaaagcaaacttccttcatgtctgtgcactagactgcctaaggccacaaaattagaagttagggtatttcactaaatagttcaagatgaagctatctttattaaaccaatattaatgtttcatttattaaaaaattacacaagcaaagattattctgtttgggctgagttatagttttgtagtctctatgccaaattttgacacctaatagtatttggcagagataagtatgaaattgcttgattaataaatgcaaacaaaaatgtatgctggcaactcttaaaacatttctaattttactgtgccagtaagttttaaagattaaagtcacgtgaactgaaaggtcccatagcttttacttttcctctaaaaatatttgatttaagcacttatttttcttaggccagtcaattagagctttttaaatagacattgcacacctaacacatatatagccacacagacaaccagaagaaaatccagtagttataagattttttttctaattttccaattggattattggcctttgggtgaggccctttaagaacagggctaggaaaataatttccagggcctaataaacaagtaaagctgagagacaaagacagattttgagaggtacttatttacctctaattccaggggttccacaacgaaaacaaaggtttttccycaaatgggatttgtggcaacttttctgttttcccaaggaatcccaggccaccagragtcattttagggtctttaatacctgcaccaagagtggcaagaaagaatggagaaaagtaattcagttgactgggaaaaaaccttttccaggaaaacaagatttatgaagagaaaaacataaaggcctttgaatatactcatagcttggacatcgattttarttaagctgagtgctctttttcatcaggggtgagggttgaggttagaattatrtaaataatataccaagttaaattaaaggattgggttatgtgcaggaattccctgtgataatgagagggattttcagagaaagatccaaggtgctgtttaatctgtgacaaatcagacatggagaaagggacatgaacacaagcaataccttcgaccctagccacttcccagagtaggagaaaggcagaggtggtttgactggttgaagcagtttttgaatgagtaacaggtggagaaggaggaagagtggagtttggggctgagggttcggacaggcaagaagtggatccagggggatgaggatagagagggcattcatctgtagggtcaaaaggggtttcagaggaaggggtttagaaggaaggaatttcagaggaaggagaaacctggggagggttttattaagaaggatttcatgaggggtgcaagcttgacacagggagggtcaggatcttaggtagaagaaagcctgaatattcaggcaagaacctcctgccatttgctgttcctggttataaagttgtcaaggtccctgagaatttgaaaaatcaaaggtgccattttcgggccattagctgtcattatctaatttgcactggggcccggccacgttgcaataaaaagccamacactttggctttatgcttcccataagccaagtttggcaaggctgtgaaggagacagctcagtggagaggacataggaattttggattgttgagcacctatgtggactggtaagaagaagcctagggtgtctgtttttgttgtaggtgtccccagacaaaagacagagacccagaatcctctttctaaagagaacaattaagctgagaagaaactgggtgtccccaagatttcttctagcctagtcccactggtcctctgaggatcaggatggcatacctgactttcccgggtaccatgagaaagtcaggggaaggcagatcttaccagttggctggattagtgtccaatattggatgttccagttggaattggcaaagggcctcttgaaccagagccacatgaggaagagagagagagagagagagacagagagagacagagagaaaggaaagtgaggatgagggaggaggaggggacaagtgttagagagcaaaatacccactgtgggtggtcagaagtggtcaggtctcaggactctgagagcccactggagagtagccccagcctgagcctcacagttcccttcaggttagttgtcctgctcatgtaaatcacttgaaaagtgaagtaagaggcaagatggggtggttggccagagactctcaggatccagtgggatgagctgccrctgcccactgcttcctgggttgcaagagagcctctacccacaacacccgtcctgggttttggcaccaaatgtaagagttaaagaaagaggaaagaaacacgattagtggctcaacagtcaaagacaggtttattttggagaataaacctgagaggggcttctggccaattttagtcaggaccactctctcttacagactaagagtatttaagggttttagggtgagagagcttatcacaggcttggaatgtttctgtgtggaggagaagtttattgtggggttggaatgtctctggtcagagggaaagttatcttggggctgacatctctctggccggaggggaggttatcttggggcaggcatatctctggtcggggagggtttattttcgtgttggaatgtttctggtcagagatgtcatttgtggtttatggtcatgctgacgttagccattaggccaatgccctttggggcagtttttgattaaggggaactttaaaatgccagtgcttgtccaagatgatgatactcctgccctgtcacctactctcttgtgattaccatttgcatgggatatctttttcatcccttcactttcagcctatgtgtgttcttaaatctaaagtaagtaccttgtatatagaatatatttgggtctgtttttttaacttttcagtcactatatgtgttttcattgggaggtttactcaatttgcatttaaagtaattgttgataggggaagatttatttttgccatgttagttgttttatgttagccttgtaattattttgtctgtcttttcctctcttcctgtcttccttgtgttttattgtttttttgtgtaccaatatactttgatttttaaatctctgtcttttgtgtaacttttatagactttttggggttaccttggagtctacacaaaatatcttgtagttatagcagtctgttttaagctgataacaacttcagtttaatcacatacaaaaactttgccctttatcatctgtccctacacactttatttttgtgaaaattgatatctattttatgttttaaaacatattttagtttgttatttttaatacttttctcttttaacttttaactggaagtaaaagtgacttactagcattacagtaatacagtatcatgtgtttttctttatatttgcctttgccaatcagtttcataccttctcttgatattgtgttgctgtttagtgtccttttctttcagttgaaaaactctctttagcatttctggtaagacaaatctagaggtgatgaactccctcagctttcgtttgtctgagaaagtctttattactcctccatttttgatggacaggtttcccaggtatagtattcttggttagcaggtttgtattattttaccactgtgaataatttcactgccttctggactgcaaatttctgctgaaaaaccagctgatcatcttatcaggcatcttgtctatcttacaagtcactgttctcttattgctttgaaaattctcttttacttttgataatttaatgattatgtatttttatgtggatttcattgggttcatcttacttagttatttttgaacctggattccatttcctttttcaggttgagaaggttttagtcattatttctatgaataagttttttctttctttctctttctattctccttttctgactctcataatttgtataatggtcaatttgatggtgctacataagttccttaggttttctacactttttatttctttgtctttttttctcttctgactgaactacttccaatgactggtgttcaaattaactgatcttttcttctgctttatctagtttgctattgaactcttatagtgaatttttaagttactgtgttcttcagctcaatgatttctgcttggtaccttttgatactttttgtggttttgttgaaattctcactgctcatacattgttcttttgacttcagtgagcatctttatgagaattattttgaattctccataaagtaaatcacataattccatttcattagtgttaatttctagaatgtattttgttcctctttaaaggaatatctttgcctaattcttcattttctttgactctctgtgttgttgcctctgcattagacaaaggaaggcacctctcccattcttcacagactagtcttgtataggagaaggttcctatcaatcagccttgttggaggttgtgggagattctaacaatcctttctcttctcagggagaagcaggaagctgtggttcttgtctgcttgttttgtgatgagctaggggagttatagtgttcaccacttcaaatcaatgctgtctttctcccccaggcagccagtctgtgctggacccatcagaactacctgactggcaagataggtgccaattctttggtcagccacagagaagttggagtattggatgcaaagatcaactctttcttttcccaggcggaagttgagagctgggatttaaaaaaatccatttactgtctgctagcaaggggaaggattaatggcatctagaattccaagctgccacctcctttcttccaaggtggggctagactgtgcagactcatctgagctccccgactggcaaggcagatgtcagttgtttgggtatctacagaaaagttagggcattagacacatggatcaactctttctctccctaagggaaagctgagagcaggaaattttttgtccacacactctgctgaccagggagaaggatctatagtgcctaccagtccaacttgccatcttcattctccttcaagcagctagactgtgcttgtcctgtcagaactctatcactggcaagatagaaaccagttctctggggagaaccctcagaaaagttaagatgtgtgaagtaaccccttctctcccctaagagaagctgggagctagggggcctctttctaattgtattatgctatgctgggagtgttctgaatcttcttttttctgttttttagcctctcataagccgtagcatgtcctgaatcttactggcttcggtgagtctgcttttgcatttgtttaggatacaggagtctttcaattagcctttgaatttctcacaaagggaatttgtccatgattgttactaaactggtgttcatgtgtgggacagrggggaagcctgggggaagaccagggtttcctactctgtcatcttgctgacttcacttctccactcatgtatctttcatcagccagtttcttactgtgttatggctccactctggtatatccacccaccattcttctatgactccttgaacccttcaagctaagtcttctggaactcagaacctattattagcaaaatatcttatagccttctccaaatgttgcctttatgtatgaatttgaagcatgtcttcctattgagaccttgacttgttttatgtctccattaagaggtgaccagttttttttttctcccacactacatttatccctgtttctgtagataggataatgtcattcttgcctcttctcaaatacttgattttttttctctccataaaaggcattaactactctcatgccatttgattttaccatctgctatacctttgtttatttttaaatgatgtttaaaaattactttagaaattattttaagcagaaaaaattgtgtatatttaccatgtacaaygttttgaaatatatattcattgtagaatggttaagtcaagctaattaacatgtacattacttcatatagttgtcatatggttaaactctactccttagcatttttcaagaatacaatatggttaactgtagccaccatgtctctttctattaaaataatctataggatgcaggttactccccttttattctttgaagattttaacccttgagtcactgcatcctcaccactgttacttttatctttaaacttattaattttattatccatgtttgtagatggtttatctaaatccttcactctcatctctttatttttttaatccatataataatcttatcctaaaatgcactttaattatcaattctctagatattagtttttcctataacagcacttctcctcatctcaaacatctcttctgatgtctcttcttctaatcttctgacccttccagtccagttatattaccacgtttatattatctatcatccccttatgttctcaccttccacctttctcaactgaattttcattcaatttctttacctgcaacctccactctgctttcctactagaatgctaacctattagaatccaacctttgcaccaaaattaaacagaaagaatataactcatcatgtgaacatgttattaatgtctgatgaatgaatgatgcaacaagtgatagtttgaccagaagtacatatttattcagcaaatatttttagtgtctattttatagagacaaataactccattccttctaagtaaatgtataggacagagaatccaccaaaatatacagcctgtatggtcctcaaacatttccatgctctgtatctatggagaaaagaaaaacgtaaggaggttgtatcatttcctgaggagcattcagttgagtgtgggcagcagagtgagcttatgcagggtcaggaaactttgtgaaaggccagatggtaattattttaggtttatatgccatgtggtctgtcatgactaatcagcacacaaaggcagccatagccaatgttaataataagtgtggccatgtgccaataaagcttcatttacaaaattaagtgtaaggctagatttggttttaggtgtgtgattagttgaccattgtgttgaaggaagcccaattagctgtgaagtgaaatgtcgcttttagagatagctgtcctacaaataaacaaagcttattgacttttctgggagtgaatatctgaaattggagagtccgctacagaataggcatgctacgccacagttttgtcttggtgtgaggacatgccatgtggattgtctcagatgtaggaaaagccttgtagagaatttaaattgcaggggcccttggagagtgggttaatgccatctagyactggtcataagtggtgaactcttacctgtgctgcagggggcgatatactcagcaaccacagactcatctgaaagataacgttgggtgaaggaagaaacgaaagatctatgaactagggaccatgctaaatctgtctagtcactttactactggagaaaagcacgccctatcagaattgtcaraacttcatgtaaatagacaagaattaaacaggatcattaacatatttatattctctttccctgagactggagatggggactgaagcctgttcagatggcagctgttcaaattttaaattcttgggaagatgatcataattgcactaacctgtagttctctcttccatgacctctctgcttctattcactttgttcagcttgctcccttaattacttttcaaagattattgttccagcttgaaacactcctcctacttctatagacccccaaaactccactcatcctctaggatccaaatcagatctttcttcctgtttgttcttcctgagcaccagccttctgtgctgtttttgcctctcaaacttattgcttagctcactaacactcatttgtcactaatagtctttcctgttatgtaatatttttatctgtattatgttatctatgtctctaaactacttgaaagcagtgactatatattatcattctttttaattcttaagtttctgactcaagaaacactaattgataaatttgttcagtaagtttttgttttgttttgtgttgttttttcttttttttgagacggagtctcgcaccgtcacctgggctggagtgcaatggcrtgatctcagctcactgcaacctctgcctcccaggcttacacgattctcctgcctcagcctccatagtagctgggattacaggcacacaccaccacacccagctaattttttgtatttttagtagagatggggttttgctatgttggccagactgtagtaagtcgtttttatagtgtacatcttggaggaaagaaacaaaagattaatgttgactaagtgggctaagaagaggatcaactgtcacaacaggatccatttcttggctctggttaagattgtttcatttttctttcactcacctgtctcatagtaatcatagactttaacaattgctggcttcaagtctcctactgggwtgtcttgcagaaccatgaaggaaaaacttagcgtctgatttgtcacctgaaasgaaaagtgggagtaatcaagaacctagaaaacctccttctttctcccatgagcaaaacatattcttattgttctttgactctttttcaccrgtgtctttaggtgaccagacatttgtggatgtcaagatgggttttagaatgcatccttgggaactctatttamagtcaacaaattttcacagattttcttctaaacaactgagccaaccctattcttttgtagtcccttgttatgagattaactctctgggcccatgtgaatgtgttctaagctggagaaacatggtttcatacaatctgtaattaaaacaacgaagtattctttctgtttggatacataaaacattttctttgttttatggtcatatttgataatattcataaaatcctcattttattttatggtgacattttagaatgttaacattatcattaggcaaccactggggtcatatttattcattttgtggaggtggtctttaaaataacaggaatgcatgataacctttagtcctattgatttatcacttcaagtttaatatttattcatatcgtcagggagtggggcctttaaaacaacaggaatacatggtacaccttttttctattgattttgtactttaaatttcatagaaatattcatattccaattttaacacaattaaaaatagaacagaacactacatggagttcaaaggtttcccctcttattcttcttggaatagataaacctttctggaagggcattactaatgattgttttcctcatgttaccgactattctagtaaagagactcacttagaaagacgacccatatgtagtctcagccaggatgtcagagccctcacctgttccacataratgaggacatggttgttgctcacttctgtccggctcacagagctagatctttcaagctggagagaattagaaaacttcagttaaagttagagaacagatgtgagaatggtgtgagatctagagcagattgtaataagggacaaatggtcattctctgaagagaagaaagctaattgttttcaggtcaggagttccacaattcttcaatatccaagtaacacattagagcctctggcatctttgataattttagttcacgttgattttttttccttcccaaatttttagtgcatatcagtcagtttgggatttaaaccatatcctatctttcttgggtggttttattgttttgtgcccatgtgctttaaattcctgactaaactatgagtggcctaaggataggtactccttgtgcatttctctggtatcacatatgtcccttagcttacggccaactaaatagttcatttacttcctgggtttgggaaaaatatttttttgaggcaggatgatgttgacatggttttgatattggtatggtcttagtttggggatacagaacatacttttgtatgaagtctattaggattaaaatacacctaccatttttactgttggtttcaggggaataaaaccagataccatctttacatcaacaatcaccatattggaagcaggacggtttcctgtgtaactgtagtgtcaaaggaaaaagaatttagggttttatacgtgaaagaaagccaaatttctgctttcaagcatcactttaagcctgtctgtcttcaagaagttgtccctaatattctacaaaggtctgtgttccctggacttgtgcaacactgacattggacacatgcatatacatcagatctaccacttgctaaaattacagatgtttaagcatcaccccaaaactatcaaatcaaaatctttggtagtgaatcttgctaattggcatttttaacatatctatggtttttgcacacctcactatacagttcatttgttatttagtatatattacttttatatttttagtagagaaaggatcacgtcataatgataaaagcctaaattcatttatagatatatcaattctaaattatattaatctaataacatagcttccaaatggactattaatttctgttaattccaagttgcttttgggccaaagataggtgattaggttagaacgtcttacctgatggtcagtgagatctgaaagctggtgtgggctttgtgtccatcgcaagtytggggcacagtctgcacttttaaagcaaatggggagtcctctttctctggaagaatattgtatttcatggatgtctgtgaaacagcaaagacactatcagtttctctctttttctggacccctcacttcctcattacttaacgtctccagaggtgccttttactttcccaggaaggaaggaacagagtttccatttcaattggcaagtttaaagttgaytctcacccatataagcttggagccctacctgaagatacacacatctttccccagttactgttatgacatattctccagggagctctggcaatgagatctgctgcagtaataggaggttgttgttgtctacttggaaatttgtagaaaaggtctgtgaatcctgaacggtgacctgtgcagttttctcagttctggtgaaagtggctgctccatacctggacagggcatggagagccaccactgtgtcctggaagagacgagtggacaaccgccccaaagagtaaatttttggcrtctgggattttcccccaaagtctgtgttagcctaccatgagggaagctggctttttacccctaaggtagatcttcactaattacctttcctttttctctgcctttcagacattatcaaaatcatgctgcagtttctccaaatgaaataaaaggctaataatgtttattaatgtcactgtttattttcattgacagtccttttggatatgtccttcaaagaataggtctaaaactaagaagttaagacaaaaatagtgaccatttttaagtagatgattgaccagttagatggaagagtgataaaaatttactgtacatgaaaatggtatgagacaagttgcactttcttgagtttctttttaccttcatctagcttgtttttatttaccccacctaatctctctgaaaaacaaaagtttcactatggagatcctaactgttgaaagaagacatgtaggagggaaaagccagacactctgggtgtttaatacaatcatttatactctcgataaaatacttttagaattatgctagaaaaatacattttcaagagcttcagcttaaaaaagatcaacttaaagagaaagtaagaagagcactctcagggaaagtagaaaggaatgaagaagctgagttccttggagtagttgaaatggaacttctcattccaaaaagatcaaagtggattctacttagtcactgtacttttaatcacacattttttggggaatacatcttagaggatttcttgttagattctgaagatgtctggaacattggttcccaactggaggaaattttttcttgtttcaactggaagtgacgtgctactggcatctaatggggagaggccagggatactattgaatattttataaggctgaggatagttccttttacaacgatgatgtggctcgaaatgtcaatagtgttgatgctgaaaaactctggtctagaatgtgtccaatgaccatagcgtggctttagagggtaaagatgctcgttgtamgtctccatgttgctaatatattaacatagggcttagtgaaaagtgttatgggggatgtcttaagtctttcctttaaattctcatggtcctcaaatattcctaaatacttcttcaatgatttaataattgccttctcttttccattaactgttctacttttaagcctcccaattgccaagtgaacctggagcagaagactctttgggaaccactgacctgggtggaggagaaaccaccttgggcgttctgctgcttcatgatccacttcacaatgttagttgcagaggtcaggtcccctgaggtgggggctggctgggccgtgagataagcgaggagcacataggatgtcatctccacctcagcagagggagcctgggkttggtaaagatgccccactggtgccttgggtctctgagggcgctcccaatggacgaggttgtcttaagggtgagaaaaaggagataattgtaactcatcaataagtaattataactggtagataagagaatgcacattcataatacatggagctgaaaataatacaggagaagcaaggtcttctatgtcataaactcctaaaactcactaactcacacttctatgctgaacttgatttagtcctgtggtacgaaggtagggtaggttgatggaggaagaagcatagagcatactcaccaatctctccaatgttattttagttggactgatgaaagagaaaagtggtagagagagttcttttattgttcgtgatattttctgagaattgcagtatagactagaatataaaacttaactattgacctcatgtgacttttgtgatgctctctctggcaaatagagataaaaatagtttgaaaatgttattgcattttctgtttgttgtacctcttttctttctttttttttctctccaactgaatcagtccstttttgttgttttgtaacctcttccagagttaactacttccattgtaggtgatgaaatgtataaggcaccacttcaaatgttggcactgctataagcatgttctttcctgctaattcaactcagaattaaaacttttgattcttgttttgttttttgttgttgttattgttgttgttgttgttgtttttgtactccatactcagaaatagtttccactgtagaagttatctcatggcagttgtgttctttctagtagtggtctacaaccagactctagtttctccaagaacactacaagatagattgagtttaaatatgtactaaactaaatgacactctttcaaatgagtttgaatgcattttgtttttagacaacctctatgacattttttccttaaaaacaatgcctctgctccaaataaatcatggtcaaaataaatgaagatctcaagatgacatcagttctacttgtctaagtcctggtgttgtatggatgacaagcagaagccagttatgacaggtgatacatccaaagtaactgccaaatttgttaacatttttccatttctaaaccatggaaaatcatctatggagtcacaccatcctcatggtagtccagcagaggcaccatgccatatgggttcatgttttcaccaataaagaactggtagtttttattgcttcttgaccttttggctaagatcaaatgaagaactggtagtttctgagattagaaagagtgtgcttgatttgttctgcagctcctgttataaaaggttttactgtttctggtctctgttctttaagtttgtctttgattttatgtcagctttgatgtacttcttgtaggcttcttttgtgaagtcagttcctgcaagtgattgttcatgacaatatcaacaccaatgattactctgcttccagtaccttcgctttgggaaacttcagtgaaggcatctccaccaataagcgagtcatcaatgtcaccctttgtcctactgaccatcttcccctccacctccaggcacagtccttcctccatctctggatcttgtaaatgtcagagaacatctcagcgtggctgatgagatcctggtagataattatgatggtagctgaaaggagactatagcagcactagcttaggagaagcccagagcatgaagtgagcatggtgcagccaggacggcattgggtgggaatttagggggtatggaagagctgttgtacctcttttcattcaagtaagtagagagaaatcatgagaaaatgaatctatttgtctattatattggttttagcaagtagaaataaaactgcattatttatctgcagcattatgtctattatgttctgctctgtgtaacatatgcaatcccagagaagacagttttataagaggtgctctgatctcacaatgtatgacttggctaaggaattacagatgaagcttgtggatttcagaaggaatatatttcttctttttgtagaatcagtgtaaatggaaatggaaatttggtaccatttgctgtttgctctcacctttttttgcacagtttttaaaaaaacttttattatttatctatttatttatttattttttaaatkttattttattttaagttctggggtacatgtgcagratgtgcaggtttgttacataggtgtgccatggtggtttgctgcatgtatcagcccatcacctggttattaggtcccccatgcattagctatctatcctgatgctctccctctccgcacctcccagacaggccccaatgtgtgctgttcccctccctgtgtctatgtgttctcattgttcagctcccacttataagtgctctcaccttctttcacagcttccttatcaagtgagttcagtatttctctattctgattttgctttcccagtagggaaaaagcataggccagcaatgccttggtgtagacatggctcccatgrgtcccctcctttgctacattccaggctgactccaggcagaacagggcattgcgaacaatagggttctgtaaaggcaaaatgtggttgtgtcaaactagggtgaatagarggcagagcaagccgagagctggatattgacagtcagatgttattaatagatttcagacagataggcagacagctagatattcatcatatttaaatagaaaaatatttcgatctcttccctttatagttcagtcttaaagaataagactagagaacstgtttttaggattggttttgatacatagtctatgggcattactgggcaagtgtaaatctctcttaatgcatcaaccaaagagcttatcagtctgagaaatccctcatcattgaaccaaaagatacttgagactcaacccttagcagggtggcattccagacagcaaatctacagttttcatggtagggaatgggattgagctggtacctacagtgactgggagaggaatttccagaagggcaatagtaacataggcggagagggtcgcttcatcttctacacctccctgtgaatacaacattgatttgattaattccagtgccaagtgttagtatattctcttctgttgtttgatggaaacgctcctcagtatctgtttccattcaaagtataccatttccttctctctctctytctcgacagggtcttgctctgtagctcaggctggagtgcagtagcactatcacacatgacagcctcaagctcctaggctcaagcaattttgctgcctcagcttgtcaagtagctgcaactacaggcacaggccaccatgcctggctaattttgtaaaatgttttttgtagagactgggtcttgctatgttgcccaggctagtcttatactcctgggctcaagtgatccacctgccttggcctcccaaagtgctgtgattctacgtgtgatccactgcatctggcccaatttcttccttctctgtagaaagtgtaatactctttccctgatgccatcccacatcatccaggacttcatctttgcaatttccttgtgcctccttcctcccttcacycctgggggatgttatgttgatgtgtgtcaggctcagaagtttgtggaacagttcacctttatggcrttgttgagcagtgacccagagctcctgaaacagccattgtccttctgcatctgggagagccacgtgagagattgggtaatgtgtgcttcatcaatgaagatgtaggatcgagcctgggcgaaagtcttcagtacaaaagctgtgagcctagggggaggaaaaatgcagtgctgaggctcttttcattgagcactttactgctctgttttgtacacacaggctcccscatcacagtgtgcmcccaagaaagtcaatyagctgttactgagagtttggagactttttctttttagcttagacatctctttttcttttttcttttcttttytttttttttttttttttgctgccacatgttgttcaattcattaccagcttgtccttgcttcctaaagcatttytatgccacttcagaggttcaggttccttccagttttyttggttggttaactaagtcatttgcttttacactgtgggctytatgaatttatttcctttcctagatttcttagcttactttctgtagttttaactctaatcagctaacttctaatgttctgcttcagtaaatatttccctccatcatcctgcccttccacttttttcccctgtgtttgcctgtgtggtaaaactacaaagagagagagagaaaggatatcatctagtagaaggtagtaaggtatgctctgccagtaatggttgtggttttattctagcatttttctaacacctcttagggctgagcaacaatttaagggggcaagttacaaacctataatgttcccttagcaacatgagaaggaagagggtctgggtatattggattaaaaaaatcaacctaaaagtgttctcaattttgccacttattagatgtttgctcctgacacatttatttatccacactgaatatgttttctcctctgtaaaatgaagctaataactctcacttcccagggtagctataagaattaaataaggtaacattatggtttagaaatkgtttctccaccaaaactcatgttaaaacttaatccccaatgtggtagtattgagaggtggagcctttaagaggtgattggctcatgagggttctgctctcatgaatggatgaatctattcctagattaaagggctatcatgacagttggactggtggcttcataagaagaggaggagatgctagcccagtctctacaaagtaaaacaaagaaaagaaaagaagagaaggagagacccaagtgagcccattcaatcctctagtcatatgatgccctgcatcaccgtgggactcctcagagtccacaccagcaagaagactctcaactagatgcggcccctagacttttgacttatcagccttcatagctataagaaataaatttcttttctttataaattacctagtttcaggtattctgttataagcaacagaaaatggactaagacaggtaatctatgtgcacgttctgaactcatagttgaaactcagaatagattttctttcttaccaagtgttgccctggttcctgccatatcgttccccaaaggtgctgtaggagccatcttggtgtttgtagttcagctgtctctggtaacctgaaatggaaggcttcagattgttcatgaagcattaaagaaaggcaggccatccatatgtttaggctcatgcatccaggcgccatggacattttatgaccttctgtgatctgccatagttttgtgaatgttatggatagatcaaacacaacatcctattagagtgtgggaagattgttgttttcataaaaattatcatcatgggttaatatttgatgatataactgaagcttaattgggaaaagtttcaytagagtaacaaagtaaatttttctctgtctcacttaccagtgatgagatagccaacggccttggccttgatctcctgcrtcagctgctgggtttcattcagatagttcaagacatagatgttaggagcaaataggaccatgttctgttctccacagccatatggcatctggaggagattttgtatattttgcatagcagaacctaatatgtcacctggggaatgtgaaagattagatgtcagaataatttcagttcataaatagccaacattattaacaaaaatggcctttatattcagagtctatcatttaggtaagagaaaagttatatacacagagtgtgacttccagaatcctaataagaatagcagctatcgcctgtaatcccagcactttgggaggccgaggcgggcggatcatgaggtcaggatrtcgagaccatcctggtgaacacggtgaaaccccgtctctactaaaaatacaaaaaaattagccgggcgtggtrgygggcrcctgtagtcccagctactcgggaggctgaggcaggagaatggcgtgaacccrggaggcggagcttgcagtgagccgagatcacgtcactgtactccagcctgggcgacagagcgagactccatctcaaaaaaawaaaaaagaatagcagctatcaagaacttgataattcaaatacaaatacgtagataagatgtacagtggcaactcttttggcccaggtttactaaatggaaggtgactcacccagaactgagaaagaagctctggcagattctttgaccacatttgatgggagcttcaaggacaactgctcagacacattagcacctttagaaacagacagcccatgttaaaggaggacatctatgattacaatataatttagtgattataatgtagtgagagcttcagagccacactccctggatatggtactggccctgctttgtgaccttgggtaaattgtgatgatttgaggaaaaaacacatgtaaaacattcagaacagtatctgcaacatattcaatttcaacgaatgtgagcaattgttattattgcagttattttattattagagttagcagtaatattattatatctccttgtggaactctgggtgcaaggaataagaatttgacttaatgatgagactacctttgatagtctaattgcttttggcactgtgtgacttccagagtccttcctcttctcatttaactatatttttgcatggctgtgctcagtagctttctaaaagaagcctaagacttagtgggggaactatcgctctccacttttgtagcaatattaagacttataaccrtgataatacaagttattttactgcctcccttacactatatttgaatggattcccatgtttataaatagataacatgaatataccttaaattagtccttctcaaatgacaaatacagtgctgtatacactgtggacatagaactaataatgtggcggttctgtataaaagctacaactacttcttaatgatatgatgaacttaaatgtaaattattttctacacggaaaacacacatttttagtgagatgggtaggaaatgctatatgttttgtcagcagctgttttagagactatctcttgggattcaaacttatcatgaccctgctgtctttagtttttgttgttgttgttgtttgcttgtttgtttttttaagagtctcactctgttgcccaggttggagcgcagtggtgtgatttcggctcactgcaacctccccctgcccggctcaagcgattctcgtgccccagccccccatgtagctgggactacaggygcccgccaccaggcctggctaatttttgtttttttcgtagagacagggtttcaccatgttggccaggctgttctcaaacccctgacctcaagtcatcctcccgcctcagcctcccaaaatgctgggattacaaatgtgagccaccacacccggccaaccctgctctctttctacctcatcctgggacactctaagcttctgcagctgggcttgtcagtgagcagccactgggctatccaggtaaaagggctacgtatgaaccaagaaagcccaggtattagtcctgtctgtaccacctgagtcacattaacttgctctcttgggctcaatgtcttcatctgtaaaacatacataaagaaatatttagtattatgctgactttcatggaacactctgaaaactgggagataaaatgaatgtgcattgtaacttgaggtttatacccctttgtggttttgatctcactatgattatgaagatggactcttacctgaggcacaggtcatrgaactgaaagtcttttcttgctcaataccttcagccttggatgaaaggaaagaaaaggagaaaagatagaaacatcctggtgacaagagaaccacatggattcctttctttgatgggtagggtttacacgaatgatgtttaccatcctactctttttttcccaacttttgttttaagttcaaggggacatgtgcaggaggtgcaggtttgttacataggtaaatgtgtgccatggtggtttgctgcacagatcatcccatcacctagggattaagcccagcatccactagctattmttcctgatgctctcccttctgtcactcccactctcagacaggccccatatatgttgctcgcctccatgtgtctatgtgtttgcatcattcagctcccacttataagtgagaacataacatcctacttgttattgaattattacaaatccataaaacattgaagaaccagggagggtggtagagagaaaatgggaagagataataagggcagtaaatcaaagctaatgggtatgagagatatgtgaatcttaggagagaggtggagatcaagaaattgcgctcaatgtaatcccagcactttgggaggccgagaagggaggatcacgaggtcaggagattgagaccatcctggctaacatggtgaaaccccgtctctactaaaaatacaaaaaaaaaaaaaaaaattagccaggcgcctgtagtcccagctactcgggaggctgaggcaggagaatggcatgaacccgggaggcagagctttcagtgagccgagatcgcaccactgcacttcagcctgtgcaacagagcaaaactccgtctcaaaaaaaaaaaaggaaattgcactcaaataatttgtgaaaaaaaatttacaatagctggcaatgttgtctgctgcaatgcttttagggcaggaaattccattagtcttacaggatgtattgtgtgagcatgatattaatggttctttgttgtctcaagagtgaccgcccggtgttgcattcttacagktgttagggactcccaaaaatatgttacctccaccaacagggttttgatgactgtgtcttttcttttaatctcagggacctcaacaacctcatttccacagagttctaaggactgcattgcctctgcactcactgagaagttcacattccctaaaacaaggaatattgaaaacatgagtatccactttgatagtccaatcacctttaagggctgcaccttaaacttatagttgtccagaatagaaaataaggctaaaaaaaaagaaacccacaaggttaatgtatactaagtagccaatgtccaagatagtgattctggggactagcttgggtgagaacagtgggaggaggtcatagtggatagaaataggaaaaaaaactaactttatagaattatatctatggcaaataaaagagagaatatgatgaaaaaagtactcagacagccaccgtccttgttgattgataggcccttttgggtactgtcactcacccagagttttaggagtcactgtccaagacaaggtttgtctctcayttccacagatacaataggattcttctccctttgtattttgggaagctaggaaggctggagaggctttcagctgcacactgacctatcaccccatgtgaggcagagacagaaatgatcagaatatggaacgacaygaacacatagaattggggccaagtgtragatgctgcagtaaattgggatttgkaagaaaaatgtatgtcacatagattcatccatgctttaagaagcatggcaatggcaatgatacaaatcaagattggttgtgtattaggaggatttggcatttgccttagggtagcttgtggacgtgcaggcttggcagtggcagaggaaagggaaaagcagtgattgtatattgccctagggaatactatctgctgctatgtagattttcatagtttcttccttcctttcttctcctatttcttacaacatatattacatgtctaatccatacaagacataaaacactgggaatggtagatgagaggctcccgatcttgaggatattgtgtcacaagaaagatgatctatatacaaccactattacataatttacaaagagataagtgctataagataaattaaaattatatattttggagatttcaagatgacgggttggakaatgactctcgtggaactgagaaagctgagttgtgtgtcagcttcaagaatgttcctggcatataacctaacttgcagcaaagaattctgcaagcgctaagaaatagaaaagcaaggtgtggcttagagagccgtgatttaagcacccatagcacatatatcattgtattatctttctgatcatgtcctgctttgcatagcactaattattcacagtgctaacacacaatcccttgaattatccttagtctcaggaacagaatcagtagctgactgatcaaaggaatcttttgttctacccacctttcctgttcaccctcattttccttacccggatgcatttgggaaggtagtttaggaccgtggccttgagtgtgaagrcctctccacgaatcacagagtaaggcattgtgagctccacaaagaagggctggaaggctcggagagaggcagtggaagagataccaagtccagcatcttcrgacaggcagaaggcccctgccttccactcggtgatggtgtcagggactgttactcctacctcagccacacctgatgagctggggrggagggcaagtgaagaacagaaataatgaatgtaagccaccttttctcaagtgagaattaatatgcataaagctaacgtcaagaactgaatccacttaagggtatatgcgagtgtgcattcgtgtgaacactagattatgtcctgggatctgagttgggaaaatgaaagccactgaatggtacctctcccccttatcaacaaatgatcatatcccacatgtctgtactttgaataaaaatatttgaattgcgattcattttagtccttaacttcccttgctattgtataatcccataaataagcatttttaagaatcatgaccaacaattagaccactggattaatgtagcctgatttgtttatgtgcctgctccagccctgatatttacagaaggctccctgaacgacattaagcagtatatatagaactgaatatttatagttctcatgtctactatttgacagtatcagaaataattattttagaattgctcagcactgagacaattgtattaatgagcctatgcaattgcgcattttacttaggtctatcctaaagaggaagaggttaagataattattcagaacttttcaggaagattgtcttagaawtgaaaatgttggaggaaccacattccctcccctccagcaaatggaggaaagtaaagttacttacttcactgccaccaactcccagatccaagtctcaggaaaatagcttcgcaccgtttcagggactggccctgaactttgttcattatttaagggtatcacattatatgtgcctaattgaggaacatatggtctctctactactcctagacctgctaaagtaagagaaaattgtctagttagggaaaaacattcattaatttcatggtgcacatgtgagacgttagagaacaaaattttcagttttcctgctcagactgtcctaaaagtcttgtagaagttgtagaacttgggaaatactttgtgatccctcattccctgaaaagagaggagtctttgtcaaaggtggaaattctatgtatcctagacatagcataatttgatgtgaatggaagctggaaaaaygagatcacttggagacagttttatgggttttgtggcgaaggaccaattttgaaattgagacagtattgcttcattcttagagaaactgagcaggaattgtaaaatgctctttagacattgagagtggttgctatactaaaaatgaaattaccagtggagtgaacagaatttaatgatttacattaaattacttttacataaattaaatttactttaaatyactgtatggaactttgcaaaactgttgttctctgggaaataagattagagcattagattttattccacttattttttgacatctgaaataaacaattcagttgtcaaaaacagatatttccatttggaatggctgtgtggttcagacaaagaaatcatttaccaacgtgagagggtggagagctagacatgaaagcaattttgtccacgttgtgcctgaaatcatgcttactaattgaatttgatttaagatctccctccatgtatcccatctgatatttcagaaataccttgtgaaagaatacttacaaggaaaaatatatttctagcaatttcaccctaacagttttctccactgaagaaagcatcagtagtaatttctttagtgaatatcatacaccttgccccatgtccttccaagtggtaacaatttctatctctgactctgatttctcactgttttgtcttctctgtcttcactcttatcttaaatattgaaatatctaaaaggatgatgcacctaaatgaactattttccattttctactggatatgtcaagggccctccaactcctccagttattgcagttaacaaaccatggcattatgtgttatttcaactccatttagtggaccatggctatatccttcctactcttactgtcaacttgactttccacgtgtcctttcatagtctctgcatcaaagctttgtgtatcagacccaagaccctggtggcatgggctcacaagggtatctcctgatccatgggttgcagagatccttgggagaaatgtgatttcccaggcgaggtcgcacaatcactcaccgcttcccttggctgggggtgggggttccttccgttgccctcccccacctccacccctgctgcttttcattgttctctgtagtcatggaaatggcttcatgttgttgaagttcttatcaagaaatttcacaagatatttcagttttcttagctcttttatttcctcatatacctgattcatttatagctactaatttcaatccctgttatgtattcatcacacattttagaagctctttttttcctgagtgttattatatgccgtcaattttccatcttgaatttaataaattcaagaacatttccttccccccaaacctcaatggtttaaacttgaagtttgttctatgtaaatctcatggctattttcctttcccttattctttattctcgttatttatataacatctcagttacaagacaaaatcatatttaccatttttgagaaattgtttgaaatttgtgctatcattgaaggtatacttaaacagtccatggccctttaaaaggtgtcattttcttaataataaagctcatttaaagatggatattaatcttaaatgccaaggaacatagaaaatgctatttaaacaatcaaagttcttaatttgtgttggtgcattatatttagttatcttattgggcgttttgcaaggtcttgaagagccattagtcaaattccttcaatttattaatgaaggatttgaggcttagagaggagatatgacacacccacttcacatataggatatctgatttccaatccgagcatataaatatttgtgagcagatggatgtcaggaatattttggagaaaaagggagttggattcatgagagagggatgacaaatggctgggtagtgttcaagtgtaagtagacctggtgatgggacagatgttttaataagttcaagggtgttgaaaaaggctgctgtatttgaatagtggttttggccatggattatgagatatttctgtgatgttcacgttgtttcttgtcaccagtgaagccctttgtccttctttakgttttttaaaatacagcatccctatgaatgtctttcctgtttccataatcagaattactctttctttccattgtcagcattttccctctcttacagtacatcagaatcttgtattttatctgattttgtgccctgaagtatyggatgtatctaaaaaaaaatctctgatcagttctagctatcaccagctaagtcacctcagcaagaaacaattaatttgaatcttggtttctttgtgtgtataaagtggaaatagggctacattacctcattttagcattttgggcatagtaatattgttggacatgaaataaaattaaaagcaaattgctgttttacctccatagtayccttgacctactgctcctgcagacanggaagggatgactgaacacgactttggttttcggatttttgagttagtgaacaccttcaatcccatcccctggaaaaaaataattgttcaatctacttgtaagcttgattagaatatataaaacatattatccttagagacttctctatgtaattccagtatccttatattaattctatggcgaaacacttgacagtaaatatagagtagtgaaattactaaacttatggattattaagattttattctttattcattattttttggtttgcaaawaaaaaaacctaaatataactaaaaagtatccagatgaataggcagaggttagatctagccctgactcacatactgagcttttgtgtgatcctyacaagagactttaacctttttattggcttcatttttstctgctgaaaaatggagaggcaaggctacataattactaagattatgaatagatacagagttttattaacattcaaaaactcacaagccagcatgttaataagtagtgagaattttaccttgaggaagctataaatatctgcttcattacttgataagggaacatagatggctccattatgaatgaagaaaggacggggacagtgtccttgttcttcctcctgctggtccacattgtcaggaaaattggtgagatccttcacagttagcagattatatacctgtagcagtggggggatcaaaggcagaactgttacttacttttcttttgaaatagaatgaactgagagaaataaaataattatcaccaatcttttcttgagtacgttcatgtagttggtaccttagagatagttgaagattttccttatatttaacagtgttgttttgttataaagaaatgaaacctacttgggaaaatgcttccaaagattaacaaaatcttaarttatgaaggattaattaaaacttcattgtagagtctagaggtaaaaatagaccaaatatagaaagamgacgtaacttgcatctgtgtttaattaatacataatgccctgaggaatttagctacatattattattgccacctgttaaacatctatgtctactcaggcttattctcagacagaaaatcgtatagatggcccattagaagcagctgcggtctgcagcacttacggagtggaatgaaaaagcttattaaatgcagcaccttcaactgaaatacccaggttctcacattgagactgactaggcaagcaacttgagccacagagaacaatgaaaagcagcaggggcggaggtgggggagggcaacggaaggaacccccacccccagccaagggaagcggtgagtgattgtgcgacctcgcctgggaaatcacatttctcccaaggatctctgcaacccatggatcaggagatacccttgtgagcccatgccaccagggtcttgggtctgatacacaaagctatgtggagtcttggcagagcagcwgctcaggcacacagaaaccctggagttttacataatccggccctgggatccctggaaaggcaggaaatctgtttgtatatatccctaggaagggggctaaattcagagagccaaagagcatcatcctgtggaccccacttccacagcacctcacaggttaagactcactgtcttggaatctcagccagccgacggcagtgggttggagtccacctgagatggacctgagttcctgcagggagaggtgggtgccatctctgtggttctgaggactcagccactccagcctgaaggcttggggaatacagatggtctggatgaggaacggtcccccacgatgcagcacagctgccttgccagattgtgatcagactgcttctttaagtgggaccctgatccattcctcctcatcgagtgggacctttctgtgggggcttcaggtactccagccagggttctaaagacagagctttgatctctccctgggacygagctcctggggggcaggggtgtctgccatctctgcagtttggttgactctgccactccaacctgctggctttggagaatacaggtgatccaggtgaggaaggatcccacccaatgcagcccacctgctctaccaaaaagcagccaggctgcttctttgagaaggtccctgatcccattcctcctgactgggcgagacctcccaatgagggtctccagccacctccaacagttgcatgtgggctggcaacargttagtacccccacaggatggagtttctagaggaaggcacaggctgccatctttgctgtttcatggcctttgctggtgatacttccacgtaygggagaaaccaaagcaactggggtctggagtggacccccagcaaacctcagcagccctatgatagagtggcttgactgctaaaagaaaaacaaacaaacaaacagaaaacaacagcatcaacaaaaaagacctaacacaaatctaattcaaagggcagcagcctcaaggattaaaggtagataagytcacaaagatgagaaagaattaattcaaaaacaacgaaaactcaaaatgccagagtgtctcttctcttccagatgactgtgacacctcaccagcaagggcacagaaccgggctgaggctaagaattgacagaagtagacttcagaaagtggataacaataaactttgctgagctgtaacccaatgaaaagaagctgagaatcatgataaaacaatacaggagctggtagccagaatagccagtttagagaggaacataactgacctgatggagctgaaaaccgcatctcaagaacttcacaatgcaatcacaagtatcagtagcaggatagaccaagaggaggaaagaatctcagagcctgaagattatctatctgaaataagacaggcagactagaatagagaagaaagaatgaaaagaaatgaacaaaacctctgagaaatatgggattatgtaaaaagaccaaacctatgactgattgggatccttgaaagagacagggagaatggaaccaagttggaaaacatacttcaggatatcatccaggagaacttccccaacctagcaagacaggccaacattcaaattcaggaaatgcagagaaggccagtaagatactccacaagaacatcaacccaaagacacaaaatcatcagattctccaatgccaaaatgaaagaaaccatgttaaggrcacctagagagaaaggccaagtcacctacaaaaggaaacatatcatactaacagtggacctctctgccaaaaccatggaagccagaagaaattgggggccaatattcaacattctaaaagaaaataatttccaacccagaattttatacctggccaaactaagcttcaaaagcaaaggagaaataagattcttttcaaacaagtgaatggttaggaaatttatcaacacaaggcctgccttgcaagagctcctgaagaaagcactacgtttggaaaagaaagaccattaccagccactacaaaaacacactgaagtacacaggccagaacactatgaagcaatcacataaacaagtctgcaaaaaagcatcatgatgacaggatctaattcacccataaaaatactaaccttaaatgtaaatgggctaaatgctctagttaaaagacacagaatggcaagctgaataaagagccaagacccatcatcagtatgctatcttcaagagactcatctcacacgcaaggacagacacaggctcaaaataaagggatggaggaaaatttaccaagcaaatggaaaacagaaaaaagcaatcctagtttctgacaaaacagactttaaaccaacaaagatcaaacaaacaaagaagggtagtatataatagtaaaggattcaattcaaccagaagagctaactatcctaaatatatatgcatccaatacagaagcacccagattcataaagcaagttcttatatacctacaaagagacttagactcccacacaataatagcgagagactttaacacaccactgacaatattagacagatgattaagacagaaaattaacaaagatatttaggacctgaactcaactctggatcaagtggacctgattgatatctacagaactctccaccaaaattcaacagaatatacattcttctcattgccacatggcatttactctaaaattggacacataattggaagtaaaacactcctcagcaaatgcacaagaactgaaatcataacagtctttcagacgacagtgcaatcaacttagaactcaagattaagaaattcactcaaaaccacacaactatatggaaattgaataaactgctcctgaatgactcttgggtaaacaatgaaattaaggcagaaatcaagaagttatttgaaactaatgagaacaaagagacaatgtactgcaatctctgggatgcagctaaaacagtgttaagtgggaaatttatagcactaagtgcctgcatctaaaagctagaaagatatcaaatcaacaacctaacatctcaactaaaaggactgtagaaccaagagcatacaaaccccaaagctagcagaagacaagaaatagcaaagatcaaagctgagctgaaggagatagagacatgaaaaaccctcttaaaaaaacaatgaatccaggagctggtttttttgaaaaaaagttaataaaatagatagactgctagctagactaataaagaagaaaaaaagaaaagaatcaagtagacacaatcagaaatgataggggaatatcaccactgacctcacagaaacgcaaacaaccatccgcaaatactataaacacctctgtctatataagctagaaaatctagaagaaatggataaactactggacacatacaccctcccaagactgaaccaggaagaaactgaatatttgaatagaccaataacgagttctgaaattgaggcagtaataaataatctaccaaccaaaaaaagcccaggaccagatggatgcacagctgaattctaccataggtacaaagaagagctggtaccatttctactaaaactattccaaaaattgaaaaggagggactcctcgctaactcattctatgaggccaccatcatcttgataccaaaacctggcagagtcacaacaaaaaaagaaagcttcaggcgaatatccctgatgaacatcgatgcaaaaatcctcaacaaartacttgcaaaccaaatccagcagcacgtcaaaaagcttatccaccacaaccaagtaggcttcatccctgggatgcaagcttggctcaacatacacaaatcaataagtgcgattcattacataaacagaactaaagacaaaaaccacatggttatctcaataggtgcagaaaaggcctttgataaaattcaacatccctttatgttaaaaactctcaataaactaggtattgaaggaacatacctcataagagccatatatgacaaacacacagccaatatcatactgaatgggaaaaagctgggagcattccccttgaaaactggcacaagacagggaagccctctctcaccactcccattcaacatagtattggaatttctggccagggcaatcaggcaagagaaataaataaagtgtattcgaataggaagagagaaagtcaaattatctttatttgattttatatctagaaaaccccrttatctcagtycaaaagattcttaagctgataagcaacttcagcaaaatctcaggatacaaaatcaatgtgcaaaaatcacaggcatttctatacaccaacaacaggcaagcagagatccaaatcatgaatgaactcccattcacaattgctacagaaagaataaaatacctaggaatacagctaacaagggaagtgaaggacctcttcaaggagaactacaaaccactgctcaaggatatcatagaggacacaaacaaatggagaaacattccatcctcacgcataagaagaatcagtgtaatgacaatggccatactgcccaaagtattttatagattcagtgctattcccattaaactaccattgacattcttcacagaattagaaamatctattttaaaattcatatggaaccaaaaaagagcctgaattgccaagacaattctaagcaagaagaacaaagctggaggcatcatgttacctgacttcaaactttactacaaggttacagtaaccaaaacagcatggtactgataaagaacagacacatagaccaatggtacagaatagagaactcagagataaaaccgcaaacctacaaccatctgatctttgacaaacttgacraaaacaagcaatggaggaaaggcctccctatttagtaaatggtgctgggaatgctggctagccttatgcagaaaattgaaactggaccccttcctttcaccatatacaaaaattaactcaagatgaattaaatacttaaatgtgaaacccaaaactataaagacccttgaagaaaatctaggcaataccattcaggagataggcgcaggcaaagatttcatgatgaaaatgccaaaagcaactgcaacaaaagcaaaaattggcaaatgagatataattaaattaaagaacttctgcacagcaaaaggaactatcattagagtgaacagacaactttaagaatgggagaaaattttcccaatctaaccacctgagaaaggcctaatatccagagtctacgaggaacttaaacaaatttacaagaaataaaaacccattaaaaagtgggcaaaggacatgaacagacaattctcaaaagaaaacatacatayagccaacaaacatatgaagaaaagctcaacatcactaatcattagagaaatgcaaatcaaaaccacaatgagataccatctcacaccagtcagaatggctgctgttaaaaagtcaaaaaacaacagatgctgatgaggttrcagagaaaaaggaatgctttttttactgttgtggggagtgtaaattagttcaaccactgtggaagaaagtgtggtgattcctcaaagacccagaggcaaaaataccatttgactcagcaattccattactgggtgtatagccataggaatataaattattctgttataaagatacatgcttgcatatattcactgcagcactattcacgatagcaaagacatggaatcaatctaaatgcccatcaatgatagactggacaaagaaaatgtggtacatatacacaatggaatactatgcagccataaaaaggatgagttcatgtcctttgcagagacatggatagagctgaaagccattatcctcagcaagctaacacaggaacagaaaactaaacactacatgttctcacttatgagtgggagctgaatgatgagaatacatgggggaacaacactcactccggcctattagaaggtagggtgtggggagggagagcatcaagaagaataactaatggatgctgggcttaatacctaggtgatgggttgatctgtgcagcaaatcaccatggcacatgtttacctatgtaacaacccttcacattctgcacttgtacccctgaagttaaaataaaagttgaagaaagaaataaataaataaaacgcagtccatattcaaaataaaaataaaagaaccacataggcacataaatgaacttatgccattatattggatagaccaatgtctatgcagtgtactttttatggaaaatggatgattcaacagattcaagaacccacagggcagggccagaggcctgaatatttatccctggacagatgtaagattgagtcttaatcagagaacttccatttgccaggcttgatctcagagtaattatggacgagtaactcctgagtgcctcttgtttccccttttttgaacaggagtgtcaatagtgattattctatgccagttccaccattgcatgttaagtgtgtggggccaaataacttgagtacactttagttcaatgtctttgtatctagaggtattgtacctgaggaatcacacctgagaggcattatctgtacttggacctgatttaaatgatatttagcctttsagctgttcctattttacaatgagaatctcagagagaggatcgagtatattttacatgtgagagctcatgaattgctggggatcagaggtcaggctgtggagacagcttccagaattgcccacaataatctctgcctcctggtattcatgcccgaacattgttcgtcgcacaatgaatagggttgacctctgtagccaatgggatattgtggaaatgaggggacatgtctttcaggcctaggtcataaaagatattgcaagtttagcactcttggaacgcattagctctcttggatcacatgctctggagaaaatcagttgtcacattgtgggacaccagcagccctaggacctctgtgtggtgaggaactgaggcctcctgccaatagctctcaagaaacytgtcttggaagcagatcttccaacctctgtcaagctgtcaggtggctgcagctttggccgccatgttaatcgcaaccagggcaggtcacaagctagacccacctagctaagctgctctgaattcctgactcacagaaattgcatgtgataataaatgtttattgttttaagccactaggttttgaagaaaattgttatrcagcagtagataggtaacgcaaacaccctttctacttctttatttacctttgtttttgagtagaattaaataggtacataaatgaacatgtattatttatattgggtgaactaatgatttctattattattcaaagcgaccacgcttaaacgtttctataactttatcatctgaaatcttcagttatgttcatagtttcttctcacttccacaacactcaaagtttaccaaaccttactgaagtgactgttaaatttatgtgactaaacggaataagacagacataaactgttgaaaggtagactaaattcctgtactacatgctgaaattaatagcttagactagacttccataaacagagagtgtaaaaatatcaggcatattaccaaagaaagcactcagagagaaagttttcttgttttgggttaacttcttgttgtttcttctaactaaaatacagaaatatagtcattgtctcttgcctaataattattacgctatgaggagatattttgacctgttaataaaatacaaatcaagatcaagaaaaattttgattatagcaatcccccaatctgcggttttggtttccaagatttccattatctgtggtcaactgtgatccaaacatattaaatggcaaattcagaaataaacaattcatacgttttaaattgctgccattttgagcagcatgatgaaatctcacactttcctgcttcatcttgctcgggatatgaatcctctgtttttctggtggatccacactgtagccactccctgccccttagtcacccagaatcctcagttacaagattgtcacagtatctcagtgcttgtgttcaagtcacccttattttacttcatcatggccccaatgcaccagagtattgatgctggcaattgggaggtgaargagaagccgtaaagtgcttcctttaggtgaaaaggtgaaagttccccacttgataaggaaagaaaaaataatgtatgctgaggttgccaagatctacggtaagaacgaatcttctatctatcaaatggtgaagaaggaaaaagaaaatcatgcttgttttgctgtcacatctcaaactacaaaaattatggctacagcacgcgataagtgctttgttaagatggaaaaggcattaaatttgtgggtggaagacaggaacagaaatgtgttccagctgatggtcattgggttcagtgctatccacagtttcagacacccactgaaggtcttgggacacacccctrcagatcagggggcactagtggatatgctccaacctgaagaatgttaattttgataattaaaaataggacaggggtctcagatatagttatctcacagtttaaaattttaatagacatgaagtagaaactagaataaacaaaagaaaatttcatattacgaatttaccaaccaacattgaaaggtaataatacctcccaaacagataagttgattgacccttttaaatggtgattcatgagggagttaaagctataaaatttctcataactttttatcaaagatcaaatcataacattattttttcttgcattatgttaaaaagttccaaacacgagtaatctagttttaaataggttagacaagtagtttctgaacttttcccttccttctgataattattcttcaaaaaccccatattagatatcattttctccaaatggcaattattaaccaatgttcaccttttattttgctgatccacctatatccttttttattgcctctctctaaggacaaggactgtgatatgtttccttctgtttccccagcttttacaatagatccagcatgtagtaagcttgaaataataataataaaataaataaatcatcacgacatgccaagtgtcacccccatgaattaatataactatagtcaaaagcagataattaaaattttagtctgtgaatcaacattgctaacaaaggtgtagtaggtcattttttaaaagtagaaaataatttgtaaatcacttattaccactttcacagatcccaacaactctacagacataaatagttcgatctgttaaaagatacatgacttcccttatgtttgcaggtattaattttgtagcaagcttacctactccagtgaccaaaagtgattctatttagacaggatccaaactaatactttggcaacacattaatttactcactcttttaaacatgactatcacgtaggtggggaatcttaacaaaatatagctttcattaagatcactgtaagacattaataactgaggttaagatttgattctttacagaaatagaagctgtgtcatagaaggaatcaaagttgcaggcagattcagaatttcaaaatcacatctcagcttgtgccacttatcttgaacaaatctctcaactattctgaatccacttttctaatcttaaaatgggactattattctcyggaatgttgggcagattaagtgagaaaacctatatgagacagcttgagaaactatcaagtactcggcaagtggtacgtatttttactgttatattttactctcaatagaggcttatttatttatttatttattttattatactttaagttttagggtacatgtgcacattgtgcaggttagttacatatgtatacatgtgccatgctggtgcgcaaggtaatttacagattcaatgccatccccatcaagctaccaatgactttcttcacagaattggaaaaaactactttaaagttcatatggaaccaaaaaagagyccgcatcgccaaggcaatcctaagccaaaagaacaaagctggaggcatcacactacctgacttcaaactatactayaaggctacagtaaccaaaagagcatggtactggtaccaaaacagagatatagatcaatggaacagaacagagccctcagaaataactctgcatatctacaactatctgatcttcgacaaacctgagaaaaacaagcaatggggaaaggattccctatttaataaatggtgctgggaaaactggctagccatatgtagaaagctgaaactggatcccttccttacacattatacaaaaatcaattcaagatggattaaagacttaaatgttagacctaaaaccataaaaaccctagaagaaaacctaggcatcaccattcaggacataggcatgggtaaggacttcatgtccaaaacaccaaaagcaatggcaacaaaagacaaaattgacaaatgggatctaattaaactaaagarcttctgcacagcaaaagaaactaccawcagagtgaacaggcaacctacaaaatgggagaaaattttcgcaacctactcatctgacaaagggctaatagaggcttcttgatctgagcctctggaatggcccttcctggtccccaaggccactggaaactcactgaggacacagagagctcagcctcaggcttcatgagcagcacactttggtccacagcacgaagggcacagagggactgcggagcagctgctacttgcaggtgggcatgtgaggctgggggactttgtgctgggctgaagctcaaatccacctgtgggaaatgaaggaaacrtcaaccagtgttttccctacttctgtgatcttgcagtcacctgcatttcctaagccacccttatattcagttcatatgactatgttggtaatgtcagtcagaaacctatttttacaactttccttcactttaaaaatagaaaataatttgtaaatcayttattaccactttcacagatcccaacaactctagagacataaatagttagatctgttaaaaggtacatgacttcccttatgtttgcaagtattaattttataacaagcttacctactccagtgatcaaaagtgattctatttagacaggatccaaattatctaatgctttggcgacacattaatttactcactcttttaaacatgactattacataagtggggaatcttaacaaaatatagcttctcggtagcttagtcttgtcctaaggagataactgaggcagaataaggatagataccttgttagatttttagatggccatctttatctctgacacatgataaggtaattctaggtgtttacacttattcttcaggttttgggaacttttgagtcttagcattttacatactcacacaactgaatcagcagagaagagcatcatgaacacaaaactgattgtattttatttggtagcagctttgtgtaattgaaaaagtgctgtactagatccctagaaatttgggtctgccataaacttgttgggaactgttgggcaactcattttacttttctggacttagttttctctggggtaaaatagatggcacctacagtatcatttatttgtgttcttttaattttatgttaaatcgctcacyttgttggctagacagttttcaatytcaaatttttcagagtctccaacaacttctccatctggtaaaatggcaaagatgaacattcgtgcaatgggggcaacgtctgactccacagggaaggataaggcaaaactgcctttcactggaacatggagagagtgagacaaaatggtcataagtgagacaaaatggtcataagtgagacaaaaaggtcataaaaatagtgtcataaggacactattgcttggtcttatccacttgagaactgcgtccattcattctaatggcttagtctctctatgtgccattagttatttggtgaaattagtaggccaatgtctcccttcagaactttaattatagcagaagttaacaaagttcctttcactcacatcttttttatttgatattccacttaactgttgcctaaatcaattaaatatcagtagctccaaattttctgcatatatatgtgacaactattttatttacatttcagactagaggtgattctcaatttaaatatagagctataatttgtaagatataataagtttattttgtcatatatgacttttaaaaagctctgtatgtaaaaaaaagttcatactaattgaacttcctaaaagaatatttaattcttggagttttcattgcagtgttaaactcttataagtacattggtatatttctactggaagcattaaatggtaccagataacacttcagaaaatactttacattttaaagcagggtgaagggccaccaggtagctacaaaagggcaasaacaaaagttccattttctgaatggtccactggggacttgagtagatggcccacatttagttgaataacggtaattataaaaccacgagagacttaatgactgaaaagtttctgagatgcctgtacataaaggacagatactctctggtattatttccatgtcttccttttctctacatccctcctgtcccagattcccagctatatggctttaaattcctgtgcttccaagttcttttccagtaacatattcttggtgcagttagacaatacataggataacagagtctctcgacattgttgaaactcaaaataatgtaggacaaggacaattagaattgtagaagaactataattgattttatttttttcttaaccatatgtattaaaaattaagtctaatacccttaggaatattttacaaagtataatatcaggatgaacaaggctagctatctaacacacaacatgaagactgtagttaataaaatggtactatattttagatttttgtcaaatgagtgcattttagctgttcttgccacacatacacaaatgagtaagtaggtgagatgatggccatgttactttccatcactatagtagtcattttattatctatatgtgtcccataacgttatgttgtacaccttaaataaatgtaatttttttttgagacagggtcttgctctgttgcccaggctgaaatgcagtggtgcaatcatagctcactgcagcctcgaatttctgggctcaagtgattgtactgcctcagcctccccagtagctgggactataggtgcacaacaccacgtttggctaattttttatatatttttgtagagataggatcttgctatgtagcccaggctggtcccaaactcctcggttcaagcaatcctcccaaaatgctgcaattacaggcagcagccaatgtgcccggccaaaatttacttttttaaaatgattatattaaagcctgagattggtggcactcaattaaaaattgttataactctacgtagaatrtggaatttttccaacttcatgcaaatttgactttagcttaacattacttrttttatatcactatgtgtttatactgcaaagctcttaagtttgggaagaaaggaagcttaaaatatccttaaggcagtgttatgccattcatatttgtgttcagttggacagatcaagttttagctcagacctcaaaaaggaaataagctccccttctaaaaggaaggaagcccttttatcactgtcttgagttcaacaaggaaagtggggtagattgaaatgtcataaaaccagaaaaaaaattrtggtgactttatggcaaagaatagtggtaggaaattaaagcttttaataataaaatttgccaacacatgtgtgtgtgtgcaccctgccttgccactgctggcagcgtgagtgtcctccatcacccctactcctaccacacagccactgacatcagagcattggcaggcactaagctcgccaaccccacccctgccagcaccctgcccctgcaatggagctgccagtgcaaaactaggcacaaaacacacaaacccacccctagccatgtacagacactgccaccagtatgaatgcacacaaaaggttcatacagtcctgcacccaccagtgccccacccccatgctaacaccaccgtcagtgcaaatgcatgcacagttgctagtggggatcccccaatcccctgagtcatactgccatgatcattgctatgaatgcctgcacaaaggccagcaacctggcacctgctagcaccctgccacagctgatgagcgtgtaccccaccacgctgccactgccatgctgctggtacatgtgaatgaggagggatcccactgctaccatcctgcaaagtgctttggctgacatcacccatggaagtgttgtgaccagtggtctgggagcaccttggtcccttcagtgcaacatgttcttaacctcaaggagccagagaacaaagctggagccagataccagttccccagagttacagcatgcaatccaggagtcctgaactgagccttgctcctccctgcctccactgcccccaaatcttctggtaacaaagtcagttgactgaactcaccttataccacaatcaaacctccaaggtcatcgaataggataaaaggaaaaaatcaaaacaacagcagtttctaagagtgaaggaacatcagcccgcaaagatgagaaagaaccagcacaagaactctgacaactcaaagagccagagcatcttctttcctccaaacaatcacaccagttctccagcaagggttcttaatwgggctgagatggctgaaatgacagaaatagaattcagactatggataggaatgaaggtcattgagattcaggagaatgttgaaacctaatctaaggaagctaagaatcacaataaaatgatgcagaagctgacagacaaaatagccagtatagaaaagaacataaccaacctgacagagctgaacaacagtctacaagaatttcgtaatgcaatcacaagtattaacagcagaacagaccaagctgaggaaagaatctcagagccacaaaattgactttctgcaatacaacagtcagacaagaataaagaaagaagaatgaaaaggaataaacaaaacctctgagaaatctgggattatttatgtaaaaagactgaatctacaactccttgatatccttgaaagagatgagcataatgaaagcaacttggaaaacatattttaggatatcatccatgagaacttcccctcctagctagagaggccaaattcatattcaggaaatgaagagaaccccaaaatatacttcacaagaaagtcatccctaagacacacaatcatcagattcaccaaggttgaaatgaatgaaaaaaaaaatgttaaaggtagctagagagaaaggacaagtcacctacaaagggaagcccatcagactaatggtgggcctcttagcagacaccctacaagccataagagatttggggcctatgttcaacatttcttttcttttcttttcttttctttttttytttcttcttgacagagtctcactctgtcaccaggctggagtgcagtggcatgatctcggctcactgcaacccccacctcccaggttcaaacagttctcctgcctcagcctcccgagtagctgggactacaggcgtgcaccatcacacctggctaatttttgtatttttagtagagatggggtttcaccatgttggccaggatggtctcgatctcctgacttcatgatctgaccaccttgrccccccaaagtgctgggattacaggtatgagccactgcacctggccaacattcttaaagaaaataaattccaaccaagaatttcatatctagccaaactaaacttcataagtgaaggagaaataagatgcttctcagacaaggaaatgctgagggaatttgttaccaccagatccaacttgcaagagctccagaaagaagcactgaatataaaaaggaaagaatattacgagccactacataaccacactgaagtacacagaccagtgacactatagagcagttacacaaacaagttgacaaacagctaacaacatgatggcagattcaaattcacgcatctcaatattaacctctaatgtaaacagactaaatgccccaattaagaggcacagagtggcaagccagatgaagaagcaagactcagtggtatgccgtctttaagagacccatctcacatgcaatgacactgataggctcgagataaaggaaaggagaaaaatctgtcaagcaaatggaaaatagaaaaaagcaggggttgccacatgcccatcaatgatagactggataaagaaaatgtggcacatatacaccatggaatactatgcagccataaaaaaggatgagttcatgtcctttccagggacatggatgaagctggaaactgtcattctcagcaaactaacacaagaacagaaaaccaaacaccacatgttctcactcataagtggaagttgaaaaatgagaacacatggacacagggaggggaacatcacacactggggcctgtcgggggtggggggctgggggagggatagcattaggagaaatacctaatatagatgacaggctgatgggtgcagcaaaccaccatggcacatgtacacctatgtaacaaacctgcacgttctgcccatgtatcccagaacttaaagtataatttaaaaaaaaagaaaaagagaaaagcaggggttgcaatactaatttcagacaaaacagactttaaaccaagaaaggtcaaaaaaaaaaaaaaaagacaagagaattgcataatggtaaagggtttaattcaatgagaagacctaactaaacaaaatctacatgcacccaacacaggagcacccagattcataaaacaagtgcttagagaccttcaaagagactcagrctcccacacaataatattgagaaacttcaacactccacagacagtattagacagatcatcaaggcagaaatttaggatctgaactcagcacaggacccaaatggatctgatagacatctacaaaactatccactacaaaacaacaacacatacattcttctcaactgcacacggcactactctaaarccgatcacacaatcagacataaaactatcctcagcaaatttagaaaaatgaaatcatacactccacactctcggactaccatgtgattaaaatagaattcaataagaagaaaatcactcaaaaccatacaattacatagaaattaaacaacctgctcctgcatgacttttgggtaaataatgaaattttggcagaaatcaggaagttctttgaaaccagtaagaacaaagatacaacacaccagaatttctgggacacagctaaggcggtgttaagagggaaacttatagcactaaacatccacatcgaaaagttagaaagatctcaacttaacctcacatcacaactraaagaactagtgggtcagctgtgctgtgcaggtgatccatgctacaccctaatcactacttgctcttcggaacctgaaagttacagcaacggaagcttcaagatggaaaaaatggcagccagcctcaccctctgtgagctccgtcccagggaaatgtaaagttgctaccagcctgaaaaccctgatgggggtggggtggtggtggctgcagtcccaggttgtggggttgcccccatgmggagaagtgggactcacataaaaaatagtctggccaaacgtccttgatgaacattgatgcaaaaatcctcaacaaaatatttgcaaaccaatattcctgatgaacatygatgygaaaatcctcaataaaatactggtaaactgaatccagcagcacatcaaaaagcttagctaccgcgatcaagtagacttcatccctgggatgcaaggttggttcaacataggcatatcaataaatgtgattcattcatataaacagaaccaatgacaaaaatacgattatcttatcagatgtagaaaaggattttagtaaaattcaacacctcttcatgttaaaaactcccaataaactagatattgaaagaacatacctcaaaataataacagccatctatgacaaacccatggccaacatcatactgaatgggcaaaagctggaagcattctccttaaaaactggcacaagacaaggatgtcctctctcaccactcctattgaacacagtattggaagtcctcaccagaacaatcgggcaagacaaagaaataaagggcatcagaataggaagagaggaagtcaaactatccctgtttgcagacgacatgattttatatctagaaaaccccatagtgttggccccaaagctccttaagctgaaaaatgatgttagcaaaatttcaggatacaaaatcaatgtacaaaaattactagcattcctatacaccaacaacagtcaagccaaaagccaaatcaggaatgcaagcaatcccattcacaattgtcacagaaagaataaaatacctagaaatatagctaaccagggaggtgaaagatctatacaatgagaattataaaacaccgctcaaagaaatcagagatgacacaaacaaatggaaaaatattccatgctcatagataggaagaatcagtatgaaaatggtcatattgcccaaagatctctacaatgagaattacaaaacactgctcaaagaaatcagagatgatgcaaatggaaaaaatattccatgctcatagataggaagaatcaatatcatgaaaatggtcatattgcccaaagcaatttatagatttaatgtttttcctataaaactaccaaygacatccttcacagacctagataaaactatttaaaaatgtatatggaactaaaaaaagagcccaaatagccaaggcaatcctaagcaaaaagaagaaaggaggaggcatcacaccacccaacttcaaactatactacagggctacagttaccaaaacagcatagtacttgtacaaaaacagacacacaaatcaatgggacagaatgcagagaccakaaataatgctgcacacccacaaccatctgatcttcaacaaagctaacaaacacaaggaaaggactccctattcaataaatggtgctgagataactggctagccataggcagaakattgaaactggatccccgccttacacaatgcacaaaaatcaactcaagattggttaaagacttaaatgtaaaaccaaaaagtatacaaactctggaagacaacctaggcaataccattctggacacaggaactgcaaagatttcatgaagaagacactaaaaacaatctcaacaaatgcaaacattgacaaatgggatctaattaacctaaagagcttctgcacagcaaaagaaactatcaatagagtaaacagacaacttagagaatgagagaaaacttttgcaatctatgcatccaataaaggtctaatatctagcatctgtatagaatttaaacacatttacaaggaaaaaacaaaccaccacattaaaaagtgggcaaaggacaggaataaacacttttcaaaagaagatatacatgtggccaacaagccaatgaaaaaaagctcaatactactgaatattagagaaatgcaactcaaaaccacaatgagattatcatctcacatcagtcagaatggctattattaagagtcaaaaaataacagatgttggcaaggttgtggagaaaagggaatgcttatacactcttggtgggaatgtaaattagttcagccattatggaaagcagtgtggcgattcctcaaagagctaaaaacagaactatcatttgacccaagaatcccagtactgggtatatatccaaaggaatataaattgttctgtcataaagacacatgcacacatatgttcattgcaaccctgttgcaatgaacagtagcaaagacatggaatcaacctaaatgcccatcagtggaagactgaataaagaaaatgtggtacatayacaccatggaactatgcagccataaaaaagaacgccatcatgtcctttgcaggagcatacatggagctagaagctatcattcttagcaaaataatgtaggaacagaaaaccaaatattccatgtgctcagttataagtgggagctaaatgatgagaacataatggatacaaagaggacaacacacagtggggcctatctgagggtggagggcgggaggagggagagcagaagacattgaggcctattggagggtggagggtaggtggagaaagaggatcagaaaaaataattattgggtagtaggcttagaacctgggtaacgaaataatctgtacaacaaaccccatgacacgagtttacctacataacaaacctgaacatgaacccttcaaacctaaaataaaagttttaaacataataataaataataaaatttgagaagatttcattatttaaaatctcaattctgaaaattaaataggcaaataatttaggtaataataatttggacagtatgaagaatagtgtgaaaagagaacaatatgaggaagctcaacttggacaatttgaaaagttttaaaaagttgaatttagacaaattgtgaataaaatttgttcttttatcatagaggtgtaagtgcttttgataattctttggtgaagagtaaatcggtaattaataactattaaaatatgtggttaaaattgttttatgatgaaacaattatgatttaattagctatatagagaaattttttccaattgttgactcagctactttcaataaaattttgtggcatcttcacaaagtaaatgattaaataactagtcctcattttactatatagagattttcatacagactcttcctgttatgaataaaattcaaattggaatattataaaagaaaaaatcaaataaatgttttaaaacctttgattatttctgtgaatgtgatacatagaccagtattagaagaaaattattcaacaaaaattgaagaacaatgtacacagtggggtccattctccatatctaactacctctacactagtattgggaaaaaactgatattcaaaactggcagcagtttttaatgtttaattaaaataattattaattattagagtactgattaataatgcataaattttaactttctcaaaattgtttcaattttcaaaactgaaaaataaaaattaaaaattaatatttaatttttccagcttagcaggaagagaaactacataaatagaaaatattaggcatggagcaaatcctaatggttattaagtttagcttaggggtgtggtggaaattggtaaaatgtttcccttagtttaggttaattacaaaaatgttcacgggttctcttttcagtggtttaacctctagattatttgacttagaatagaaaacgatcttggttccccaggcctcaatttattcttgaagtgaatccaatttcgtatataaagtactcatggcctggcacaagaaaaaaaaatctatcacctttcttccttcccatttcccatgataattacttttttcttctctgcaatgttaatttaatcaatgtacactttattgggggtggagataaatagaaggcagcttagattttgaaaagagctttgttttgctgttagaagaaacaaactaaagtgaaaaactagtgtaccttagcagagtgactgatacagagtagacaatcacatttatctgttgactgttgaattttaaaatgccaaagagtcataagacgagtattttcctgcgtgtcctccttattgtgaagggatgatggaaacgatttcccatttatgaactgtcaccgagggaagggtaaggatgtgttaggggagcaaggagagatgaatctgaggatactcactgtctcctgactccacaggcagagtgtgggttccagatctgacgatgactcccttagccatgatctgaaatgaaaaaacagtgaaggaartttcttgagctggacacagttctcagccttctattccccacatgacccactttcagttgtcaagtctgtgctggagagaatcarcctcaagaaaactcatggaatgaaggacgcacaacaagaacacaaggtggctgtgtgcaagtagtttattttgacattcctgagcctattgaccacttttgtcctactgataagctgcaattgtattccatggcctcattcttaccaggtaatggaaactgagctccgataactctcccatggcctgtctattcagtgtatagtgtgccgtgatagtctccgtgtggccacagggcagggtaccagccacaggctccaggtgaatgtaacttccacttaaggagaaaacacgatttgcagtgtgctgagcrccctggtggtcttctgctacccatgaatagtgaaaacacaagttgggatgcacagtgaaaacctgagtaaacagaaaagcaaagaaagaatactgtcttgaaattcktcaccttagcttctcaccaaaatgaatrgttacaacggtgtcttccactctaaaatacactatgcctctccctcatactggtcgacagccaaataaatgaattttcagtctcccaacattcaaatattaaaaggaaatcatccacaaatttatctcttttgccctgattctgctaactcattactactttgacattttcctcctgcccctcagaactagaggaaaaatgagaatgataaataactcaaacaagtggaaaagggatttttcagatattagaattacctcatgaattggcttaattaaaattagggtttgtattaataaaacattctattaccttatgagcttcaaaattgtttttagtaatccttagtaaattagcatttatgcctcttatcattattgtgacttccaacctttaagacctatgtgayttctgaaactttaagccttgcagataatgttttgcgcacaattctatttcccttgtggtaactgctccttagcttttcttcaaagtgcacttatttttttctaaatttattaggcatattttgtggactcttctatttggtctcataataaagttcctatttaaaaaaaccttttgcgcataaacacatcatactaataatttacagatcttttaactccatgaaaataggaaattttaaagtgtagggacactatttagtcaccttttaaatcctagggagagcgagtgtctatcacatagaaaacattaaacatcattacatgtttttaaactgagttaacacgtgaaactgagaaacagaaataatgtatatgttatttatcgacactgaaatccataaattatagtcttttatcacttctttgagataacaagcatgaaaactttttagctagggaaatcttttgatcatcgtcattagacagtgtatattaagtgtgtgtgtgtgtgatcactttacaaaatttctaagtgacctggaaaaaataacataaaacaaagtacatgaattactgaagcagctgatattgttcacgacccaaatcaaataagatttttttcatactatataaaatgttacagataatgatagtgaaattatcaggcacttctgcagtgccttttctaatgcctttattgtttttcatgaaattctattatcctcaaatttgtaaactcaaagttagatatcttcttatttcttactcttaaatgcaatctgtacatttcttctgaatatatcactgttcctaacatttcctttgtcctcagagatttgtctttctatacttacccggacaaaaagtttattaaccgagatactggtagtattgattgaaaactgtgcaagaccctgctcattggtggttgcattggagtaataattggcgtcattcacagaratgaagaagastttattggggatgggcacaccttttccatccaccagaagcacctaaagaagaaaagtacttgatagttgatgtgaacaacacccagagaggactgaactcatgtgaacaaatgcttttgctgctataactaaaacaacaacctccccctcaaaaaaaccccaccaaaccttcatatttacgacaaaatgtttccttccatttggatcctcatgtcctacatagcttatctatgaaactttgtagtatttccagtaaagtcagggagtttttttttttttttttttgagacggagtctcgctctgtcgcccaggctggagtgcagtggcgcgatctcggctcactgcaagctctgcctcctggactcacgccattctcctgcctcagcctcccgagtagctgggactacaggcgcccgccaccccgcccagctaattttttgtatttttagtagagacgggrtttcaccatgttagccaggatggtctcgatcgcctgacctcgtgatctgcccgcctcggcctccgaaagtgctgggattacaggcgtgagccaccgtgcccggccaaagtcagggagatttttaataactacaacttgccacttaatatgcacttggaataagaataaaagaaatgaatttaaactggctgtttttcccttttcgcatagacggaggctagaatgcttggctgtgttctgaactctactagctaaaaaagttacttctctgcgcttcagttttccaccttcattaaaagggggataatagttgtgcctcctttatatggtagtattgaagattaaataattatttaaaaatacattagaggagtagggcgactatagttttccaataatctgttgtgatttaaaaatagccagaagagaataatttgaatttttagcaaaaaaaggacaaatatttaaggtgatgaatatctcaattatgctgattggatcttcaaaaattatttgaatgtattaaataatcacatgtactccccaaaattgatactatgatgtatcaatttttaaaaaatttaaaataataaaaatacattagaagatatttggtgtacgataattattccataaatgttagttactaacgttattattatctcctgcaacaaaccagctaagaaaatacacatgagaatgttttcttcccttcctttcccttccccttcccctggcccttccctttccccttcccctttttccttcttttccttttccttcccctttccttcttttcttttctttcacaactggtctctgttgcccaggctggagtgcagtggtgccattataactcacagcagcatcgaagttctgggctcgagggatcctcccacctcagcttcccaagcagctgggactacaggtgcacgccaccagcccactgctaatttttttttttttttttttttttgcagaggtagagtcttactatgttactagggccgatctagaactcctggcctcaggcgatcctccccccttggcctcccaaagttctgggattataagcatgagccactatgcctggccaaatgtctcaatttactaattataaaacaggtaaaattaattatcaatatgaataaaattaatattttattggctttattattgttaaaatatataagttaaacatataaaaatataataataataaccatgaaatgcatgttattttaatacctatgcctaaaattaaagacttatttatttatgtcagaagagatcaacagatataaaaagaacactgacagccataaatgttacaaactctgaaaattctgatgctgcccaggtcatgatagaaatatcatttattctaaactgcatgaaagaagaggtttgatataacaactaagtcacattacattaagtatctttattagctacatattaaaatattatctctgattctcataataatttagtatgtgtctgtttgtttcatcagtgatatttagaaaggaaagtatttctccttggtttcatggtttttggtcatattaattaactgataacactaaccaagtgtgggctgcatcattgtgtcctgtgcttaggtgcaactggatactttgcttacctgtgcattacaacatatcttacctgtgcaaaaaaggggattccttgtctaaagtgtgaatccactttcacgaatttgagtttggatacaatgtttgtgatttcactgatcctgtttgcagtgacttccaggtctgaaaaatataaagagtcagtacttttagaarttactttagtcataaaatttctttcttacaaatgacctttattttgttatggaaagtaaactattgttttatttcccatattcgttcattactcacacctgtcccctcttctctgatcctggcttccactctaagcttcatttcaaagcccgtatttgtaatctggagcattttggtgtgtacttgttgggtgatgcagccattgctgttaagctgagaaaaataccaaaaccaataaatgtcaaactgattgagatcaatagtcactgaatctactattctgtctctaatgacaagaaaacttttttttttgcattaagtaagttaattgaccttcgagaacttaatactcatatctgctttgtaacctccaaagttagtcgtccaaatgagaatcttgttgactaagaacagaaattcgttttttggtgggggatattttgcgacaagcttgtcctgatgccctctttctagttagtaaaatggagtctcactggtygtaaacagtgatagcactgagggagaataccrcctactaacctgttgactgaattcctcacagacctcctgcttgtcacaattaagaacacgagataattttctacacaggctcacagttgcaagtcctgggacaggcttcccataartgtatctggtacatgagaaataaatcaggaattgagaatggctgtttgcattttccactaccactcctccacagaactgtccctctttagagttgcctacacatctttatcatctgggtgcccaccaagtagaaagctgtctggaaaatgtctccctcaaaaatattagccattaaaacctttgaaacttgactgcactgtaccaccacattctctttgggattgaatatatatatttatataaatatttttatatatttaatatataatattataattattatattttaatgtttaattaaaataattattaattattggagtactgcttaataatatataataatataatatataataatataatatattatatataaatatattatgtataatgttgaaaataattattaattattagagtactgattaataatatataatgtaatatataatatatgacataatataatatataaatataatatatattatatatttatatattatattatatattatattatataatataatataaaattattatatatattatacaatacataatatatataattatatattatacaatacataatatatataattatatattatacaatacataatatatataattatatattatacaatacataatatatataattatatattatacaatacataatatatataattatatattatacaatatataatatataatattaattatatataatatataatataaatattaataatatataaattatatatatttatattatatattatataagttatctatatattatatttatattacatatttatatattatatattaatatatattatatatatatttaatcccaaagagaatgtggtggtacagtgcagtcatatatatatgcaaacatatatatatatatgtttttcctttggccaggtgctttggctcatgcctgcaaccccaacactttgggaagccaagaaggattgcttgaggccaaaagttcccaactagcatgggtaacatagcaggacccaatctctacaagctttttaaaaagattagctgggtatggtgacatgcacctgtagtcctagctacttaaggaggtttaggcaggagattcacataagcccaggagtttgaggctacagtgagctaagattgctccactgcactccagcctgggtgagagactctgtctactaaaaaaatgtttcttccttttaacctacttattttctatcattcttctttattttgttttaataatatcaaagcttattctgtataccaagtgagcaaatgtagatgatgaattgaataaaaataagtacataataactaagcaaatctaacacaaaatgcacagacacacgcacacgtgcactgacacacatgcacagagaagagaagggagagagagggagaaaaagaagcctaggaacacatgaggcatgtaaatacaaaataattagtggggttatgtgtgtgtgcacatgttatattagtcctttctctgattagataatgggtaacagaataatacacaataattttgttttggacattggttttctttcctatttgcaaatggctctgaaattacttcaaataaaaagatagaatcaaagcagcttattctgaagcccttctccaacatatagatatctgcactacggcactattaatttggacacataactccttggccattgctctgaggctgaaatgaggcagagatctaggcgttttggtgtttctggtatataatatttaggctggcatattcctttaccctgcgtgctccctctgggactgtttgtttgtaggctatcagttttgcttcttcaggttaaaaggaactgtaagaggtatctgtaatcacagagggcaacagtggaaaggaacrtcataggtaaggttcatgccctctgtctactgcttaagagatggaggcacagagaagcagcagaatgcctagtgaaaacagtaagttctgataggggaggcacactcatcactgccgattctgagtctagtacccttcataatcatgacatcagtcactggatcatttatattatgtttaagtcacttctataaaatcctaatcattggcttttgcccagtaattgtgacctgtgatctttaggtttctctgtcacatttttagtccatcgtatcagcgcatcctccttcctcaatgacaggattagtatttatggtatacatatgaagaaaaggagaaagtgaaatttcctggagtggaaatttctgggggagagattatttcaggttattaaacaatttgttctaccattgcactatttctggttattgaacaattgttctatcaaaaagatcaatgtaaaacattcaatgtatcctcttaaaattgcccagaggaaagattaggcataattaattcaatgttccatgagaaaacaaacaggcagattctgcaagcaagacttctagaggccaactgatgatcttcagcgaaatgtcattaaaaaaaggaggttatagacttttaaacctctaagatatttatagattcctatggcttgctttaaaatattagagcaaaaaaactactgtagaggaggaaatgggacaaaaagaacctggcaaattttacaattttaaaaataggtgataggtacatgaaattgtgttttacttctctgttaactttggcacgtgattgaaaatttccgttgtagagagtttggaaaaagaaaaggtacttaggagtcataataaccaaaaccaatgtgcgaacacccagctttatgagaccatttttaggacaattgaagatacttgactgtaaacttgcaattagttttggaaaattacttccaattttgttaagtgatcgtgttgtcgcagaagtggacratgtctctgtattttagaggtacatactactgcatgtacagaaaaatatcatgatctttgtgatttatcctaagatgttaaagcaaaatatatgatgaaacaatacggaaagatgtttattgttaaatcataattaagtgtgtttctrttcttttatgtatttgaaaattttaatagtaagtcgttaaataaagagaagtcaaaggagtaatattacaaaagtgctgaggcaaagtaaatttataattttgtacctacataatcmctcaaaattgaggcaaaatataaaattttagataaaaacaatgtaactcactctccacagactgttatgttcactttttcatccatgatactgattatctttggcacctgaactttgacctcaaacttgggaagcactgttaatagagataataggaataaggaaggttggtaaacatttattggaaatacaaataatttcagtatgtctataatttttcccaaaataacactctgaatgttagatttactttccaatgtatcaactttaagatggtaaggtttaacaattcatgcagaatctaactgacttcttgagcacagcgggtctcagtgacgttaacaaatgatggtggtttcactgaaacaagaagtttcatacttggcaaagcgtaatttgctactgaaaatcagcaagctcttatgagcttctgtgttcacaccgtcctaatggtcttagaagcagtaagtctgactctactgcaagttcaacatatctacaggaaattcaaaggatctaagtgagctcacactctaggaaccaaaatgttatgcctttttcatcttccataatccataccaaattcctccacggtgaaggggtgctgtatccttccacctgattctgtctgtaccaccaccctgtaggagccctgaatgggctctgatgagaggggaaaggacaactgattgatgccagcttctagcttgagactctgccattgtgcaattcgatttcttcttgggttctgaagggaaacaagaaacatgggcggtaatcatttagtcacaatagtccttgagcaactcaaatgattttgaaggtgataattagcattgcctctggaaagacaaatacagaaggaagagaaaatacaatcaacctgacaactgggagtaggaggaattcagatctgaaawtttttaaagtagttcatctgtctagagtattatcagaacctcctacyctctaaaagcactaatttccttataagatactttttctgatacttacctcaaggtatatcagtggaatctatatgataaaaggaaagaagagatgtgattagaattccagcaaaggctacaatttcagacttgtgatcaaacaacaaactgaggaagaatattatctgtagctaaattcaacaagaaacataacagaactggaaaaatctcagggaaattattaaatagttctaggatgagcatacacaatatattcaataattattattatgtgttgccatttccctgaaaattattattggtgaatgatattattgaatctttaagtattaatattatttggatactaaaattctcctagtgaataatatgactatactgcttactttcataagttgggaaatagatattaatagagttatatgtcattatgatttagacctaacagaaatagaattcccagaatcatttggttgmaagtaaaccaagaatatttcttctaatttcaacattgtctattttctacctattaaaagyagctttgttcctttgcactaatattgaaggtaagttgaaaaaagggaaattcaattagcataaaaaagtctttgtgtataatatatttctatactatatgtatcgaatatataataaaattataatatggtctattgtatatacctatatattcataaaagcataattctttgttgcttttttaatcataaattccttgaaagtatgaataggaatagtgccttttttctatgcttctttaatattcttaatgcagtgtgttcagagtaacaaatgcagctattgccagactgattaaatactgttataagagaaagaacttcctcatctcttgtccctcaatttttgttttgtataagactgcaaatctgtgctgaggctggagccaagttcaaaaacaagtgtctttcatcctctcgcttttcttgtacctttctacctcactctgggtgagtattcccactctacccacaacccaaaccacagatagtggatgcttaccagttcatttcgagggcgaaaattttcatccacggagacaacacggaatcttactggaaaagtagttctccgataagattcagacatgataaagcaggtaatttgggtaataagacaggaggctacggggctaggataatggagactttggctgttcaggtggcccttctcagtgttgccccaaacagtggaatttccctacttacctgtctgtcctggtttatacatgggtttgtctgtctggmcaaagaccagactttgggtgttcagtaccagaactgtgttcctcttcctgaaatcttgcgtaggcccctttatctggatgctaaggaatgccacctctgaagaggctgagatccttgggagctaaaaagcaaaggattttttactactgaggaactgtgcagtcttctccctctgcattcttcagtcattgctatttcctatctctccttcagcttcaccaaggagaaggaaggtgtgactatttcttcagacataagagtgacgatattaatgtgagatggaggaatggtatcagtaagagtggccatcaatagaacccagatctccatggagttcacctagagctctagttattaaattagatgccttttaactgagtatgtatattctgaagcaatggagagaaacatctctgaaaaaatatgggagagcataggagctgagtttcccaagttaggcaactttaaagaggtactaggtgtttgcttagggtatcctgcatgtgcaaaaaattatgttgcatgcaaagtttttatcatgaaattttcatatgatctatttctaggaaatgtccagcccgatccttaaagagacagttacaatcaaaactagaaaactcctctaagtcatgaaatttttgtgggcaataggattattatttaggaatgaaatttagaagagtatttcttccttactctggtaaaaaatgctttgttccttaatagttgaaaactcactatttttagtcctttctgaagtcctaactacattccttttttttttttttttttttttgagacggartctcgctctgtcgcccaggctggagtgcagtggggcgatctcggctcactgcaaacttcgcctcccgggttcacgccattctcctgcctcagcctcccaggtagctgggactacgggcgcctgccactacgcccggctaattttttgtatttttggtagagacggggtttcatcttgttagccaggatggtctcgatctcctgacctcgtgatctgcccgccttggcttcccaaagtgctgggattacaggcgtgagccaccgcacctggcccctgaagtcctaactacattcttaaagtcataccttgggatcgcacaccagagctccatcaccatgacctatagagctcaataaaatgtatcaagcagggatagccagctggcaccgtagcactcacagtgaaggagacacagtggaataagtccttctccgccaccaggtcagtgaagaggctcctgttttccctgccagactccaaggaagcacttacagtcactgtctcattcaggtggctcagaaggacacagcccttcttaggggcctcagtgtggagcagggaggggaccagcaccatatactgcctgggaaaggaagaagtctaaattagagaaaaactgatgatagtaagcgttttcayccataaakgtgttttcataacaatatgtattaattggtgcaatcagttttattctaaaagtcaatggactaagtcaatggaggttctgtcacagatcagcacaaaaattttatcttttactcatcagccatgcctcagccacacaatctggagccatacaacactggagattgctttccaagatgttacaatttcacaggcattccttgctgtaaagagcagtctgagctctttaaactttaactttgacctttaaaaagaatctgaattcttgaatatatatccataaaagtgcacgcacacaaacacacacacatatataaaaaattgggagtgattattcattgtaaaaaggacttacattaaaatctgtctagataaacatcactttggaatgaacaccgtgactagatttacagaaattcaactgaaagaacttcagtaagcatatatcattacacaaaataacacatgtctatattgcaaaatcattttcttaatatcagcaacactgaaaaaaagtatttgctgtttctcttaggctcctcagatacagctcagtcaaagtcaatattttatcaacgagtttgaaaattttgtcaattatttacatgcacaactccctgctacacacacactacacaaacacacactgtattttattatcatttccctttatgctcaatttcttgaggcaattaacattaataatttaatattagtatgtccatgtttataaacatgtttgtttcgaatcacatgggtggataggttatcttttcaataaaaaaaaacaaacaggttcaggctgggagaagtggcttatacctagttcccggcactttgggaggctgaggcaggagagtcacttgaggccaggagtttgagaacagcctgcrcaacattgtgaggtcccccatctctacaaaaattaaaataaaaaatttagccaggtggcacatggctgtagtagyagttactcaggaggctgaggcaagaaggatcacttaagcccacgaggttgaggctacagtgagctatgattgcaccagtgctttcagagtgacagagtgagaccctgtttcaaaaaaaaacaaaacaaagtttatatgagtactaaaagtcatattattttgaaaagtcttttcttttttatttaaattgttgaaagttttcagtttttcagaggcacaggcaattttttgtgtaagcctcacattctggccttagctttattgatgagtgtcctttgtctctaatgccccccactccatattttcctgtcactttccagaagcctccaattcaatataatctctccacactctgaaatcccatgggctgaaagagaatgtgtttttgttgttgctgtttttgagcatctgccacatgacaagaattgttaagctgtctctgtattaagccatttaatcttcccagcaatgctgtaaggtacatgcatgatactctccatgttcatggaagctaaaacatgagatcctcatcagtccccaaaacttgaatccataacagatggataaaatccctgcccccatgccaaatcagtaaaatcagtaaattgtgactaaaatgtaactcttcaaagctttaatgattcartgattcatgattcaatatctgcagggttaggccatttatagagtaaatttgcaagtaaaaactattattttcttrtattattttactacccttactttccattgccaacataaactcttactttttaaattgttttctggacaggcaatttgacacaagaaacccaatattgttgctttacaaaattaataggtgtgagactaggaggagagaatccaaggataattgagttgtggaatgtggaactcaaatttggtcccctcatcctccatgtagtctgctccagcacaccagtcttgctacatgtgttttaaagtgttcctgggcaaaactatatgccatgaatctccagggccactctgaaatcatccaagtttcagatgattttactgtatgagtagtaaggttttgttctctagcagagaagctgagggcagttcagtaactcactgatagtcattcagctagtctcttatgtcttaatctttttctggtatctggatgcttctgatctcctgatcactgctcttttaacagcataataaataataaaaatgtatcattttttacatccccatcaaaaaatttttcctttagttctttgatcttaataagaaggtatatatatatttataatttatttactatttttattcttataaattataagcctaaaagatatcacgattaaaaattaattccacatatatttgatattctaaagaactattttatatgagttcagttaatatttttttaacagatattgaartcagaacaaatccaggttgacaaacttgcccaagatgtcattggtagtgagctgctaaaatgttttaatatatgtttactcaatcatgaatgtttgcattttaaatatttgcctctttagcagggactaaatgtagcaaatattaaagtgataacttttaattttctctttttcattttattcccctgaaaccttcatctttctgaagcttactgccccaaggcaggggagaatggctattggttctcytttgtagtctctcacatttatcacatcaagggttaattctggagggatgaagttaagttttctccttataaagggagaaaacaccccttctgcttgtgacaactagggcatgaggcttgttgttctttgttcagtggcagacacaacgtaaaaggatggtttcaatggcagcatggtccaatgtagtgtaggaatgcatccagaaccacaaattgcttaatgtttctgacccaatacacgctactcgctttatccattcagtctgctctcagaaagcaaaatagcctccacatattcccatatgctttctggatggagagcagctggaagtagtagagcccactgctgtagatgaggtagagggatagtgggggagaaatgtacccctaccggttgccaggaaattgtgcaaggaaaaagcctgaggaaagcaggagacttactggattgaactccttatttctgctttctgcgctttggcctgaagaaggctatttgtgttagatggataagggtaacacacagagcagagggaccccttatccctttcccgatttgggactctgaagacttccctgtatcagtctggaatacaggagacacgataggcatctagaagtgcagtgtgggtatgcaagagagaggtagaagtttaacctctccaggacacctcagtgcctatgtgctattattggacccaagagttctcaccattctctggaagaaatgtaaaggcagctgggttaaggccagggaccttaaatggcctggactgcaaaggggcaaggtgaccctgcatcacaggctgtgttgaaacaatagccatagtatttgaggcaggatgcaaaggtaggagttctatgggatatgaaacagctgaagtgagacagtcagttagagaggactgttgggtcctgaacacacaagagaaaccagatggctaaacttcaacagtgcatgccagcaagtaaggagaagtcagactgacagtagccaagaaggacggagaactttgagaccaaggactctgacagttttctctattaggagttaatggagaccacagttctctagacactatagaggagaggaactggggagaggtggaaaagaagtcttacaattattgagttgtaccaacttacaactggatagggttaaaattattttccctgctttggtcccccactgggggctgttggtgaagacttgatacatgattgaaaaataaaggarctatactttctgtatatatatatatggcctacaatacatgttaagttgcacttcactatatatttcgaatatctctatattcagtgccttccatccaaaagaactgttctgtgaagttgggatctagtgttttatttaatcatgcttcctagtgactaatcgtatttatgactctgattggcccagtgtagaaaaaatgatttcaagaatagaggataaatgaaagacaaacaagggattaactggaataatttcttatatttggaaggtattgtaatgagtggaaaggtggcatttacaaaggaaggcaaagcgaagacacaagggagagactgaaacgcactctggaggaaggggtcttgagtgagacttacggttctgtagagtttgagtcactggcagaaagcaggataagaagtagcacaagacataaatgaagaagtctgtctttccgcattgtgagggataaatctcagggttgtgtccaactctctgccctcagcctcgccctggagaccagctgagtttaccaggctttatgtggccactatgtacaaacaagccccaccccaaggcctctgaatagagttcagaattgagcacagattccctaaaagggtcattactctcagtggttgcctcatttttctcaaggctaaattctgataggtactgaggcatgtctggaagataaaatttgtattccatttagaatgagctttgacagcaaacctcctgataaggaaccttcaacctacctttctccatctctttcaaaatccttacaagcaggtgacaaaggatgctgacaaagaatgtcagggacatgttaccatgatagtagctcatgcattgcagattcatttctgggactgagtgagttataactatagactttagggtttttgggttttcttttttagcagttgattgagtacatggtcctggaagaaagtgatataaaataaggatttcaagagtagaggatcaatgaaagataaaagagataaaagatcaaagagattttagaaaggagttatcaaagatcacacttgtctatttcacagcattgacctgatcagattcttagttgatcctatctgtccttgttactgtctgagcactctaacgtttgagtcccttaaaccatgtcattgactttatctgagatttttttttttgagccatactgtgtgctaagtgctattctggtgatgaaaatacaatattgaacaggatattcagtatccatgctctcatagaacttgtagtacaatgatgatcacatataaaccaccagcagrtttaatgccatccttagactgcagacattggtgtctgtttacatactgtattgcttgaaactttttraatcaactttctttctctttctccatatttcagcctaatcatcccttctttggagagcaaattcctggccacactgctgaaagtggattccttcctattagtttttatttcacatctttgtttcttttgtcacattatcatagaatgaaataatttcttttaaattatgaaatgttatatatatatatactcacaaatatagagagcaagataaaaracactcgtaccttacatgcacccaactttaataaaaktaaacacttgccaagtttgtttaaggtcatttcttcttaagaaatgaaagatggcaatggtagygctcttttaaaatttgtctagaagcttttccagtttttaccagatccaccaacccaaaaaaagaaataaatcaagacaaatatggttggagtttcctttgtaattctctccaatctcatttcccttccaatgttgtgggattaggaagttgatatgtattcttcaagatgtgtttatgtttttaatccatatttatgtaaataatatatagcataattttgtgttttgtattttatatgtataagtggtatgcacatattgtaaaatatgtcatcactattatggttttaagacttattagcattgataatgaggataaaatttattaattttaatgaccatctatacgacattctattgtatgaatgtggccgaacctgttactctattcccctagtgctgaattttggattcttcatagttttcaacattacaaataatactgctacaaatacggtatgtctacttaagcatatttgcaagactttctctagggtatatagcagagattgggttataggctatatatgtatgtacatcttgaaatctatcagattggtaaattgctcttcagagtattacatggatttgaatacccatctgcaacagtggatattttcagtttattatatatttaccatcgttttactctgctaggcattttactttttatcaatctgatgagtgaagcagtatcttgccttaattttcattattaatgactttacacatcttttcatatgtttatggaccatttgaattmtaccatcagtttgatatctcaacacaatatgtaaagggtctatcaggaacatctccttgccccagtttcatgagccttggactctagacgctgcaattttatttactaaaggctttaaaatgtgcttctaaatctctcagccaaatattctggagctgttaaataccctaaggggaaagtgcccttaaacacagaattgcccctttgggttgctatgttgcttctgaactttggattcataattcttcacagtctttgcttttcaatacctccagtgaatatatatataaccaaccattcctaatttaagtgggaagtttggtctcaattaccttgtataccattactggaaaggaaagtcttaagtgtgtatttttattttatataaagagtattggaaaaagaccttgcctgtttcttattctttttagttattgctagttttaaaacatcctcccatgtttatatgtttatatgtatgtattttattaattgcattttattacagtatagccctctttggtgatcatccaagaggtttaatgtttccactctcctaatgataaaaacaggattgtctctattgtcctgccatgaggaaataatgctttgataaatatctttttacatataccctttgagacaggtaaatcctcttgcaagacgcatacacaggagtgagattgttgtatgagaggcatgtacttaagtgactaaatagtgacaaataactctccagaatggttgcatcacaccacaattctaccagtagtgcatgaggattttcgtatccccatattgccaccaatactctagcttttacatttttcttccagtattcctttaaataagctttctgctcatttccctcttttctccttctaggactcccataatatgtgtatttgcatgcttgatggtattccataggtcccttatactttcttcactcttctttaattttttttcttttttcacctttaattaactatttacatgacctgtcttcaagttactaattctttcttttgtgtgactgtgtttgctgttgaagctctccattaaaatattcagttctgttcttatataatttttgtgtgttttttcttaatggtttctatttctttattaaacttctcattttgttcatacattgtttttctaattttatttagttgtctatctgtgttttcttgcatcttactgagcatctttaagatgattattttgaattttggggggaaatttgtagatctccatttggggtggagattagttactggaacttcattrgtttcctttggtggtattatgtttgcctggttcatcattatctgtgtaactttgcattggtttctatgcatctgaaggagcaaacaccttttcccatctttatagactggttttacaggtaaagatcctcaggatcctcctgttgggttcccaggattgacaagattgcttccagaattgtggtcaactggaggtagagccaggtcacatggttttgctgggtcaacagtgaggtctgtggttggcaggcctgttaactggggctctagtaggcttagattctgtctgttccctgggtaaattggactgcctcctagaccttggtcagtaggtctggcactgggatgagggtctactttagagtccacagattgtaggctagttacgagatatgtggatgaatgtggcttcctctgggtccttaggagggctcctactgggtcactgggtaggttcctaggcagacagtgctggtccagattgcagctgagagaaaagagaaccaagtaacagggctgcctcagggcctacagctgagacccaggtcttcaggcctgcctctgggttcatgaatgggcatgtgtcccactgggtccctgagtgggcaggcctgctctcaaatcacagatgagagggcctggagccagtatacagtgctgttttaagatccacagtgggaccaagttcagcctaccagggcacttgtgagcatttctcccattaggtccctgtgagggcaagactgctcttagactgcatcatagaggagctggtaccagatttcaaggccattttaggattcactgtataagaaagaaagtagccaatcatcttttctagtttttttatgttagttattttctttcattaaatgttataactaatatgtatagttgaggccatggtagaaacagtagtgacaaaaaacataactgtctatgcaagataataggacaaatgttttccaaatgaggaaaagagtagttttgtcttaaaatatctgatttttccagaatgtgaaatgggacagtgaaagagaaaatctgaatgaatgtgcaataaagtttgcaggaaaggaaattatttccttcatttataacattgaatctgaaaaaaaaaaccagtaaattttttccatagttggctattttttacaatttttaaatggacacaaattcccattacataacatttattacattacagtgtacaattcagtggctgttagtatgctcatggtgttatgtaattattaccactatgaaattatggaacatttccatcacccccaaaagaaactacatacatgttagtagtcacttcctattttcaacaagtagaaatactaattcgtgcattctctgcaaacactaatctactttatatttttatgaatttacctatttggacatttcatattaatagaatcataatatatgtggcctatgttgtgtggcttctttcacatagcgtgatgttttcaaagttcttccatgttgtagcatatatatagtacttcattcctttacatgagtgaacgatattgaacaatattccaatgtatggacataccacattttgtttatccattcctcagttgatagacatttgagttattctcatttattagctattgtgaataattctgctataaatatttgtatacaagtgtttgcatgagcatatgatttcattttttgggggaatatatacaggagtgaatctgtgggtcatatggtagctcagtgtttaactttttgcagaactgccagactatttttcacagtggctgaaacattttaaattcccaccagcagtgtatgaacatcccattttctccacatttttggcaacatttgttattctgtctatatttaatttttagaatgatagccatagtggatataaagaggtatctctttatggttttaatttgtattttcctagtgaataatgattttgagcatattctcatgtgcttactgaccatttatgtatcatctttagaggaatgtctgttgaattcctttgcccatcttttaattcaattgtttatctttttattgttgaattgtaagagttctttacatattttggatctttgatctttatcagatatataatttgcaaatatttactcctgttctgtgrgttgtctcttcatgcatgatagcgtcctgagacacatagaagtttttagttttaataaaatacaatttaaaacattttttggttcattgtgcttctgatgtcatatttaataaattattgcctaatccaaggtcccaaggatttatacctatgtctcctcctaggagttttattattttagctcttacatttgggtttgtaatcgatttgagttaattttttgtatataatgtgtgttaggggtccaactccaatctttcttttgcatatgggtatttgtttttttcatcatttatgttgaaaatattatcctttccccattaaatgttcttggcacccttttcaaaaataaactgaccaaaaatgtgtggatttatttatggactctcaatgttcttccattgatctatatatctatccttatgctagtaccatgctgtcttgagattgctacagcttgtgtggtaagtttcaaaattagaaagtagaaaagctcttagttctttttttcccttcaacattgttgtgactaatatgaatctttataatatccaaatgaatctaagaatcagtctgtcctttctgtataaaagacggtcgtaattttgatggaattgtgttgaatctgtacatcaatttggggactatctttgttatctttatccgattaagtcttccaactcgtgagcatggaggtattttagagttccttactctgccttttgtgctaatgtcacctttggcttaattttaattggcttattaatttaaaggtttataaaagattactgccaaatatatttatacagaaataattttactttcttttttttaaatgacatattgtttttagagtgcttaacaaaggttatgagattattacttaccttttgttgcaatgcgtccgtccagatagcagttatttgatgactcactagaatatttctctctgctttgtgttgactttacagttatgttaccttttctaatgctaattttaaaatatttgcttgtcattttgattacrtaagtgtaactgagtattacttcttgggcatataatgctatttaatggagtaaccagtggcaactcttgcttttgccttccaaaaatagaatcttaaaaaaaaatttttaagtcagttttaaaatcaggtatttgattttttccaactgagttgtaggggttccttatatattttgaaagttaacccatttaacccattatcagatatatgatttgaatttttttccctctcattccatagatttcctattcattttgttagtattccaatagaaaattttgccctcctccattcttacattattggttatactaataaattaatctcattatgaagcagattgttgcttctttatgcttgctgaaggcatctggaaagaaccctattagacactgtgaactttgatatttcaaacaatggacccttgaattgaatcctctgaggtgttattcttttgtcaactttcagactgtaccagtggcttgaggcaggatttccaagactctttttagttcagaagcaaacatacttccttaaaaaagaatgcttgacacaagatcaaacaaaagaagaattactaggactgaaaaaaaactgagaaaaaaattaaattgtgattacttttttggaatatggtaggcattattttaattacgtttttaataaatacgaaaaaagtcctttctctttctttttatacaatatgtaactcttaatttagaagattttacatctgtgggttgaattaaacatttttaaatgatacctgatttttgtggactccattagaattcagaaaaaaagaatacttttactgagtctccttacttttcatggcatgtagttatttacattatttaataaaaatctgttttccttttaacctrtatataattggatacatcgatacagttatattaaagtataccttgtgtgttagtatttgaaaatactcatttaatcaggcatgataagcccattatgagaggacttcagaaagtcctaggtatcctaaatatatatgtacccaatacaggagcacccaaatacataaagcaagctcttacagacctatgaagagacatagattccaacacaataatagcagtagacttcaatagagcattgacagtattagatcactgaggcagaaaactaacagagatattcaggacctgaacttgacgcttgaccaaatggacctaatagacatctacagaactccctaccccaaaacaacagaatatatattcttctcattgccacatggcaaatattctgaaactgtccacaaaattggataaaagaatcctcagcaaatccagagaagccaaaatcatactaaacacagtctcagaccacagtgcaataaaaatagaaatcaatactaagaagatcccttaaatccatacaattacatggaaagtaaataacatgccctgaatggcttttgggtaaacaatgaaattaaagcagaaatcaagaaattctttgaaacgaatgagaacaaagatagaaaataccagaatatcggagacacgtctaaagcagtgttaagagggaagtttataaggctaaacattcacatcaaaaagttacaagatctcaaagtaacaacctagcatcatatctagaggaactagagatataagagtaaaccaaccccaaagctagcaggagaaatgaaataaccaaaatcagaatttaaatggaggaagttaagatgcaaaataaataaataaataaatacaaaagatcaatgaattgaggagtggatttttgaaaggatagataaggttgatagaacactagatagactaataaagaaaaaaagagagaagatccaaataagtacaatcagaaatgaaaatgagaatttaccaccaactccacagaaatgcaaaagaacctcagatactactaaggacacctctgtgcaaacaaactagaaaacctataagaaatggataaattcctgaaagcattcaacctcccaagactgaaccaagaagagactgaatccctgaacagagctataataatttctgatattgaatcagtaataaaatgcctaccaaccagaaaaagcccaagaccagattcacagccaaattctaccagatacataaagaagagatggtaccattcctattgaaattacttccaaaagttgaggaggaaggactcctccctaaatcattctatgaggctagcattatcttgataccaaaacctgacagagacagaacaaaaaaagaaaactttaggccaatacactcaatgtacatagatgcaaaaatcctcaacaaaatattagcaaaccgaatccagcagcacatcaaaaagctaattcattgtcagatgtatagattgtgaagattttctcccactccgtgggttgtctgtttactctgctgactgttctttttgccatgtaaaagttctttagtttaattaagtcccacctatttatctttgtttttattgcatttgcttttgagtttttggtcttgaaatccttgcctaagccaaaatctagaagggtttttctgatgttatcttctagaatttttatggtttcaggacttagatttaagtccttgatccaccttgagttgatttttgcataaggtgagagatggggatccagtttcattctcgtacatatggcttgccaattatcccagcactatttgttaaataaaatgtccttttcccattttatatttttgtttgctttgtcaaagatcagttggctgtaaatagttgggtttatttctaggttccctattctgttccattagtctatatgcctatttttatatcagtaccatgctattttggtgactatggcctcatagtttagtttgaaatcaagtaatgtgatgcctccatagttttttgtttgtttgtttgtttgtttttatttgtttgtttttttaagtctttctttggctatgygggatccttttatgttccatatgaattttaggatttttttctagttctgtgaagaatgatgatgatattttgataacaacacaattcgcaattgcaaaattttggaaccagcccaaatgcccatcaatcaatgagtggataaagaaactgtggtatatatatgatagaatgctacttagccataaaaaggaatgtattaatggcattcacagcaacctggatgggactggagactattattctaagtgaagtgactcaggaatgraaaaccaaacattatatgttctcgctcataagtgagagctaagctatgagcatgcaaaggcataaaaatgatacagtggactttggggacttgtgaggaaagggtgggaaatgggtgagggataaaagactacaaactgggttcggtgtattctggttgtgaggctggaaaatagggtctggaggcagggaacataaggctgattcacacttcagctataacaggaaatatcctctctataaggcgtaggccaagtaaatgactttgtaactttacttcatcttcttcatttacatagggtgtaccccaagtagagggtatttaaactcccaaaagttctgtaatggagcctttgtgtccctatgctcagtcccgctcttacaccgtggaatgtactttcattttcaataaaacccttcattccttccttgctttgttagtgagttttgtccaattctttgttcaagacaccaagaaccttgratactctctaccgctaacatttgtgtgatgggtgcaccaaaatctcacaaatcaccactaaataacttactcatgtaactgaacaccacctgttcaccaaaatcctatggaaataaaaataaataaataaatgcatgccaaaaaaaagctaatccaccattatcaagtgggctttattcttggttcaacatgcataaatcaataaatgttatttaccacataaacagaatgccgaactgaaaaaccacatgatcacctcaatagacgcagaaagggctttcaataaaaatcaaaattctttcatgttaaaaacccacaaaatctaggcattgaatgaacatacttcaaaataataaaaaccatgtattaaaaacacacagccaacatcatactgaatgggcaaaagctggaagcattcctcttgaaaactgggatgagacaaagatgccttctcttaccactcctaattcaacatagtactggaattcttagccagcacaatcaggcaagagaaagaaataaaaggcatccaaataggaagagaggaagttaagctctccctgtttgcgartgatatgattctatatctagaaaacctcatcatctctgccgaaaagctccttgatctgataaacaactgatacccaaagcaatcctaagcaaaaagaacatagcgggagacatcatagtccccaatttcaaactatactacagggctacagtaaccaaaacagcgtggtcctggtacaaaaacagacttccagaccaatggaacaaaatggagagcccagaaataatgccacacacctacaaccatctaatctttgacaacgttgacaaaagcaagcaagggggaaaggactctattcaataaatggtgctggaataactggctagccatacgcagaagattgaacytggacctcttgcttacaccatatgcaaaaatcaaatcaagatggattaaagacctaaatgtaaaacctaaaactataaaatcctggaagataacctagaaaatacytttctggscataggcccttrtaaagatttcatgatggagatgttaaaagcaattgcaacaaaatcaaaaattgacaagtgggacctaattagactaaggagcatctgcacagcaaaagaaactatcaacagaggaaacagtcaacctacaaaacagaaaatatttgcaaactatgcatctgacaaaggtctaatatccagcatctataaggaacttgcttaagaaattaacaagcaagaaacaaagaacaccataaaaatgtgggcaaaggacaggaacagacacttctcaaaagaaaacattcatgtggccaataagcttatgaaaaaatattcgacatcactaatcgttagagaaatgcaaatcaaaaccacattgagatactatctcacaccagtcagaatggctattagatggtggcaatgtcatagagaaaaaggaatgcttatacactgctggtgggaatgtaatttagttcacctactgtggagagcaatttggtgatttctcaaagatcttaaaatggaattaccatctgacccagaaatcccattattgggtatatacccaaaggaatataaatcattctaccrtaaaggcacatacatgcagttcattgcagcattattcacaatagctaagccatggaatcaatctaaatgcccaccaatggtagactggataaagaaaacatgccacatatacactatggaatactacacagccrtaagaaagaatgagatcacgtcctttgcagcaaaattgatggagctggagaccatcatcctaagcaaactaacacagggacagaaaaccaaatactgtatgttctcacttattagtggtagctacacattgagtacacgtggacataaggaaggaaacaacagatgccagggcctacttgcacgtggagaatggaagagtgaggattgaaaaactacctattgggtactatgctttttacgtgggtgataaaataattatacaccaagcccccatgacacacaatttatctatatagcaaacctgcacatgtacccttgaacctaaaatacaagttaaaaaagaacaatttttggtgaggggagactctgaaaaaaagtatcagaaactcaaaaataaggtaaaatgatggtagtacattctttcaatactattttggggtaagggtcacttaagtattatctaggggaatatccttagttcatctcattatttatcataaagattccaaacttactaaagttactttttgacttttatcaagtaccagtataaatcatttctgtccaatggaatagaaacctaagatttttaccatattgtaacattaaccagttttatacataacatgtcattcttatcctaacagattttttgtttgtttgtttgtttaattgtatgcaaatatgttagttttttaatatgctctttgaattggtaataacatcctactggttatttctttgacatgtgtgttgtttttacatttgcctaagaatcatggttttatccttttcaaattatgtttttaccaaaaatttgtcaaaatagacagttaccatagttggccaggtgcggtggctcacgcctgtaattctagcactttgggaggccaaggtgggcagattgcctgaggtcaggagttcaagaccagcctgacctcgtctctactgaaaatataaaactagccgggggtggtgatgtgtgcctgtaatccaggtatttggggtgctgaggcaggagaatctcttgaacccgggaggcggaggttgcagtgagctgagatcgtgccgttgcactccagcctgggcaacaagggcaaaactatgtctcaaaaaaaaaaaagaaagaaagaaagaaagaaagaaagaaagttaccacagttaataatacttacctatgagcctcagtatgaattataaaatattttatagaaaagtactctttatacaatttgacaaaggcattctcttttattttcaatattttacttttttatgcctgctacaaagaagcaatttaagttttcattcagctgctctgtgatgtggaaagagtatttttgggccaagtgttattcaagtgtactgatgatgaaagtcttttgttaatatatgaacagactttgagtaatcagagatcgtttactggaaatgacaagtttcatcttgtctgattaagtacacattaaatcttggcacagaytttcttaggcaaaactttgctcaacartaatttgaatccacatagaacccttgcctttagtaccttgaatattctttgttattgcattaattcccattcctaaattttacaagatgtctgagactattaagtaaaatgcataaagatatttctcatattattgctgtttaagtgactcctttacgttttaaaaattcctaagaaaggtcttttacaatacttctactttgcattaaataataatcaaacctcgccttgggggtgtgccagacagattaaaatgaataaatcaacacttcacccaaacattcattcatagacttgcttttttttttttttttttttgagacrgagtctcaatctgtcacccaggctggagtgcagtggcatgatctcagctcactgaaagctctgcctcccgggttcacgccattctcctgcctcagcctcccgagtagctgggactacaggcgcccrccaccacgcccggctaattttttgttgtatttttggtagagatggggtttcaccgtcttagccaggatggtctccatatcctgtccttgtgatccgcccrcctcggcctcccaaagtgctgggattacaggcatgagccaccacgcccggccagatttgcttttttattataaatcatcttttaattttccttattaacacagaaataaacaagaaaattcttcctggagaactttaagaacacaaagagatgtgtcttttctgagatamgctctaagcatgacagaggtctagaaatggaaagctgaaccccacgtctcagattttattatttattatctggtttttttttttgaaatagagatgaggtctcactatgttgccctggttggactccagctcctgggcttgaacaatcctccaccctcagcctcttgagtagctggaactataagtgtaagaccactgcactgggccagattttaatatttgtttgcttattttaaattatatgagatattttcttgtcttttttttttttttttttgagatggagtcttactttgttgccaggctggagtgcagtgatgtgatctcggctcattgcaacctccgcctcctgggttcaagtgattctcctgcctcagcctcctgagtagctggaaatacaggtgtgcaccaccacacccagctaattttcgtatttttaatagagacgaggtttcaccacattggtcaggatggtctcgatctcttgacctcatggtccacctgcctcgacatcccaaagtgctgggattacaggcataaaccaccacgcccagccaagacattttcattgttaagttaaactctgtggaaatatgtaaaacatgtattcttcctccacccaaccatctggatctgcttaaaagacaattaaaaatttgctaagtaaacttggccaacgaatgaaaagatactattttaattggagattatagtagttttctaggactgccataacaaaatactgcaaagtgggcggcttaacacaacatacatttattctctgttggttgtggaggctcacagtccaaaatcaaggtattggtagggtcatgatcccacagaacgctctagggagaatctgccccatgcctttctcttagcttctggtgttgtgagcaatccttagtgttcctgtgtttgcccccatcatcacacagagttttccttgtggtctgtctgcatcacctttcctctgtacacgtatcatttcttcttacaggacaccagtcctaccggattagggacccacactactccagtatgactttatcttaacttacatcttaattacaactccacggaccctatttccaaataaagcgacattcgcaggtaccaggcgttaggacttcaacatatcttttttggggacacaaatcaaactacaacaaagatcatttgtatttacctttctgataattgttaacagttccttttgcaagatagaggccatgatttcccatgtagagctcactgaatgtataaaatgtactttcaaacaagttttgctcaaagtcccaataaataaccatttttttccttctcatttatttgactttgggaaaatatcaaaatcttcttccttaaagtgtttgtgaaacattaagcaactcaaaccaggttcgagtcaaaatgatttttctagctcatgtttcctactggtgtgtgctaacaccttagtgttactccatttctcctctaattccctacctacaggaatacgctyactcaggcactgacacacttaatcacccctttgttttaatgagtgcctacaacyttcccagcactgtgttgggtgaacaggctgcacagacatgattaagatacaggtttggctttcaaagaggtatgagtatatggatgagaggaaaataaatcatttttttcttttttaaaattattatactttaagttccagggtacatgtgcacaatgtgcaggattgttacatatgtatacacgtgccgtgttggtgtgctgcacccattaactcgtcatttacattaggtatttctcttaatgctatccctcccccatccctccaccccgcgacaggccccagtgtgtgatgttccccatccaagtgttctcattgttcaattcccacctatgagtgagaacatgcggtgtttggttttctgtccttgtgatagttttgctcagaatgatggtttccmgcttcatccatgttgctacaaaggacatgaactcatcattttttatggctgaatagtattccatggtgtatatgtgccacattttcttaatccagtctatcattgatgaacatttgggttggttccaagtctttgctattgtgaatagtgccacaataagcatacatgtgcatgagtctttctagcagcatgatttataatcctttgggtatatatccagtaatgggatcgctgagtcaaatggtatttctagttctagatccttgaggaatcgccacactgtcttcacaatggttgaactggtttacagtcccaccaacagtgtaaaagcgttcctatttctccacatcctctccagcacctgttgtttcctgactttttaacgatcgccattctaactggtgtgagatggtatctgctgtttggcactatgcttcttggacacaccaatgtatctcaggatttacttgtctgtaaaggattttatttctccttcacttttgaggcttagtttggctggatatgaaattctgggttgaaaattcttttctttaagaatgttgaatattggcccccactgtcttctggcttttagggtttctgctgagagatccactgttagtctgatgggcttccctttgtgggtaactcaacctttttctctggctgaccttagcatttttgccttcatttcaaccttggcgaatctgacaattttgtgtcttggcgttgctcttcttgaggagtatctttgtggtgttctctgtatttcctgtatttgaatgtcggcctgccttgctaggttgggtaagttctcctgtataatatcctgaagagtattttccaacttggttccattctccccatcaccttcaggtataccaatcaaacgtagatttggtctttttacatagtcccatatttcttggaggctttgttcatttctttttactcttttttctctaaacttctcttcttgcttcatttcattcatttgatcttcagtcactgataccctttcttccacttgatcgaatcggctactgaagcttgtgcatgcatcacgtagttctcatgccatggttttcagctccatcaggtcatttaagatcttctctaccctgtttagtctagttagtcatttatctaatcttttttcaaggtttttaactcccttgcgatgggctcaaacatcctcctttagcttggagaagtttgttactaccaacttgctgaagcctacttctgtgaactcatcaaagtcactctccatccagctttgttctgttgctggtgaggagctgtgatcttttggaggagaaggggcgctctggtttttagaattttcagcttttctgctctggtttctccccatctttgtggktttatctacctttggtctttgatgatggtgacctacagatggagtttttgtgtggatgtcctttttgttgatgttgatgctattccattctgtttgttagttttccttctaaccatcagtttcctgagctgcacgtctattggagtttgctggaggtccactccagaccctgtttgcctgggtatcatcagcagagsctgcagaacagcaaatattgctgtcygatccttcctctggaagcttcatctcagaggggcacctggctgtttgaggtgtcagtcagcccctactgggagggtctccaagtcaggctacacgggggtcagggacccacttgaaggggcagtgtgtccattctcagagctcaaacaccatgctgggagaaccactgctctcttcagagctgtcagacagggatgtttaagtctgcagaagtttctgctgccttttgttcagctatgccctgcccacagaggtggagtctacagaggcaggcaggcctccttgagctgaggtgggctccacccagtttgagcttcccggtcgccactgctttgtttacctactcaagcctcagcaatggcggatgccccttccccagccaggcttgctgccttgccattcaatctcggactagcagtaagcaaggctctgtgggtgtgggacccactgagccaggcatgggatataatctcctggtatgctgtttgctaagacctttggaaaagtgcagtgtttcggtggcagtgtcctgattttcccagtacagtctgtcacagcttcccttggctaggaaagggaaatcctcgacctgttgtgcttcccgggtgaggcgatgccctgccctgcttcggctcgccctctgtgggctgcacccactgtccaactagtcccagtgagatgaaccaggtacctcagttggaaatgcagaaatcacccgtcttctgatgactatccataatgcaaataggaactattatcttgcttaaaacctttcaatgacatccatcaacaaatgagaaatattgttctagtttttcactatcttgtgaaaatcgtttgcctccatgtatacgttgttttatttttcaacttatcctactatatatgtctatgaagctaatctttaacttggtacttcagtccaaaattagaaattaagtcagaattagaatttgcttcatgtgaattgaataaatataaaatgagtctgaatagggaagatgaaatgcaaaaaattgacacttgtgcttaaaacctttyatatattcataaccttaaaaccttttatacatttatatattcaatgcaattccaaacaatacctagttgactatggggataatgaacttaaaagattctagagttttaacttgaacaaataatgatcttagtaattgtattagtccattcttgcattgctataaagaaatacctgagattgrgtgatttataaagaaaggaggtttarttggctcacagttccayaggctgtccaagaagcatgatgctggcctctgctaggcttctggggaggcctccagaaacttacaatcatggcagaaggctaaaagggagcaaggcttctaacgtggtgggagcatgagcaaggtgtgggggaggtgctacacactgttagatgaccagaacttgctagaactctatcatgagaacaccaccaaggggatggtgctaacccattaatgagggattcacccccatgacctaatcaccccccaccagaccccacttccaattctggggattacaattcaacatgagatttggtgaggacacaaatcagtgatgcaaagaaaaagtgaaaacagagaaatgaaaagacatcagccacagtagtttttaaaacattttattaagctacagcaattcaaatattgtaatccttatgaaagaatagaccaggtactcaatggactagaatagaccattcagaaacaagccttagtatacgtgataatttgtgataaaggaggcatgttttattagcagggaaagattgagttggtcaatcaatattaatagggctattagaaagctacatggaaaaaaaagttaatttagatactttcttgctcaccacccaataaacaagaaaataatttgagatggaattaaatggaaaaatctgcagcaggacttttgcttccacacatgcaggatttcatcaccacaaaaactctctaatgctactcacggtcacacccatcccactcccgtactctctgtaacccctagtaaccacgaatttgtttttcgtctctataattctgtcatttaaggaatgttgtataaaagaaatcattcagattgtgaccttttgagattggctttttccccacacagcctaatgcttctgagatccacttaagtcgttgtgtatgtcagtcgtttgttcctcttcrttgtccagcagaactatgtcgtatggttgccaaaccattcatctactgatgaactttttgttgtttccaatgtttggaaaaactgttttctttttcctttttgtggtttaattgacatttttaaaaattccgctttaattcatctatagtgtttttgagtgtacctctttgtatagcttttctgtgatttaataaatgctagggagaatagattcatattcagaaaagtgaatatgatattgataaagaacaaaagaaaagrtagagttrtaaatgccataaatttattcaacatacaaattttgtgtatttccaatgatcttcccttctttctctcactgtcctctctattgatgagtctgttcttcatttctggagaagttcacccaatgagatccgtaagttgctgttttcaagcatttctttattcagattctaagtagtaaaagaaaagggagaaagggaaattatgtgacctacttaagaataattctttatatttcagttataaatacttgaacttagtaacttttaattatttttaatgatagggatgttctccgtgttttcatattttaaaatggagaagcaaaggtttcatggcaaattctatgtcaaagatgaaccctgtcaatcagcctaaaggaaggtcttatagaccacacctttcatgctgtgctatatggataattacagtgacaagttttttgactttagtatacacttagaaatatcctagaaaggctataggggatgaatatatcaccactgggtatagaatggaaactacatgttagataatttagtttttacatatgggaaattcttggattcatcttcaaacaagtcaccccagacaccagtaattgtatttaacttgcatttttttctgagaaattttataatacatttgatatagttcaatttatacatggtacatcagggtttttttaggatatggaaagggtacagtcttctcaagaagcagccttatgcagagaactgagatgcttatttattttgaagttgggattagactttactgtttaactgagatgcttatttattttctttcaagtggcattagattgaatcatttatactttaccagcactgcaaggggcattgtattcttcaaaggtgaattcatctgaaacacagaaattattggagagaaagagtgaagacattcaggcataagcacccaagatgtgaattgtaaataaactatgtaagctaagaaagaaagtagacagcatcgctatagaaccaataaaaatgacttctctattaagctatttgggattggtgggaggaaactaagagaaaatctggcttgggaacagaattgaaaggccgggtacacgggtggcatgcctaagaatagttacagtagttacaggactccgtagatagtaccttttcacagctgtgtttttctcattggaattgcaccttgctctctgaacctttccttaatcaaagaagaacagttttagcactaccatcatgctacaatggtggtaattttctagctcaaagccatgagcaaatcaaagtatttcctgattatcacaaagtttcccaaattgtgtgagactatccgaagcacaagtcaaaaacagatcaaatttttcatgtcacacatcagcactgagatgtgttttttcagttattgkactcttcttatctctttggagtaattcagcccaggacaaacaactttatagggaaatttagatagaagatagaatggaccctcttattgccttatggtcaatttataagaatgactctaacacttgtttagtggggggacatgagaggttaatatacaagaacatgattatccagtgcacacaaactcactttttcccccagtgaaacactgtggagttttgctttagttaaggcaatcctttactaggttagtagtctttttttttttttttttttttcatttcaaagctcagcatgtctgaatcttacctgtctcataataatcataggcttttactgtagctggttttaaattctttatttggatgtcttgttccacaaagaaggaaaaatgcagggtttgatgggttagctggagagacaggaaaacaattggaatcaaagattagttaatctttgattaactagttactagttactggccactcttcataagatattatcaaaccctgtagttatgctatatatctgtaccagaacctatgaaaagaaaggggaattctgtgacctgcataacatactcaatgacagataaaagaaggacaaaagagacattttgtagacagccaaatgtaatgaatcaagcctgttgacagtccaggcttcatttcttttttccttttcttttctcttcttttttttttttttttgtgggggggaccaagtctcgctctgtcgcctaggctagagtgcagtggcacgatctcggctcactgcaacctctgcctcccaggttcaagcgattctcctgcctcagcctctcaagtagctgggattacaggcacctgccaccgcccccagctaatttttgtatttttagtaaagatggggttccaccatcttggccaggctggtctcgaactcctgacctcatgatccacctgccttggcctcccaaagtgctgggattacaggtgtgagccactgtgcccggccggcttcatttctttttatagaacctctagttgttattccaaatctagcagagtcacagaaagtcttaccttttcaaagtagattgggacatggttggtgctcacttcagtcctctgaatctgaggctgtttctggagctgttgaccaagaggataagccagaaatatggaatgagaaaacttcatactggcagtagttttcaggtatttatgatataaacagcttctcaggagcatccaaactactaattttgatttcttcaagaataataatgaaaataacagtagcaatatttattgaacttttattctctatatatgctataagtgtatgtgcagatacatatatgtgatatatatatgcatgcacacacccatatatccttttctctttttatatatagctggaaaataattcaataccattccacataactaggtgtcttggggcctgttggaacattatttatcatgtttctgacttataccctatacttgacaccatataatcatgatacacactattaaaatgatagagacaccctctagagaagcaattttgagggagcacacctcttgaaaagtgcatcaataaagtcaaattgacacgataaatgccagcatttaccatggctttgctatttgtaagggatctagggattacctttttaactgatgctctcataggtatgaagcctgataccatcttcacatcaacaatgaccatgttggaactgggtcagtccccagtataactataaaatcaaagcataagaataaggaattcaaacaaaatttcttggaattcattcaagacaaactctctctttaccttctatttctaacactaagttactatgtctactgtatctgtttctgttattatggttgtttggaaaacccatcattttaagctcacactcttcagatattgtaataccatattatcaatgttaagtctttttcagaaaattttctcattaataaacactgcaagaattccatattcattatgtgtggctttggacagtggagtttctccacataagaaaatcaatttctccatattctattcggttggtgcaaaaggtctggtcatgatctaggacttacctaatgttgatgtgaatctggaacgttctgtgagcatccattccatcacaatttgtggggagagtattaacctgcagagcaaaaggtgttttcccttctttcttgggaaggatgttatatctcaggcatgtctaaaacaaatggaaaaaaaatccttaatttttacactgaacttgtctcataatctgttccagacgattcataccttcccttagcacacacttctttttcttattttgaaattcaaatataactcttgagactttctctcccatttgcagcatctcctaaaccccagcagtctcacctggaggtacacacatcctgaccctgacatggttgtgctgtactcccctggaacctctggcaactggacctcctgcagcactaggcagttgccatcatcaacttggaagtctttagaaaaggtgtctgaagacttgatggtgaccaaagctgctttctcacttttagtgaaagttgctgttccatatttggagagcgcttgaagagccaccactgtgtcctgaaaaaaaaaatgagtagagaaatcacagaagaggaaagtaacaaactcacactggatgtaaaccataacaacactattcttttttcagaattatttagtcataaatgcagtccactaactctatttcaattcagttcaatctggttagtaatgataaacyattctagatactttgaaggtatatttttaaaaagtttcttcattcagctagtttaaatagacatatggagataagacttagatatytgacacaagcccaggctatttcaataatttataaatttatgtaacaatatttgttataaaaggtcagagaagagagaagaaaatatgggttagaatagtaagagaagactgaagaaggttatctgagaaataagattatctctgaataatgagcagggtttatgtagacagaagagaggcatcgggggggggacctgggtggggaatgctctatatgaagtcatggaaactgcggtgagctaattccagaagaagcaaagggatctgcctaatcagattggtgcactcatgtttactggagagaggaaatatttttgataaaatattagataattttaggctttgagtgaaaaaaagatttattttctaagggaagtaatcccttgaaaatattgctttgtgaagacaaacctacctgcatggttggggggcccctagggagttaagagaggagagagtataaaaaggacagagcagtaatccatacataagatagtaaggctggaacttgtctgctgatggagggatggagaaagtgtgaattggaaatactaaccattccattattcaactcccagatggttgtgtcttcatatatgtgaatatatttatgtttccttctagagtcttcccacagacctgagtggaggagaagcccccttggggattttgctgcttggtaatccacttcacaatacgtgatgccacagacaggtcctctgaagatggggcaggctggacagtaagataggcaaggagcacataagatgtcatctctacttccacagagggagcccagggttgagaatagagggtcttagcttcgtgaagtttcccaggacgttgccagtggatcgaatcctctttgacatagaaaagggtagaatttttagcttaaaggatgatttcaaaatctaatccataagtgataattataattacagtttacctaataaattgacatttcattttaatgaagtgaaagcattaaacaaagtgaaagcattaaatagtcactatcaaacaaatctttatcaagaaagtaaagttccagggaataacattgagcctttgtgtctactacatgtgtgtgtgtgatattagaaggtgggactgtatagagtctatactgtgtggattaataaaatgatccatgttatccagagaattcgggtcttagatcaatgataattattctgtcattaaattaagatagcatggtaagcatgagctcggtagaggtattgtcccttcttttggtcactggtggttgtcagaagtaaactttgcagtagcagctcttaccttctttcatagcctctctgtttaatgattcaagcaactctcttcgcttgactttgtttcctgctagggcaaaggcataggccaataatgctttggtatagacaacacttccttgggcctctgaggtggagctccaggccgtttcaaggcaggatagggcactgcagaccactgcgtgctatgaagaagacgaaaggctattgtaaaacagcagaaccaggcaaatgagctattcccgggctaactgcagattaaaaaccttaatgtgcctgtataacctcacagttctgaccagagaggagtttcctctgctgcttccaaaaggatctggtcctttacattccagtgaaatgtaccaaaattaaataccataaaaatcacaattaatttccctcagggattcaccatattataattttattctttacgtgtgtgaaggaggtacagaggatgtgcttgaacatacagtggcaggcagaggcatctccagcaaagcaatggtgatgtaggcagagaatgtcacctcatcgttcaccccaccgtgtaaggatcagaggcagagagactcaaacacttcaacagtcatgagacagcatctgctaacacttcttttctttttgacatcttcactagagtgtttcttgtcttgtgctagattgtttcttgtcttgtgctagattgttgattttctccccttcctcctctaccctaaaattcttgagtctgtcccagatcaccttccctcactttttatagtatgttcggctttgaggtttttttgaacactattttcattcaataaaaaactactaaggtattgctagatttcaggagatttagagtccaccattcttcctgaaatctatgtcgctaagactgaaggactcaattcaaacatcatttcctcccacatatcactatcttcagggaccagaagaaaaacagagaaggcatcaccttaatggcattgttcagcagtgatccagagccttcgaaaaaaccatctgccttttgtccctgtgaaagccaggtgagggcatccctgatgtgtgagctctccacaaagatgtacgattgggcttgagcaaaggacttgagcacaaatgcagtgagcccgtcgagcaaaacagaaacacacacatgaggaccacctcactttcatagctcactttgtgcactgcctccagacattgctcttcacaattcagtggaggagattactgggaggtattgatggggaaatagtatttaagagctgaatatactctagtccaacaaacacctcaatatcttttattatatctcaactttattggtttctctgagttgatgctttttaatttttttgttgtgaaacatttgttggagcctccaagcctccccaccatgaaaactgcatttccagaatgacttgtcctgactttactgcatcacggtctccttctgtcctcgccctcccctccttctttaatgcacagtgtgggagcttcttcccctgtcattttatagaatgacattttctgctttatatttccatttagaagatccttatttcaccattttcagctgtgttatcacagcaggtaagctttcagagatgaaacggtgagattacccaacaggaatgatacatacagcatatgcgttatttaaagactaacaattttccacaaaaaactccagatattagagagtagctgtttctagaatcctgaaatgtcatggatctacagagagcatagggaaaaaataatcttgtttccctgactgctaccatcattgtccccaaaggtgctgtaggaaccatctctgtgcttataattcaattgcctttggtaccctgaagaggaagtgttcatagatttattgaaatggcaaagacattggaggattattgagcttttttctcagtgctattaggaatcatagggtaactaatatttagttaaaatttcccgcaacccccaatcacaggcttgatgatactattgaattttctacttgtatattgggacattttattgaaaatcacgacaatgactatcgaatcttaatgaaacagatgttgattttcgttcaccaaaaaatatttaagagattatggctcttctttttgaggtaatctctcaccactgatgaggtagctagtggctttggccttgatcttctctgtcagctgtcgtgtctcatttagatagtttagaacataaatgttagggacaaaaaggaccatattctgctctccacaaccatagggcatctgaagaaggttctgaaggttttgcactacagagcctagtatatcacctgtggaataaaagttgtaaagaaatcagatatggtttgtattaggctaggaaaatagattattagctaactgagaggccaaataacctatagagaaaaggacaagaagactaaaaaaggtgaaaaaacaagaaatagggaggaaaacaaaaggtgagaaaatagacggtttaaggatggagaaaggggggaagaaactgaatggtaggtgatctatcttttctcatgggccacatgtctggtaaaactcaaccacaaccattttcaaactgactaggaagcattaccacctagtaaattgcttgaagatgagggcactgagaggtgaccctttctttttagaatatatcaaggcataatatgtagcacaacatctattcaagcccctttccaactgtaacatagtgtaacccttagtgctttctctcaatccattgcctgttgtcagaaacttcattaatcgtggatggtgaggcccatgcactagaattatacagccagacagctgcttcccttgggctgaaagaatcacctaaaactgaatatgttgcccttggagatccttcaaccacatttgaaggaacattcagtgacaccttttcaggtactccagtatctaatgaaagaagaaaaacacacatataaaggaggggaaagtgagagaaatgttctatttttgttatgaatcatgtttctctacatcatctagatccaaccttttattttccttcgtcattatataactttttttttttttttttttttgtgatagagtctccctctgtcacccaggctgaagaacagtggcgtgatctcactgcaacctctgcttcccaggttcaaatgattcttgtgcctcagccacctaagtatctgggattacaggcatgcaccaccacacctggctaatttctgtattttttatagagacagagttggccaggctggtcttgaacttctgatctcaagcgatttgcctgcctccatctccccaactgctgagattacaggtgtgagtcaccatgcctggctcagttattacataatttctttgatacaatccaagtttcccttaaagccatgattcatctctcagtgaaattcatattcatcatatacatttgtgctaaatttctatggcttttcctatgggcatatacttatggtatgcttatttccttctcttcatggtttatattaattcctgctactgttagtgcttttcaagaattacattcattccattcatttgtattcagtgtatactatgtaccaggttctaagtgcaatgataccgaaagtttcaaaacaaatttcctggcctcctggagatttcatttttaggggaagactacgataaaaaagcaagagtatatttagtatactagatgttgataagtgctatagagaaaattaaagcagggcaagtgtttctatggtgagctagtaaaacaaggcaggtcaggaagtggggagggggctccctatggaaaagctcattgataaaaagtcctgtgtgagcagagactttaagtaagtcaaggagccagatttatccaaacctgggggaagatacttccaggaaaaaggaacaaaaagtaaaaggactccagagactgaagcatgctgggtgtattccaataggaagaaagaggtcagtgtggccggaacgggttaagcgaaggagagattaggaagacgtgaagtcatggggtagcaagggtttctaagtggcattaaaaacttacgctttaacttaggggggatatgggagattcctgaaagggttagagaagaggagggacacgatctgacacatsttttaaaggatccctctcgctgaaggggaacaagaagagatgatcaggagaccagttagaaagctattgagagcctgcaagagaaaggactagaatagtagagatggagagaagtgggtagattctggatgcaatttgaaggtggaatcgactagatttgtgcatggattgggtagggaagataggggaaagaatgtagtaaagaactccaaagtgtttctccctagcaaatagaagaatggatttttcatcatctgagatgaaggaaattgagggaggagcaggtttgtgaggacgagcagatactcagtcttaaacttgctgattttgatatgcctatgagacctacaagcctgtaagtggagagtgggcagttgaatacatgagtttgagttcaggaaaaaggtgtggatcaaagttgtacagttttggacacaagtacatagttgttattaaagccattgactagatgattttatcaagggatcctcgtatagagaagagagatctgcagactgagcattatcgtcaagatgattataggtggcacagakttgggtttttaatgataatttaaataaacttaaaaaagtgttagcttttccccttctctttcaatatagtggtaatttttgtattgctatattaatgatattggtaaaatactggttttctatacaagttagtaacctggagttcctcttaaaataacttgtttaagtaaaaacatgagtgcatttaaactgtcaattgaacagtaaatcatactagtgtcacacagatatttcaatattttgaacatggtttaggaagacatttgagaaacacagaggtatcagaaagaatcctgtcctgaggtcaacagccttagaccttattattaggcaagagcttttaagcttttaagcaagtcttttatttctctatgcccatttctttattcttaaaatacaataataataatttatcctaaaaagtactttctatttatttccctaagaggctcattccaagtgattttcatcagaacaatgtttttcttttttttttctttttttttttgctagaacaactcagcaaaataaaattcctgtttattgttggacaacattgtttcacacatacatcaaacaggccaaaaaataaaaataaacagcaacttcatagacaaaaaaggaaaaaaaagaaaccttttatctttggcctttttaaccatctcatacaaaccaactacttatagtacagctaagtacatacacaaaaaagttactggaatgctcggaataagatggtttttctgttgtcatttttgcattttttacaagttttttttttctcctttgagatyataatgaacatggccacaccacaagtaaagtgagaagtaggacagagaacgctccgaaggctggtttggtcatccgagatcattaaaaatggccgaccctaacaatatgtacaaaaatataaaatgtaaataaaaaatacaagtttcctttttaaastacttttaagaaaaaaaaaaagcagggccttggaagttttggttctttttccctcccctgttgcaaattctcatggtttgggttgggtggtggagagcgcgtgtcatctgcgggtggcactgcccacggtgggcgggcgggcctctctactcgaaggtgaccacgtttagattctgagacgggaagtggagggygaataggtcacggcggccttttttttttagtttaacttttccttttttgcygtctggtcatcctcgtcggtcttctgcttctgggtatcgacatcgtyatcctcatcatcttcagctgcccgcttgcccgtagctgactcagctccctcatcttcatctccrtcctcttcctcaccatcaccttcttcctccccaccttcttcctcttcttcatctacctcgttgtcagcctccggctccccattttcctcattagcattccygtkagcaggggcgtctcttccattttccgcctcttccacaacttccttcttctcctttaagtcctcggtggtgatttcggagctggtgtctacggctgcgtctgacatggtggggcacgccggtgacgcgatgcaggggataaaaaagaaagcgasagttcagggactctggcgataaagctgccggagtccgcggcggcggaggcggctgcggcgagcaaggaggctgacgasgcacaatgcaaagacggcttttcagagcagccagtggggcaggacaatgtttttcatcaaatgtccttagatttggaggagggtaagagttgttttttttttctctctctctctcagagaaaagcatgcccccaaaagacattccacaactgcatactctggcaagtcacttaacatgaaatttttctctatatattacacttacctgatgcacagggcagcgtgttgaaagtttcctcctttgctattccttcaggctttatattgacaaaaaaaaaaaaaaaagtaaagcgatactgaatgtataaaagaaaaattaaacacttgaaagcaaaggagaaaatggtggtgaaaaattggattgtagatctatccacattcttgggaattaaatgtcactgtgagatgcatgttagataatactgtatgaaataataagggctctgagactcacagagagtagacttacgtacctcaactagtaaggccttgactacagtgtccttctgcgcaagtggygggacgtcagtcaactcatygtcacacacttcctgagaatgcatggcttcygcagtggctgtgaaattcacctttcctggggaataaagttcttaagagttaaacggtgattctatattgaacagtttcttcttttccagtttccccagtgtatccagtggttgtcttcctcttgattartattaaaggaggagaaaaagtgtgtattggggtcrgtgcagaaaacaaatcatccaagcacacgaagtggaatttgctaatagcattactactcacccagtgacttcggagtcacaacccaggacacggttttccgcccatttctacagacacagtgagattcttcattcttctctgttggaacagccaggaaagcggaagagacctccagctgcacaacgacctgtcccccacacccaaccacaagtttatgaagggatgcagaacagcatgaatactgcaaaagatgctctgtgcatcaggtaaatggacwgagggacaatgtccatgagtccagaggcgctgagaagctgtgcaaatatggtcagctctatcagacactttgtagtttaggtgtttgaaacaagaaaattgaaaaactgacaggaattaggataagtgtttaggatttagccttgtgccaacagaagaaagaggtgtttagtgaaaaacatgaaacaatcaggtggacataatgtctgaatttaggaatacacagatataggagcctgaatgaatataaccttaccaccttgggcctgtcaggtaccttttctcttagtaccaggtctgctccaaaattaggatatatcatatgcagttctgatttcctgggttacctaggagacctggtaatgaatggtgactatcttctattctcattcacttccagagaagtgtccttacccgaatgcaggtggacaagyagttaaacacagtggctttgagtgtgaaggcttctcctcgcaccacagaataaggaagggtgagttctaggaagaaaggctggaaggcttgaagagacacgataggagagaggccaaaccctgtggttccagacaagcagaatgcgctggccttccactctgtgatggtttcagggacctggtcaccagctcacttatacctaatgagctagtgaaggagcagagaagaggagtataagcaaatcttttttttttttttttttaacacaaagcatggctgatcctagaacatgataactcagtaacctagtgtggtaaatgctaaacttgatctaagggttggtgctcctggtgaggtttaaagttttttttctccctacctcccttactcccyccttccctccctccctttatttcttcctcttttctttcattctttccttccttttgttctttctttcaatctccctcccctccccttccctttcctttatttaagagggctggtagcatcctactttctaytatyttagttatcaatagactaaattagaaaaaaaattagcattgtttaattatgagataaatgaactataaacctaaatatttaccagaaaagagcagagcagaactaaaaggatcaggaatccaggataacatcagtcatacagcaggattcaaaccctctcctaaactaaattccaggcaacacacaacttactcaactaccaccaaatcccagatccaggtctcagggaagtacttccggactatctctttcacttgcaatatctgaggttcttcttcgatcattgggtacattatttctacrgctcctgggggtacacctcgcagacctggtcctggaagacaacacacaggcctcagtgtgaacctcatttttatcatcaatttcttattgctgccttatttctcaaatggaataaggtcatacgctcagggaatgtttattattggaacaatttaacctaccagcttgttattttgttcactttcctataaaaaggctaatcctattttttcttyaaatagaatctagagctaaatatatttttctttataaataaaaacaaatgacctgtacatgtacctcctgaatctaaaataaaagttgattaaaaaaaaacaaatgtagctctctctaagatgattactcaactggtgaagggaaggataaagagtaatttaatacaccaaatattgcttttacactgaaattgtgttcacatgtcttctgtttgcagygagaatcaaacaagaggaatggatattagctaagcaagatgatttygggaatgattttttgtttgtttgtttgtttcgacattgaattaatatggagacataaacaataagcaacaggattcagtaaagtatgtagtatagacaatrgggagtcaggartgaaaagacaatcaactttagttaggccggaaaagactttaccaaagcggaacctaagatgatcattcatggatgggaggtggaggagaatggggagttattcccaggaaaggactgtgcaaatatatatacaaaggtggaagggtgcttcacagggatagtaaaaatttaccctctagagtagaatggctattttcaggktgtgtttcccataattaggtaaacagaaggtataatatataataaaacataaggctaggacaaatgaataaggtctgttaagtgggagttagttagcttgataaaaaagaaattgatattccagaaatcagaagatatacatatatataagatatatataatctttacatattgttaacattatcttaaatatctttattataatattattctataatatatcttctgatctctggggcatcactttttaaagataattatatacgtgtgtaattataaatacatatatgatatatatataagataatagagttagatgtgctctttcaaaaccttaaatgcaataatcttatgaattctggaagtattgactatgtttgagaaacaagtgacatgagaaaagcagtgtttaagagtatgcaggacagatagaggtaaagaaaagctggaggcaaggaagttaaattagaatggtttttcagtaatctagttatgaaataatgacagacagattaaagtgctgtaactgaaaatgagaaggaagaaaaggataagcaacaaataccaaaagaaaaatttgcatagaatattacagaacatttggggtcaaagtgtaacgatgtactctgagttttcaggttttctgaatcatacctttgtttccattgatctgttttctcttaggttggaaagaaaatacacacttggtgaaatgaaagtcaattaatcatgcttttcagtttcttttttttaaacaaacatgccattaaaggaatcatgattttttttttttcattttatggtcacaatacctcartgagtttggtgttgtcattctgacttcagatttaaagaaattgagcctctaaaaggttaagtgagtctgcaaatttccaaagtcacatagtcatagcagataggagtgtgatgaaaaattgtccctttgttcttaacacagtgttcttttttcactatacaggattttttttttttctggtgaggaaatatccttaatgactcctttgttttcaattagaacattactccttgccttcccaggcagtgaatctgctgtattaaaatgtgtttattctttttttttttttttaacactttttactgccatcctcattttttattaaaaagtaaatttggtagacattcaagcatgcagagaaaaatttctctaggcctgatggcagtagaaaagaattttgagttaggccttttgcaacatttcctgatttccaggtatacttgaaacacacaaagagactatgcagaggtagcrtatctgccaaaagttgcrttactctcttttgctcaatattacataaatcccttctctttccataagaagatatgacagagacagttaatatccacatgagccttcccatttctcagcctcctttgcattcagggcaggaacatgggcggaagtgatgtataccattcccactcctggctttaagagtcwagtgcaacctccttccccatgggtatgaccttgaaagccacgttggcgatggcagagtcaccagaggaaagcagactggttctctctgactcactgtttggcacggggctgttctggagagtgtctgaactcacaagtagattttgtgtgagcaaaaaccaaaccrttaggtgcttacccgctgagatgtgggagtttgtttgttactgccattgaatctaattctgactaattcaggtattgactccatcatggacaaggaagatctaaaatggcaagactattaaaagcaaaaacaaaaaggtagttgattttgatgtcaaagagaaaataataattgcttaaaaatcctctatttgaggaaaaagtattatttggggctaacttaccaagaagttgctgcagtctcaagatccaatacttagaaaaacaggttttcatcttaaaccaacccaataaagcaccatttttcttctattctgtcagacaaataaatcacacctttacctcctattatgctgatacgcaatcctcgtggtagacacaaagttggcttatggatttttgagttggtaaaaatatctaatcctatggactgaaaaaarttgttaaagcatagcggcaatccaatcttgagactgtaagtagtttcttgaatttgtattgtactttcactattatgttacatatagttcatacgctcatcatgaaaattacacaaaatgaggagagctatttataaatatgaaaacagagtcatagamggtcaagttcattaagctattgagtgaataggagtgggaattcaaacccgtttctgattcttatttctaaatattgtctggtataatctaatgctccttaactcttttttgcatccataaaactgaatattttagacttagatgttttcttctcttctttttccccatgaaacaaatatctatgtctgtgtatgcatataaacagctctccttatggctttattacaaagagcatttttttgcttgtttcttgtcattttaaattgaaggtttgcatatcggaggttgttctttacaatcttagtaaactctgttttgtttatgttttaccagaagatatggcttttcctgaatatctatgcttaactcgttcctgtggtcctttcctcttttttctcagtttcttytagtcgtctcaaatgtctgcatctaaaacccacattcagatgcccacggttgtctacagtccacctgtttccagcttcccccttcttcaatgttagtcacagataaatattatttgctattttatctcagagtatttgggaaactgtgggactcttgaacacagttgtcagtgagggttgtgtacgcaacagaaagaaataaaccagaaataaatayttagagattaaacagctggttaataaaccaagaagtattcttttcatccttctaccatctgatttgtgattccagaasgtccagaagagagagatttaaattgctttcagctaagctgtagacctctagcagatgaacgacatattttcctgaaggtatgatgaaagtttttagtgctttttgatagtgataagatttaatttcacgacctggataattctgctcagttatagttaatactaaagaattacatttttaagacatcttaacatttctaatacaagttttgttaatcttttcttaatgaaagacaacttcaaattttcctggaattttactgccctgtgaggactgaagttttgcattttatgtattcaatcctgtattcattcaacaagtgttttctttgtttgtttgtttgttttgttttgttttgttgtttttctttgagacagagtctcgctctgtcacccaggctggagagcagtggcgcaatctcggctcactgcaagctccgcctccggggttcacgccattctcctgcctcagcctcccgagtagctgggactacaggcgccygccaccacacccggctaattttttttatatttttagtagagacggggtttcaccttgttagccagaatggtctcgatctcctgatctcgtgatccacccacctcagcctcccaaagtgctgggattacaggcgtgagccaccgcgccccgcctcattcaacaagtgtttatggtgcaaatgactgagatgatggcctccaacaaggtgctcacctttccaagagtgtcagacacattatggaaaatattttgttttggttttcttacatattggaatccccaagagtcactgagaggggaatacgatggtggtaagcagytttgggatccatttggttaaggtttgcagcctaaaagtaaaccactttctatttaaggtggtagagaagttcatgtgtgaacatctgtgtgtccacagagttatctgtctctgagatttcaatatttttctgttagttatcattttgttagagggaggggagaaaagatcctagagcttagaagtccattgtttctccatctaaacagacacgtagaaatcagtttttgttatgtttttggggaaaaaaaattaccgtgaagatactgtaaatgtcatccccctccaggacttgcttcggtgtggaagtgattccgctgtgagttgtgtcttttgcgttgttgcactcttcatcatattcatccgcaggacctccagctctaaaggtaaatggactctttactggtagcaagttatagacctgcaacatggagagaacaaaggaaatctctttctttttaacagattttaaaatgtgataatgtcccttaggaaatttaaaagattatggtgtttatttaacatgtgcwtgcttacattatgaaaagcaacacagagaatcatggagtaatatcaraggtcatggatcctaattcttttgttgtgcaaaagaaagtaatatatagagagatgaaatgaattgatcaaaatctcaaaattcattttggttgagtaaaaataaaaccgtctctatttcccacaaaaaaaaatgcctacttttaaaaraaagtaggaaatgtggacagcagaggcacataatgaaagaataaaagcctctcacagccccctcacctaaaataatccccataaatacttgattcatttcctttttccatttcatatgactaaggctgtaccaagttttctttttagtctactgtattaggaccaagtttagcttaagaaaaatctaggtgcagggacaactgagaaataattcaattccagtttggttttgcccagagccaagtttaaggccatgtgctcagggttcaggtggccttactatacagtgttcaggccattaaacacacctgcagaccttctaatgtggcttctgtcacttgtcatctgtgctactgtaataacttcgtaactgttcttgtgctttcattcttgctcccatactcttagcagcaaatatgatctttttaatagattcatctcaattgtccactcttctgtgtaaatttcctcattgatttaccattgcatttactatcaactccaaactccacaccaagtaaacagagctcgccatgatcttccgttttccatcctacctgcagcctctatcatcctcccctctcactgctacatattaggtgatgaccttttccttttcagtacactccaaattcattctgactcaaaacctttggcaygctgcttccattttttgtaagcttgctctggcctctccactattctccaatgtaaacatttcaaaattgctcaattatttcaaaaatttatcagcacctttatgcttgatatcaatactccgtttattcttttcatagtatttataaaaatctggaattattatatgtttatatgtttttgttgcttgcttgtttgtttgtatatctcacaagattataaatcaaaactagtaaaagaccaaatctggattgtccataattaataatcctggtctcaaaacaatgtccatcttatagtcaagatgcaataaatatttcttaaataaataagtgaaccatgaagccaataaaatatagggctgttctgaaattgcttcattgcaagagacatttttaaagacaacattgaatggaaattctcttttgtccacacttaaaaccagtgagtgagtgtctggattttaagaaaggcataaaatttttgcataatttcttgaaattatattagtggtgggttaggaagtggatttaaaagaaaagaaatgagaatggaattcctcctttaaaatgtattgtttttatcgtcaatttcttatagttgccttatttctcaagtggaataggttatatgctcagggaatgtttattattggaacaatttaacctaccagcttgttattttgttcactttcctgtagaaaggctaaccctatttttaatgtctcctggttgtgttttcttcattcataatattaaagtaataatacccatctcaaataattattattcatttactcactcattaaaaatgtgttgatcatctattgtacataagattctgtgctaggcaagatgatggagtcacgacctatcagtatgctgtcttcaagagatccacctcatgtgtaaagacacacataggctaaaaataaaggaatggtggaaaatttaccaagcaaataggaaacaaaaaaaagaataggtcataatcctagtttctaataaagcaaactttaaaccaacaaagatgaaaaaagacaaagaagggcattacataatggtaaagggttcaactcaacaagaagagctaactacctaaatatatatacaaccaatacaggagcacccagcttcataaagcaagttcttagakaattacaaagagacttaggcgcccacacaataatagtgggagactttaacactccactgacaatattaaacagatcatcaagacagaaaattaacaaagatattcaggacctgaactcagctctggatcaagtgggcctgatagatatctacagaactctctgtcaaaaaaaaaaaaaaacccaaaatatatattcttctcatcaccacattgcacttactctaaaattgatcacataattggaagtaaaacactcctcaacaaatgcaaaagaactgaaataataacaaagagtctctcagaccacagtgcaatcaaattagaactcaagattaaaaactcactcaaaaccacacaatgacatgcaaatggaataacctgctcctgaatgactcctgggtaaataatgaaattaaggtagaaatcaagaagctctttgaaactaataagaacaaacagacaacataacagaatctctgggatgcagctgaagcagtgtgaagagggaaatttgtaacactaaacacccgcatcaaaaagctagaaagatctcaaatcagcaaactaatatcacaagtaaaggaacaagagaaccaagagcaaacaaaccccaaagctagcagaagccaagaaataaccaaaatcagagaagaactgaaggaggtggagacacaaaaacccttcaaaaaataaatgaatccaccattgaccccacagaaatgcaaacaaccattagagaatactataaactcctctatgcacataaactagaaaatcaagaagaaatggataagttcctggactcatacaccctcccaagactgaaccaggaagaagttgagtctctgaatagaccaatamtgatttcagaaactgaggcattaataaatagcctaccaaccaaaattccaggactagacaaatttacagatgaatgttaccagaggtacaaagaagagctgataccacttctaatgaaactattctaaaagattgaaaaggaggggctcctccctaactcrttttataaggccagcatcatcctgataccaaaacctggcaaagatacaacaaaaaaagaaaacttcaggccaacatccgtgatgaacatygaagcaaaaatcytccataaaatgctggcaaaccaaatccagcagcacatcaaaaaacttatccaccacaattatgttggcttcatccctgagatgcaaggttggttcaatgtaygcaaatcaagaaatgcaattcatcacataaacagagctaaagacaaacccacatgattatctcaatagactcagaaaaagcctagaataaaattcaacatcccgttgtgttaaaactctcaatgaactaggtattgaaggaacacacctcaaaataataagagccctttatgacaaacccacagccaatatcatactgaatgggcaaaagctggaagcattcccctggaaaacctgcacaagaccaggatgccctctctcaccactcttattcaacacagaattggaagttctgagtagggcaatcaggcaaacaaaataaataaagggtattcaaataggaagagaggaagtcatattatctttgttgacagatgacatgatcctatatctrgaaaaccccatcatctcagcccaaaagcttcttaagttgataagcaactttagcaaagtctcaggatacaaattcaaggtgcaaaaatcactagcattcctatacaccaacaacagacaagcagagccaaatcatgaaagaactcccattcacaattgctacaaagagaataaaatacctgagaatacagctaacaagggaagtgaagaacttcttcaaggaaaactgcaaaccactgttcaagaattcatgaaggacacaaacaaatggaaaaacatctcatgctcacgaataggaagaatcaatattgtgaaactggccatattgcccaaagaaatttatagattcaatgctattcccattaaactaccattgacagctttcacagaattagaaaaaactattttaaaaatcatgtggaaccaaaagagagcccaaatagctaagacaatcctaagcaaaaagaacatagctggagacatcatgctacctgacttcaaactttactacaaggctacagtaaccagaacagcatggtactggcgcaagaacagacacgtagaccaatgcaacagaatagagaactcagaaataacactacacatctacaaccatctcatcttcaacaaacctgacaaaaacaagcaacggggaaaggattccctatttaataaatgattctgggagtgctggctagccatatgcagaaaattgaaacttggacccctttcttacaccttatacaaaaattaactcaagatggattaaagatgtaaatgtaaaacttgaaactataaaaaccctagaagaaaatctaggcaataccatttagggcataggcatgggcaaagattttgtgacaaaatctccaaaagcaattgcaacaacaacaaaaaattgacacttgggacttcattaaactaaagggcttctgcacagagtatcagagtgaatagtcaacctacagaatgagagaaaatatttgcaatctattcatttgacaaagatcaaacatccagtgtctacaaggaacttaaacaaatttacaagaacaaaacaaacaacccccttaaaaagtgggcaaaggacatgagcagacacttctcaaaagaagatattcattcagccaacaaactgatgaaaaaaagctcaattttactgatcattagagaaatgcaaatcaaaaccacaatgagataccatctcacaccagtcagaatggtggttattaaaaaggcaagaaacaacagatgctggcgaggttggggagaaaaagcacacttttacaaagttggtgggagtgcaaattagttcaaccattgtggaaaacagtgtggcgattcctcaaagatctagaagcagaaataccatttgatccagcaatctcattactgggtatatacccaaaggaatagaaatcattctattataaatgttcattgcagcactattcacaatagcaaggacatggaatcaacctaaatgcccatcagtgatagactggataaagaaaatgaggtacatatacaccatggaatactatgcagccataaaaaatgagatcatgttctttgcagggacatggatggagctggcagccattatcctcagcaaactaacgctggaacggaaaatcaaacactgaatgttctcacttataagtgggagctgaatgctraaaacacatgaacacatggtggggaacaacacacactggggcctgttggggtgggggcagggggagagagagcatcaggaagaatagctaaaggatgctgggcttaatacctaggtgatgggttgatctgtgcagyaaaccaccatggcaaatgtttacctatgtaacaaacctgtacatctggcacatgtaccccagaacttaaaataaaagttaaaaaaaaaaaaagattctgtgccaggcatggcacagattgtcttggtaagcaagattgctcccttaaggagaatataacagagaatacaatgagwtaaaatatgtaaagtactttatgcagtttctgcttgttgtggaattayactatgcctgttactctgaagaacttgttttttgcaaacatttttggaacttttaacytccaaaaatgatcttatcacgtgagcatttcatgatctccaaggttggaacgkgastcayagatttaggtgasagctcagcttcaggcttcattagcagcacactctggtctacagcacggagggcacaaagggagaggggggtggctstcaccttcaggygggtgtttgaggctggcaggctctgagctgaggagaatctcaaatttacctgtaaagaggatatgattaaagcagccattttataattattacagtaaccrgcccttcttctactccaggctaagagtagccttttctatacttcctttctctttattcatcttacagcaggattaagagatgaacagcctaggaactaccaattcagtgtctctggaacaacctggaaatttgattccagttaactcaggttttccattccttatataaatgrtgaaatataaattgacttaatcatatagaaataaaatgctgcatagaattgaaaacacacgtacaagaaagatgcataccttgctatcactgacctatctctgtgcagtgtttatgtgaagactgtgtgcagtttgcacggtgatgtgaaaatcacattccacccctgagaccagccaacagaagtctcctccagttggcagtctcagtcacctgaaattctaaagcagtgtggaactgttcatcatgattggagatttactggtccatttaaaaaaaataaatatctaatatacagcctaagagttcattggttcagacaatttaaaaaatggtgaataaagaacaacaggaaattgtgcagaatcttcccaaagatttgmttctactttggccaaaaaaattaattggcaagataatctattagttccttctgttgataccgacatttcttgagtagtatctgagttatatagtagtagcatcaggtaacttccttgattcttggactgaaaactgatttttattggaatgaaatatcagtatgtttagctaaataacatctgacttaggttgctaaatttcactatgacaatccagctttatggtctactgaatttaatatagcagtttggaatcacttatcataagacatatatgaaaaaaatcaataattatttatcttcaagatgcaatagtattcatctytctaactcaatatactatgaaaacattgcttatggagaatctctttaaaatatatttgcttttatttttagaaaatttaagttcattaaaatatgttagttactgtccatgtcaaaagaacaggtaatttgggattataataaactaaaaacactattagcaagaagtggacatgttagaaaatagaaaatgttttactgatatgaaaaccaaaacataactttaaggcatatttcaaaggagtctgtacctcatatattatattaattactaccaatgttattcttaatgaataattatatctggttgagtataacaaatgattccaactattacataatttttaatgtgtatgccaaatctgttgtaagtgaagaaataagtatatgaagtttgaatagaaaactatttttctctgtctcagcaaagattgaaaaaaatttaaatgtatcgttttgcagggatgcatgtctgacttggggtctttcctcacatcctcagtgcactatttatttgctcatcatcccaccaagatgtctaacttttagggtgcttaatttgtaattttaatagatctactgtttttctaatttttgtggtagtcaactttcttctgaatcttcttatgaatctttgttcatattattttttacagctgatcttcaattctgatcaatgatgattttaaaggtatttaacgtgaagtgattgaatataatgtccgtgggcttttacttctatggtgaagttttatactgttgcacagggactgtcatatgttttgcaaaatcagaattgtttttcagactggattccagggagaaaattacttttctgccaattctgttttataatgcttctctcatttctagggtgtgaagaggatactgacccaccagaaagagaccccactgctagaacgaataagatgtgctgaaagccggagcataacttggccattcccaagatttaacaacaaactaactacccatcattaacagtaaaggtattgaagcatgaaggagtctcttctcagtgggtatgaaacacacagaagtccaaacagaacagacactaagcttcttggacacaccatccaggtttaatagcactctttagtaaggtggaattaaaggtttacatcagaatacactgtgtatttttcttatttcactgtatatttaaaacaagacaacctaaatatagatctcagggcagaaatgttcacttgctataaacacattttgttttaatctccacaaagcccatgttaaaaaaaaaatccttccaggtgtatttgaaaacaggcatctgaagtaggcggctcttatctgatcgctaatgttatgattatgctgctagagtagtgaaaatcagataaacagcaccaagttctgttggaataaagcatacttatatctcagtgagcttcacatggcagytttgtattccttaaataaaaaatatgccatctgaacctatgttaaatttttgtgctatcattatttttaaagtgtccaggctgtttctcatctgttctgtattattaagctgagtttaaactcatgacaacctactgctrtctgtagtggtacatggaagtgtgccagtgtatgatggggtaaaattggcacagccttgtgaggcatcatttttaatcaaaatattagtaacaaaacattttaaaattaaaactattaaaggcttataggtgacttgattttgaaattcatatgaattttataacaaaacaagagacttttaaaaaactgtgtttgtggttgcctgttttggawgtcagcactagacctctcagtatgacatcaccccctgcctttagaagtagytgggaggaatgttttaggagcactgtatgcctaatttcctaatttccttcttttccacacatcacaatgggagaagaataaaaggactagtcttaaacaaaacaacccaccttgttggcaaaacagttttcaatctcaagcttgtcagtgtctgcaacaatttctccattaggtaaaacagtgtaaayaagcagatgagcactaggagcagagtctgattccactcgaaaggagaaggaaaacacccctttcactggagaatttaaaaagaagaacaagttcagaataacacattagcaacagaattatcaatttgattttttaaaaaggcatttccaactatagactttatttacatttggatcacactgaagtaagaaaagactttataccactgtgcaggtagtagtgttcaataaatatatgctgagctaatgacattttcccttaaagatataggtttaattgttcatttcctctgtttaagtaggaaaaagacatttaatgcttgtctctatttctaaattgaaaaatattattgagaaaggagtcaagagagaagaaagagaacttctagacatgtttggttataattcttgtgtgtgtaagggcaatataaacaatgcaacagtcttttccttcaggccatttataatacagcagggatacagatacaaatcacataaaaagccttgtgagcctttgatttttataatagaattctgtgtgttcatctcagtggttgtcctctgtgtgaactacatagagcttatgtaacattccacttgattattttcataaatgttctaagtttgatctttgtagcataaaattattctttaaaaattgtacccttcctgtatctataaaagatttgagggcagctttcatgaaaatacagagaaacagcagagtcaaaataatttgaaacagtaagacgaaagccaaatgaatgtggaattctgaagcagggttaaacataggagttaattttattaggaagctgcaatraaatggttattacactagagtacttaagtttttcactgagtttccgaaatgtcaaagacaaagtcaaaacaatcatttacatagctgtcattaaataaaatgaagtatattttttcttaaagagagggacacttcttcttcccatcccaccaccttaggacccaatccatacaggatttaaactctactgcagaaacaaactttgaagatactgctttgtgaggcagtgactttttcatatgttattagagacaaccttacctgctctaaaaaaatcaatacaatgtccaataacataaaatcagggattaaatggaaatttagagtcratgtttcatatttgaatgaacgtattcaaattttgtgctttatttcaagcagaaagaaaacaatcagtaagagattatatagacctaagagatgttacagaccgaagaagaacctatggtgagtggcgttttagagtgtgggtactgcatccttatcatgaccttagaagcctctttctggctcaaaaagactgggagaaagtctatgaaaaaaaggttttcatctagaagtagagttacaggaaatttattaagaggctaatctggaactcaaaaaattacaaacaaacattaatattttgaaatcaaacttaaattcgtgattaattaaaaaggtatcttaggctgggcgcggtggctcacgcctgtaatcccagcactttgggaggccgaggcgggtggatcaygaggtcaggagatcgagaccatcttggctaacacggtgaaacgctgtctctactaaaaatacaaaaaaaattaatccggcgtgttggcgggcgcctgtagtcccagctactcgggaggctgagacaggagaatggcatgaacccgggaggcagagcttgcagtgagctgagatcacaccactgcactccagcctgggtgacagagtgagactccatctcgaaaaaaaaaaaaaagttttttaatcaaactttacatgattatttaaaggaaaagttgtaaatagttgagttagatgactaattaaaaatcaatttttatttgaaaatttatttgagctctgttaataaaagttccttcagtcaatgatagctcataaatattcaattttgtttcaaaatttgaaacaaacaaacaaaaagaagtctattttttccttatgagattcaacttggggacaagaggtaacaagtaaataggccagctgtacttatcttttgtaaaaaaaatatatttttacttatctttttatgatatgttaaacattcttcctaggataacagaaattaacagatatttatgcaccgggcacggtggctcatgcctgtaatcccagcactttgggaggccgaggcgggcggatcacgaagtcaggagatggagaccatcctggctgacacggtgaaaccccatctctactaacaatacaaaaaattagctgggcgtggtggcgggtgcctgtggtcccagggacttgggaggcagagggaggagaatggcgtggacccgggaggcggagcttgcagtgagccgagatcgcgccactgcactccagcctgggtgacagagcaagactccgtctcaaaatacataaataaataaataaataaataaataaataaataaagatatttatgattcaaagaaataaagaagaaaagtgtgatctaagatagagaaactctattaacccagttgacctcaatgacgttcagagaacactccacttaayagcagcagaatacacattctaacatttatcaagatagaccatattttctgagctataaaatgtctcyataaatttaaaagrattaaagtcatacaatcataatgtcattaaattagaaatcagtaacagaaagatctctaaaatatctcccatttagaaactaaataacacacttctgaataactcatggttcaaagaagaaatcaaaaaagaaagtagaaaatatyttgaactgattcaaaatgaaagtttcacatgtaaatattaaacgatgcaactaaagcattattaacaggaaaatgtgtaacaataaacacttgtattagtaaagaagaaaggtctcaatcaatgaccccaacatcctcatgaagaaagtataaaaagaagactaaattaaaatcaatctttaattgataaagatcagtggataccaatgacataaaaataaaawaaaaaacaagaaaaatcaattaaaccaaaaaccagttgtttgaaatgatcagtacaattgagaaacttctagccaaactgatcaaaagaagacataaattataagtatcttgaatgaaagagcttctatcactatagaaattacagatattttaaaacaatattatggactattttatgtcaataaattagacagtttagaaaaatagacaagattttaaatgacatacacaaccaaaaaattaactaaagtagtagcaaayttaccttgcacttcattaaagaaaataaatttgtatttaaaatcttctcacaaagaaaattctatgtccagatcactggtaaattcaacaaaatatttaagaaaaagaaataccaaatattaatgaattcagatatttagggaggagcttttacagaaaagtgttaaagcttttatagaaaagtgcttccttcttcctgcttataacaaaactggagaggagaaaaataaattgaatgaggaagtagtcatcaaaaatgaactaggacttgataattcggaaatttctcagcttatctaaattgcaaaaatcggtaaaattaagacattcgctgtcaggaaattgtgctctagaaaaaaagctatgatgtgactggacaactttttgctaaagacttgatttgcagaaaaattaaaatgtcagagtaatttagccacaaaaaaagggctcttcgaaaakattaagtgcatgactcttagatacccttacccatcacaacaaaagccaaaattggagatagaattatccatcaaatgtcaatgaaaaggctttttgtttaacggaatgaatctctgtgacacacaggagacctacatggttcttgaaaagtttatactaatagaaacattgtcagcttcaactaaaagggacagagagagtatagaataaaagaagaatatcagacctctcaaatcatgcaagcaggaaacgagatctgataaaacaattcagctgcaaacacatccttcatgaaaaagggcaaatgatttcatgagtggatccttgagcccagacaatagagaaatgaattaaagaggattattcccaggtgttaaaactatgctgttttcctagccagatatcagcacttcttgggactaaagactctttttgccctaggatggattatgtccaggacctcawtaacacctaatttagatgactgagatgatgagatttggaacttttgagctaatgagactgtgagcttttaatcttatgttaatgttatgatggatagagtgaatgcactttgcatgagggatgaatatgaatctctggggccaatgggaagattgtggtaaatagaataatggcccctgaagatactcaatttccaaaacttctgcatatgttactttatatggcaaaagggcctttgcagaaatgattaaattaaggatcttgaggtgtgaagtttattctggattatccaagtgggcccaatgtaatcacaagggtctttctaggaggaagacaggaagatgagagagatttgaagatggtatgtggctgaatttgaagatagagaaaggaaccgcaagcaaagaatgcaagaggtctctagaagctggaaaaggcaaggaaagagtctcccctcaagctccagcaggaatgcagtcctgacaccttgagtttagcctagtgagacttctgacctccagaactagaagatacaagtggtgttttaaggcactaaaaygaagaactagaagtrttgttttaagcccataaatttgtgataatctgttacagtagtaataggcaatgcatacacaagcacacaaagtaaaatttttctgtggttattttccatattttttcagttattttctgccttttgaagacattaaagacataaaatgartatgtattagtttaggaataaaatttaaaatgtaggaatgctataaaagaagaaaaaattttaactgggctaaagcraacccagtatgtcatcctattacatcagcttcttcatctttggatgaagaggttggtgactgtttcttctaatgtgagaatagctccaaaytgctaaattgttcagaatttgacaagatgaaagaggaaagaaaaaggaaatcttgaaaacatttactgtttccttgtycaatggataacacrtggattcctgattgggagatttttcctcttgctttgatctgaaggcagaaggaaatatattcattattgtttaaaagaatacattttaacctaactttaaaacattcatgatatatktgtgaaccataatcttattaccccaacctagaagttattttgatcactaaacttccttttcaatatcttcatatatgtgtctttacatactttaaataaaaaatatataattgtataacgttttattattttatttaatatttatcacttctaataaatatatgtaaatatgtaaacagaatttatgtattttttcaacaaacatttcaaacatctaccttatgcaaagcaatatatagtgaaggcagatataaagtataaataagtattctctaatattgcctctattttaaaaaaactaaatgtattgagcattctctatatgccaggaactgaactaagtaatttactgttaatttacactataattycatgaagtaggtattaatattatctccaggactaaagtgagatgattgacatttctctttccagatgaaattaggtaagttatccaaggtcatgtatctaggaagcaataaatctaggaaattcaaatttattgttaatttttctatttttttatggaattaagaaaatgttatttatagttaatgctcttatacagaattccctatatttaactttttcttcttaaaatgacttatttgagtaactatgagccttggacattttcaatttgggggcattcgtgggaatattggcctcaaaagtatcactccaatttatagtctgcctgttaatataccttttccttgcaatcacaccagtcatgagctttgtaaaataattagaattgaatatttttccagaagattgtttataagttttatttccttttgaatgagttcatggttcttagcttttgcttctttatctactgagttctaagaaaacattttctctttgactaaaaacattttatcctaggctctttcctctcctgctcaataagttgccattggaactctgcaaggaaaaattctaaaagtttcagtggtgaatagagcataaatgagaaattaaagcattaatatttgttaggaagtaacttctcttctagcacaaaaacaatacaaaatatattattgttatcttataaatggcattacttagacaggaacccagcaattttggagtctacacaatcagaaggagctacagtgggtcttattcttaccaaatagtagaaggttaattctttttcatccctgagaatctgtttattcagratgtagtgtgcttgaatctcctgggtttgtccacaggtcaaagtaccaataataggtttgaggtgaatataactcttgcttggggaaaaaaaatgctttgcagtatgagatgtttgcgtatgaaattcatcaagccaccagttatcagaacaattgttactctctttgtatttgacctaatggaagaataaataagctgttttatatataatatatatatrattgcaaaaatatataaaaatatgcatattatatatgtttgtatatatatacataaagcaatataataaagccatataagaaggctgctttcttaaatatagcagaatctgtaaactgmttcccctcgagatcatttaagcttatgctgtactgatttagtagatgttattcattcacaaacaaggtcaattactttctcttaacacgctatggctgcaaattgcataagaacatttgaatattcaacacaaaacaaaatagtagtatgccaaagaaaccaagcaagatcttacttgtattagaatcataaaaatattcaatttttcaaaggaatatcaagatgatctattcaatgtctcttgaacctaaatcatattgtcaacagagtttacctacaagtaaaagatttctggcagacttttctctttttataatttaggtctccatattgcttaatttacattttactcttttattttattttattttattttttgagatggagtcttgctctgtctcccaggctggagtgcagtggcgcgatctcggctcactgcaagctccacctcccgggttcacgccattctcctacctcagcctctggagtagctgggactacaggcgcccgccaccacgcccggctaatttttttgtatttttagtagagacgggtttcaccgcattagccaggatggtctccatctcctgacctcgtgatccacccacctcggcctcccaaagtgcttggattacaggcatgagccactgcgcccggcctacattttactctttatcactttttttttaattcctagagttcacatgcctctcaaatatctttaaattatctctggccacagtaatttctctatttttggtcccagatgcccctttccacttactgaaaytgtgagaaaaggtgatatgtagttggtggtgtccatggaaatgttcaccaaaccatgctcatcagtagttgcactgaaatagtatctagtattcacatgaacatctacagttttgttggtgattggctgatggttttcattgactagaagaacctagagatataaaagtcatagctggttaaattgtcatatggcaataacatcttccactccgtcacatttaccgccaggtcactccctgtcatttactgaagatcttagaatctgaaaacgagacttgttttctgagctctaaactatgatttttctttttaatacttctttttaaaaattattttgaaagctaaatggcagtttattttccattattattctaaattcacaaatcataattatatacatttcctgggtacaatgtgatgttttgatatatgtatacaacgtggaatgattaaatatactaacatatatatcacgtcacttaccactttttcagatgagacatttataatttattattttgaaatgtacaatatattattactgactataattatcctgttatgcaatacatctcaaaatcttgaatagttctatttggatatctcatggggmctcaaattgagaacatccaaaagtgggatcatcacactaccttcccaaactttctccacttccactgttctctctttcagtatatgggtcttccatctatcagrtaactgacgcaggaatactgaggaattgggttttttttaatgagtcattttctttcactgcttatctcaaactcattgtcaagtgctatctcctctccccatctcccatcaaatatatattgattctatctgcttctctccaaatctgctgctaccattctagttaaaatcacattttttcccatctggtttccagtagctatttaatcttctgcatttccttgctgcttcattcttgtctaaaccattctatacakcctgagctaacctgatcatgttactctctttcttaaaaccattagtcacttctcaatccaaaattcttaccatatcttaaaagaccttaataactgttcttgcttgcctgcaattattcagtgaattcggtcatgtctttaaccttagctgtcatcacactggctgctttttagttctttgctcttgaaaaactgtttcatacccagagccttagacattctcccttttatcttacatttctgaccatgtcatactcacctttcaagtcatcagtttttctcatgatcttctctctacctgaaatggccatatgaaactatatctatatagttattaatttcttgataatttaatatgaaatactaggataaatgaagaaaatgtaaaattcaagtataaaatatcaaatataaaattcaaaatacagcttgaagcatttgcccatgaactgttaattcaaagattatttactacaaaatataatttaaaatacctagaaatcttgcatctcttatatgaaagaaaatggatagtttactaaattattggctctaaaatgtatcaatattggtatctatatgaaactttgaaatggaaaacaactttaaaaactaccagtaataaaaaattcaatcatctagatgaaagaatgtgtttgaattcttcctataaaaattatgttacaaaatcattgtttataaagagacaatcaaagagtatgcagctgaactacacaaatgtattacagaggtgtgttaggaagttaataaaacatgctttgtttttctggattttgtgattatatttgctttttaaattataatctgctgtacttttttcctatttgaaatattatttttttaaataaattttgattttgtgatttaaaacttcattttcttaaaaacctcatgccccaaattgtgattatgttaaaaacattttttttacctgtccataccaggggagtccacttctgtaatgtgaatctactttagtaaatctcagtatccttaaggtatctgtgatttcatatgatccatgcccagttaattccaatcctgaaaaataaatgaagttgaaccattctatgtattaaaaactcacctcctacttcctcctcagcctcacttcatcataacaaaataccatccacattctcttttctttattcttgccagtttcccacatttacaagctatttgaccagcaactggacattagcttcaccttcacatgaaacattattggtatccatcrtccctcattcctctggttttccacctatgttctttattttctcaactcctctgtgatcttgctccatctttgtttttccctctctcacatccctgctctccctccacaactttctgtacatggttggattcttcacaatcacactggcccaaaatatgcttgaatttctaatacaaactttatttccagaaagacctgtcgtttccctgcgtgagctatccaaaggatagtgaacacctggtgcttttccattcaatgatgtgtacyctgtatcttgttcttatcaaaaacacagtgctatcaaattcttaaaagattccctacttgccctccatatcgaattctcatctcagacttcattgtacatgaactctcggtagtactccacactaagtaccactgaaactcttccttccaggggcttctaaaaaattatcctcgttgtttttgccccagctctctggcttcttatttaattatgctgatttatttgttactgtctatctcctaaatgcagttgtttctgtccttggacgcctctttgtcctgtctctatcctaaatttagcagtgctaaatgagctcactttcagagcatttgcactcactatttttttttttttttttttgggacggagtctcactctgtcgcccaggctggagtgcagtggcgcgatctccgctcactgcaagctccgcctcccgggttcacgccattctcctgcctcagcctcccgagtagctgggactacaagcgcccgccaacacgcccggctaattttgttgtatttttagtagagacggggtttcaccgtgttttgccaggatggtctcgatctcctgacctcgtgatccgtccgccttggcctcccaaagtgctgggattacaggcgtgagccaccgcgcccggccgcactcactcttaagaggacatagacacaacgagaatggatttagatttacatttctggtcctaatttaactctggctctgttttaaaattatcagctaaatacatccacttccgttttgatattccaagctgtagttatctttaacattggcctggcgcggtggctcacacctgtaatcccagcactttggaaggccaaggcgggcggatcacttgaggtcgggagtttgagaccagcctgaccaacatggagaaaccctgtctctactaaaagtacaaaattagccgggcgtggtggcgcatgcctgtaatcccagctactcaggaggctgaggcaggagaatcacttgaacctgggaggtggaggttgcagtgagccgacatcgagttattacactctagcctgggcaaggagcgaaactccatctcaaaaaaaaaaaattatttttaacacatctcatcataacagttctttttcattgactcattatcttggttaatggtatttccatttcccaggccccaaatttggaatctttggggtcacctttgactaatcgtctgacgtaccacatggtagcacattttttcatctagcctatcctcttcaggtctgctagacttaccttttaagaatatcaatttatttagacgattcttctcaaatatattgaaagatatccaagcttttcagaataaatttaaactctttagtgtatgatttacttttctccacagcttagcaccagcctccattttcagattcttctgagatcatagtttttgatgcttatcacgttttccctttccatcattaatctttcaaagtattacctaccctatataaatcagttgaaatgctattttagcaataaggttttctttgggctctagaaggtatactagaattaattacctctcttcatactcacttggcccttttttgtatttcttgcagaaattttattatggctatgtgcacacacacacttaatttctatttttaggtgcctaattccttgagggcagggaccgtgttattttcataatctccagaaactataaagtgttttacatggaatggaagtttgataaatatgtatcacattaataaatatttaaaaataatacaaaccggttccctcctctttgaccttcgctttgacatgtatcgtcatgtcatactctttttgtctcagctgaaatattttagtgtttacaagttgtgtgaaacatccttcagtgtctgcctgaagagaaagaaagagaattctcaggtcttccaatttgctacttaaaaagtcagctgtcaatttatgagaatttttttactggccataaaaataaatgtaacaaatgttctgaccatycttttggtgcttatcttttcccaagcccaagaatgacataaagtttcttcgttcatcattgatttattcattatcaacctttggcttctcccctctcttctgaaaactgattccatttctgccatattcaactttctagagtttccaaacgtgccatggtatttcataattctatctctatgcatgtgttgttcctcaaatgataattctctttttcccattcttaccgtagccaacagttaggctcctcaaaacttaactcagacataacatattctgagaaggctttcattcctataaatattgactaaggattgctatgttttgttttgttttttttctttttttgagtcagagtctcactctgtcacccaggctagagtgcagtggccatgatcatggctcactgcagcctcaacctcctgggctcaagtgatcctcctacctcagcctcccgagtggttgggacgacaggtatgtgccaccacacctggctgatattttattttttataggggcaggggtctcactatattgcacaggttggtctcaaactcctgggctcaagcgattttctcacctcagcctctcaaagtgctgggattacaggtgtaagccactgcacccagccaggattgttatgttcttaactgtatattctcaatatctaggatattaataggaatatatacatttattaaatagatgaatcctcaccataaccaagttttcaaactaaatgttggggtacatgttttaataaagatttgttttcattttaaatttatttataagaaaatctttattgcataataaatttaatcatattaatttatttttatatagatgtatgtcatgactcacttgaaaacagaagttaatactagtctccctgatacattacagatttgggcagctagattcctcttatagtatcttgcttgtcagtgtctgccttggtgttcattattatattcgttactctggcctctcattcatttgctctctgcagctttgataactttcttttccatacccttgaggtaagaggtgggactcaactttggaagcaggtctcagacaccggrccaaattgagaacttactaaaacagggatgcagggtggctgctttccattagacgtgcctaccagtgtgccatgtcagtttaccattgcygtggcgacacccgaagttaatgcctctttycatggcaatggcctgacaacccagaagttaccactttttcctggaaatttctgcataatctgcctcttaatttccatgtaactaaaatgggtgtaaatatgactgcagtactccctttgagctgctactrtgggcacactgcttatggggtagccctgctctgcaaggaacagtacctctgctgctgctgtacgctgctgcttcaataaacgttgctgtctctaacacctctggcttgcccttgaattctttcctgggtgaagaaaagaaccctcttgggctaaaaccccatttsggagcttacctgccctgcgtcacccttacagggtctgctcatactgccacaccctggactttttacatactctgcctctggaatcagtaatttttgccttttattttttaatacatcacattctactttcagctgttccccttaattattcttattccacttcttccttgacgtgttttgggcatctaatccattgtccttggaagycttccttccttcagccttatacyggtttaacattcctccagcgcagtttactttccacgacattccatttgattctcccactagccaaattcttaacacctgccacacacatttttctgttttctgtttgataaaagacaactctggatccttccacatccttttatgcccttatatctggcatttggattgccgttggaaggacattaccaaactaaccagataaataccactagatacccacgagcccaaccctcaagtgagcccccaacactgccagaccatcttacaattttcccccactccaccattttgcttgatgggtatttcaaacactattctctgttgtattgtattcactattgtaatccatgagaagagaaaaccttggtattagtgtcctgagsagagtggtttccacatamctgttgattgaattcttcacagatactttgtgaatgtgtgttgtggcagtcggaacggcatagtgaatatcttctgcatacactaagtgtcaccagaccagggacaggctctccatatgtgtacctataacaataaggtggccatgcgaaaagctacttaatggaaataatactgatgtttcttcaactgacttgatcctttcatacatccaccttaagctgttgtattaccttccatattatttccattttataaacccttcttctgaaagrccgtgtcttaattgtccataactctcagaaaaagtactggaagaatctttttgaaacagctccaaatggaaaattaccaatttagtttttctcagatctttcttccctcttagttgcggttttactataagatggtcctatttccctctttctctgctgtcagattatctaggtcatgattccagctttgacaacacctcctacattgtcttagggcaacatattaagactatgtagagagtgtatttctgagttctccttgatttataggtactttaagaaaataaatgtgaagttagatggaaaagtagtagctataaaacaaaaatgttgtatcatgactcagtttgaytctgcctaatatgatagaaggaaatgacacaaagccataactaatttgttgtctctcaaaacgtgttttgtggaccaccagcattgaaacgatctgggatacatgttgacatgcagatttctgagactttcctcagatgtatgattggaatctttggacatggggccagagaatctgcatttgaagtaagcacactccccaccccatagattctgttgaacactgacgtttgaaacctattgctttagcccaaatgatggggcagataaggtgtagggtcagttccccaagcttctcctttttataggattacttacagaataaaaatattagtacacacaagccaattagaacattgtctggcccattttaaatgtccagtaaatgattttatgattagcagatgtgtgtcatctgctactgtacctgctccctactgtgagcttaggcaagctacaaagagaggtattcctctcctaattaaaayacttccaacttcagtaactgttatttacaatacctcccctcagatagagtacagaaatagaaatgagatgaaaaaaatgcaactcacaaggcacaggttgttatcacaaattcttcatctagaaaaccaataaccttgggcatttttacttggacctcaaatttaggcaaaactgttttgataaaaaagaaaaaaaaaggtgagagtgggccagagatcttacaagtattrgtagtagatgctatgacagaacctttaacatgtggtcacatgaaatgacttcagctacaacagggagcccagggacaatactgagaaggagaagccattcattaccatgagcagtttgtactatgttcacttggttaacttgataatacattccctagactctctttctctgaatttgtgccagatttcccagatagagggaaggcagcatgattagtccctgaagatcatcacagttagatgtggtaaagagggaccaataggtttcaatgtattcttattctttccctccctaggcccagctyttcttcccaaatgccagccctgctgactaacagaggtctgaggcccatcatctgacacctggctataagcctactaaagtggtagctatgcagagtgcagaggtaataatcttccacagattcttctgtcagctcctctgcatggttggtgcacttgggcagctgagggtccctcgcttcccagacctttgcaagctcacatttatacacccctaatcatgcttcagaactggctagtaattttctctcacctgtcaactcctcctgatggcctcttacttttctagcttctctcacagttttgtaaggtgttattcctacaatataatactattctgtgattttgatggcagttctgacgagttttgggaaccatgttttgtgataggacttctcagccatggcataaaatatttaatttacattacaaaatccacataactgataactaataagatggcttcaatgtctgacttagtaatcaactatggttgagtactgactagatcaattgtgttaaagtttagttgactaccatacttagttgaactatagtttagttgattactaaattatatggtttaggaatcatagttgattagagtagtataggtgtaggttatagacaaccataaaataatccctggaaatactttcagttataaaatataaaaaacatacatagtgtatgtagctgacacaatgtattggwtaacaatttatgtttgagtatcaattcaaatctttcctaccccttaatgactctgtgatttttttaagttactaacttttccagtactgatatgctcatttgcaaaatgggaataataatagtatctgtcccagaggggcattgtgagaattaaatgaggtagtacataaaaagcacttagcaaatatatgggtaaatttaaaagcttgctaattttcaactattgtatgctagacctttgattcttacctatatgtaaaaattatctaatcttaaatactctgacgttataaatgccttacacatagagcattcttaccatattcattcatctcaaatgagtgctgtattttcttccctgactctctctgcagcatgatcttgtgggaacccagaatgggctccactgatagcgggaaagagagttggttgagtcccccttgcaatttgagactttgcctttggaaaatttggttcttcctggggtcctataggtaaaaatattatgagttcatagaaacaattgaaatatatacctttgagtagaagggcagctttgcgggtaagaacgacayaggcagctgtatcacagatggttggtaaattggcccaaaggtattagcaaagttttataggaattccaacctgagataagggcaataagtttactagctatgagatattacagataacatttygtactgatgcctctttttggtattatgtatatttattttggtcagaaatattggatgagtcactaaattgcatcatctcaagaaatgttcctgcatttacatgttatccacttagaatttaaagtggacagaaaaacagtatttgttyagctttggtgaaatggtgagggaagggagagaggcaatttaatgtaacttgtagagagtcctcattccagttgtaatgtacaacataccacttacctcaatataaaccaccggaaactgaaaagaaaaaaagatagtatgagcacatggtagaatatagaaggagaaaaccatgacaccagcactgacagagtatatgggccagagaaagtaagtctctatattccaaatgaggaaataccccatttggttcacagcactttgtatgtttagtttgggacatacatctttcacgaagtcatgactttcctattgttaaataacatacaattgaggaaacctatttagataaaaaggtccgaataataagtttattattatttcacagattatatttgtttaagagggaaatcaaattcacacatttattcaatgaaagtaactggaatctttaagaggacagcttcaactgcatactgaattcattttaagaatgcagtttatggagtgccttgattctgacatcccttattcttctagcagagatacccttatgagatcttcatgtggtgggcttaaaatacctctttaactggtctcaagtttcccaaaagaataggccttcctttttccctcagccatcacccatcattacgagactcaccatttcatccaaagggtggaaattgacatccrtagagacaacacggaatttcactgaaacagaggtattttcctgtgaaatcaccccgtggagcctggggtagtaatagcatgcctgaattcccaggattgcagaataaagtaataaagaagctcctcccctctcccaaagttccccttgctcatttgattcctcatacctgtttgtcctggtttgtatatgggtttgtctgtctggacaaagactaggttctctgctgtagttayatatattgatttgctctttgtgaaatgcagagttgccccctctacctccacagcaatgaccacccaggaagatggtaattctggaatctgtaaaacagaaatgagctgaagaatctgcccagacttacttctgaatttctcagccattaggagtttctgtcttcctggttagtccctgagaattagtaagggacaaagtcaaggataatgctccttgtcttaaaagtagattattatgatgttgtaacatgacagtaacatgattgaaggagaaaatattgcaataaaatgagctaattcttcaagccagttatgactgaaatgggatgcttgcattttcacagcaaaatggtgatattaaaataattattaaattttatttttcaaaggtcaacaacattatatattatctggccaggsacrgtggctcatgcctatagtcccagcacttcgggaggccaaggtgggcagattgcttgagcccaggagttcaagaccagcctgggaaccatagtgagacccccacctctacagaaaatcaaaaaatcatccaggcatggtggtgcctatctatagtcccagttactcaggaggctgaggtgggaggatcacctgagcctgggaggtcaaggctgcagtgagccgtgatggcaccactgcactccagcctgggtgccagaaagagaccctgtctcaaaaaaawttttatgttattatttgtggtaactacatatgattaaacaattaataccttaagtagtaaaagattaaaaggacaatacatccactatcaaccattggtgagatcttagataagttatttgactttataaatctcagtgtttctatctgtaatggtatgaatattatttacctcagaagtttaagatcagattaaatcctttctataactactgttaaattttatgcatggcactctgtttgtaaatatcatgtaagctgtgagcatattcagtagaacttccattcttaaaatctaaattgagattcactctgtacttcttatttttctttcattatgcattttttattttcaaaggattagaaccaaaggtatcagctaatgtgctctttctctatccagctcccttatttcaaggatcagtactgaccatgaaggaactgcagtagaaatagttcctcttcgtcaccaggtctgtgaggagggatctcttctgcattttgtacatcagagttactttcagtgccaccatctcattcaggtgattaaggatgacacaggtcttttcaggaactccagtgtagaggtgtgatgggaccagcactaggtactacctgtggaggggagaagtccagattaactatggaggggtcaaaaagacatcattattatggccattttctaaataatctttgcttttgtcaccaatcatagaacagagacagattttagcaggagtgtattctccaaaggccaacccaaaagatctgaggaactgagaaaaccagaagttaaaccccagatatgcttctcttctgttgtgaagtactcacccacataatattagcaaagctgtcaatagccatgggtaagcaatccatgagttattatatattttggataaaaatttcataatttcaatatgcaaatcaatcaamaaatcatcattgaaagcattaagaacctctctgcatgcggtcttgggttttgcatggatgatactacagatctctttgttccaggaaactaggaaaaatataacatttaatacatggggagaagctgaattgcttttcagtatgaccttgggagcagggccttttctttctttagctcttttcttttcttttcttttcttttcttttcttttctttctttagctctttggtgatggagacgaggcaagctgagccaggctaatcaccagacatattgccatatacacccagaggaaaataccactctcctctcaccaattgcctctcacaagcacccagacacactacatctggggatgctgtacgtgtacacactcttctctctcttcctgagtgtccctgtctacccagaaaacttctgtttgcttcataacacatatctcaaaagtgactttctctgtgcagaatttggtgaagccctctctcttacatcaggcctcatgaagagtggtcattctttggaagtattctgacagaatcctgcaatgcctgcttctgtttttcttctatagttcattctctgtgcaccatctctctacttttccatactgtgaggtgttgagggcggcgtctgaattttgctaatctgtagattcccaagacccaatgccagctcctaaaggtgtgccaaaggattgagtgaactgacacacaaatcctggcttgtctgtagagcatacattcatcttggcaatcccttatttgaggaaaacacagatactgagtcatttcacaattgtcacgacgtgcaatccattttatgaatcaataaaaaaatgtatccctttttgggtaggaattctatattcttttttggtaaatgtttcatagatgttgctgccttatgtctgtgactttcctgaaattggaggatgtctctttccacatgagtagtaatgacttgctgatacttcctggcccttttgacagcagaaaattgtgtagggaattaggaaatacagatcaaagagataatagaacgggaaaaaaggaggacaatttaattttctggaaataatgcttatggttctgcagcagctgcagcatcactgggaaggagcaggaaaagcaggatcaagactggcgggggcagttgatttcccatcacggtacagaaaggaagagggcagaatgggagcctgagccctcgattcttttaaccctgttcttgctccaactcactggtttttatttcatctgatgggcagtgaaagtaaactgccaatcatttatttttgtaacatattaactacttccagcataaaaaaatcaattccagatcattttcatgaccatatgtattaatttatccactttcccaaattttctaaattcctgaaaaatagtagtttgaggctaccactagctcaggtcattaatcagttttaaaactattttcatgaaaacacaaaacaaattacatggtttgatgaaataaaccaatattcttgcagttttaaaaagaggtattaatgtaaatccatatcccaaatatgttttggtagtctagggagcacaacatacattcttcacccaagattcatcctaactggctcttcagtgaaacaaggaagtgaaatctgtcatagaattttaaataagacaagtttgggagcaacctctccattgcttgaaagattcacttttgatctgtataagtattcttatatttactattttaaaaagggcagttcattgggtataacaacatatgtaatatataattactgtttcttaattcattcaacatctagaatataaattcagttaatttattttattctctaagaaartgatctctctctgatgaacattcttatttaattttatcctgagtgatagaaaatattttatcaacagtgatgcatcatcctatttgctttccaaaggggattcagatgttagaatttatttttatggaacactgaaaataagaaaggtcccattgttaaattaataaaactagggccttataaaattgaagtctggatattttgaataaagaactgatttcaactataaaataagatgtgaagagaaataggcacttctgagaacggggaatattttactgtgttcctttctaaattggggctaggcagatcttgacatacacttttctatatgacctgaaagagtgatggagaagtaaagatgatgtatgtgacaacccttggtggactgcaaaactgtagatatgtaagctattaaaattccaatgatgataaactatggctaaaaaaaatgccaagtcaaatggaataaactgtagtaatacattgtgttggcccttgtagtcgacaaatgcttgcttgggtaattgtaaaactcttctgctttattttggctccatttgtatgctctcttacttccactcatcttcccagctcttcccacatcccaccctcacccctagattaccataaacgtgcttattctctatcagtttaatatgggataaattaacctataataagcagtaaatgacttttaagaggtctctatatcactttttccaggcatgatcatactttttagatacgtaccaaacctgtatttgaccaaatgctgaatgactaaacataaaatccttttttgtaygtatgaagcaaaaattgtcatcacagtttgaacttctggaatagaagaataaatctcaagaattatcagaattttatcattttaatttttaattaaaatattttagttgatacatttgaaacatttgacattatagggtaaacacaatactttctcagcactgtcagctaaggcttctatactcttgggatcttcaaacattttccttgtattccttaaaagaattttattaaacatgtaatatcttacatacacttgacatctaaagtgtctacactaaaataagtgtagtataatactgatgtttaaaaaataaaatgtaataccactttttaaatgtatccgatgaaatgtagacactgcagtgattttttttggccaccaccgttcctgtaaaacacacatgaacacttttttcaccagcaggaaattttatatcactcttgtttctttttggtcttatattttcattctacttcctcaggtaattttatcctggagttgcatacttcaatatattttattgatcgccctattatatgtttctgcaactaaagatcatcaaagattattataaaaatattcttgagcctgtaaagttctaattagtaataaatgttttctaggttgcattatcattaaaattattatcaatatactatttataaaattatatatctgctataatcttaatagatattaaaaatgagaacattttgttcaaaaataattttttagtgaaataaatcatgtattccagctggctccctaagattgtgtattcttggatgaatattgcttattgctggattaaaacaagtttcatctattctctatttgttctaccctgctctatttcaattctagaatattgctaytctgttttctattgtatagatgtaagcactaaggaaacctgttcacataaagagagaaatagaaataggggacgttctattataacaatgttatctaattatttaggcttccatgttaaaagccaaaggtcacattataaccattaaaaattacttttaattatctatcagctgataagtcctctgtaattttattgaaagcaaagtgctaaaccaggtcaattgcaacaggatttggaaatcagccattatgatcattcttattctcggttcctagaaagtattcaataaaggcttaaaaggacttataaacggccaccaatcattactttcttacttaaaaacacaacttttaccaaatatactcagaaagtttggaaattttgaaatatcatttattttaatatactttgtcaatataaagcctcataaaaggcttttatctgatcagaaccataacctgcacatttagctcatttcatttaaaggaagtctccaccagtaacctgatttgcaaagccagtccttattgtcaaaataaccagtcaaactggacttatttctaacagaaaaaaatgttgcattatttttaatttcaataaactcactaatatatattcccrggatgactctcccactttgcaattctaagatgaagagttgtgctgaatrtttgttacctagatgaagtaagacaaccctactttkgtatttctttccatgctttctgctttattcttatggaactctcagggggaatacaacattgacaagagttggaaaagggaagaggggaattttaaatgtgaattgtaatcatttctgtcacctctacaatatgtatgagtactgaaaatttcagaacaggccaaaagaatcaatttctaacatcatgtttttcttataccagaaattgttttaagacagatgggtatatgatacctacaatgggcttatgatgccttgattaagagagtttgtgcaaaagagaatttgtgcaaatattaatattttgatttatctttttgtaagagacaagcaaggcgtttttcactccaagatacatctaaaatacatattataactgaaagagaaaatgtatattaaaatcaactcataagttatgccttgattatattacagcawgatgacagtggttttataacattgcttacaacaatcgtaagattattgatcattcayaatttcaaggatcccagaaatgacactgacataaactgagggcaaagctgactgtaactaaaagattttagccaaatgtcaaagtcaaagataaatgtcatagcgccctaacaaatagtatrtgtttatcaaaagcgataaacctggagatgtcatcacaacaacaaaaactttcatgaaaaagacaagacaaaggtaagttacgactgtaattgtagcattaaatatagggactagaagagaagagatatatgtgaaaaaagttgactttgtaattgagaatagttttgatacattaattgtataacagatttttcaaatgatccaaaataaagctacttttcaaaggaactctacaaaagacattattacctttggacatatttctaaaccaactttattttcaaagagaaatgtgtttacgaagcattgagcaactttgggtgggttgagaccgaaagtatccttgccacttgagtatacattgggggaggcagagytggaatcaytggcatatgtggaatgaaattaatgcatgtattagcacataagggatgtgaatagcaatacttttcayaaacaaaaaaagcaggattattggttgtaaaatttatctaccatgttaatatgctgaataatcctgtacgttttctatccttgtgaatacttgggctggcagagaacaggctggaaaaatcaggagattacagactacgtttccatccttcaagtatttccctgcatggatactgagacgtagaacaaatgataaaaagaacatgatgaatgtgctttttgtcttattagaaagactcacacttaatatgacactatattaatattcagagatcaggccagtgggcttgtcaactgagctgtaattccaccagcctgctttagtcaatactgcaatggcgcttccttctatacatattattaraaactgccctagtggaaaataatcttctaccagcccagtcttgctttttatattagaattaaaatttttattcattaaaaacattattaggagagtgaaaggaaaagtcacagaaaagaaaaagatattttctgtatatataattgacaagtgcttatacccagaatatattgaagacttccagaaataaattagaaaaagacctagcaccttacacaaaacatccaaatagctaataaatatatgaaaaggtacttggtctccagagaaatgcaaattaataccacaatgaaatctctacatatcctccaaaatggttaaagttaagattcataatgccaagttttagtgaggatgtggagcaaccgaatctctcatccaattgtgaaaakgaatcatcattatctactagaattcaycatccacagrgcctctgtcccagcaatttttaccgctacataaatacccaggagagtgacagcaaatgtgcaaaaagtcacgtataagaacatttgcrgttgcattatttgtaatagctctaaattgaaaacaactcaaatgtcccacaacaggatatgtaaattgtggcatattcatacaattaaaactttatagtgtttttcaatgaaatagaataatgttaactgcatcagtgtcaatgaatcccatgaatatagaactgagcaaaagattccacatacacacacacaaacacgtatacacaaacacattacaaatcatataattctatttacagaaacactggtgtgttcattctaagtcatccagactagtcttctttcttgctcttagtgaatcaycaatggaagttttgctcaggagaatgaaatgtcccatacttgtacatgcaaacactgggatccccagttaccacaaccccaacctgatgggtctcctaccttcacctcctcagccatactaaactccttgcttttctttggcagttgagaatctttctacttgacttgaagccttcacaccttttattatcttctgttgtattgttcttctgtatatgttctgatagctaacttccttactgccttaaacctttgctcatctatcagcttctcaatgaggtctaccctgatcacagcatttaaaactgcaaagtctaaccccaatcttaygatactcttgatctcccttgctgtgcctttttaaaaataacatttgtcattttatgacatgttayaaaatgaacttacttatatttcttgtttattgcctgtctctcctctctggaatataaggcagagatgtcttgtttttcactgtttcttattattcagaagtatatccactaataacaagcattcaataattatttgttgaataaataaatgaaaagaattatgtgcccatgagaaacaacacttgctttttctttcttaaaagtatataaaaagatgaatggataaattgaattgtatgcatatatttaatatagaatgaagcaataatatttcaaggagaatgacttaagaataacttcagatgatgtgaagtcagtctttgtacaagcaatcacataacagagtcaattatatagttttatcagcagatcacagggccttctttctcttttgttagtgacatagatgaatacacacacacacacacacacacacacacacacatatattctgtataatcattaaaaatgtcacttaatgtaagaaagaatgcggttctcatttacattcttctagtttattattatttcttgagaaaatattgctgggttcattataaaatagattctggctgttgcgtgttagcgcgcgtcccggagtgcgcatgcgcaacggcgggggttgttccggcagcctttcactgaggccacccgccagtttcaaattcagtggcgtttgccctgattcccggggcctggctttcagcgtagcaattctgccggcgaagaaggtgagcgcagtgctgtgtggcagcagaggtccttaggacgaggagcagcgggacgaggaagggcagactggtgaaatcgcaaactgggcgtctgttccggcgccggacccctgtttgcaaaggtgggtggcccgtccggagcggaaaaacattccggaagtggagggcygggccagcgtgattgacaagcgggaacccctgtgtggggacggggcmggcctaggaaggttgtgcctgcggtggaacggsgcggtgcgcaggagtsggcattaacagcagccgcgtgtctgggtcttagatttggcctagctgtgttgagcttttcatggattatgttacgtagataagacactgcaacagtgagtgagcgcttgtaacccacctgtctcttacagaaactgagccccagcgatactaactttagcaaggatacagctgggatcctaaacttggcgatcagagcccagagccgataaagttagctgcgtgagtctagcttcccccrgggcgggaatcgaggcggagcagggtacagtacggaggccagggatgagtgcagttgaccagattgttgacggaagtgtcataaaagtggacttaaatgttgataagcagctggttgggttccacacaggktgcgagctcaggatgcacgttggaggggacacagggycagagcaaggtgggaatgcgggtattatgggccaggccatcctccagctggtggagcaccgcagcactgcagtrtgtggccctggcttaacagcagtgcggaaaagcttttctcttggggctgtggtgctttccaggtgtgtgaagttaaaacattttagggccatacggtaggtagyacctgccacatagttgtcttggtcagccccggctgccrtgacaaaataccataaactgggtggcttagacacagaaatgtgttttctcacagtcccagaggcttgggatgtccaggatcaatgtggggaggacacaactgagcccacaacaatagtctgtactcggtaatgagtgataattggggactgaagaaaatgaacacgttaagaactaatatgttcctgaagtgctttcacaactctaacctcgttttatgagcgtgagctttgctgtcctggtgtgtgccttggcactgggaggtgatggttgtcctccacacagccaacctgaagagggctgaacaagtcgctgcaaatgtttttaatagggcttagtgaatccgttatactcagatttatctaaacctctatgatttagcctgtgctgcttctggaataatgagatccataattaccactgatggggaagtgaaataatacttaacgtttcttctgtattgtttagtgttgtcattctagagtttggtcaccaaatctgtcttttttatcccacttaccctggtgggaggaaaagtgaggagatagaaagtttcaggtggcttgggggtctggcagatgtggttcaaatcctgagttcaagcacttgctgagtgaccttgggcaagtcatataagtttactgagtctcagtttctttctctataaaatagagcttataaaaataccacacagggtttttgtggggttatctgaaaacggtttgaaaccattaaagaactggccatttaactaataggtattcaagtcatgggacctccgttacccagcctcggaagagaaacctttacttacagccccgatgtctggctggctcctcattcattcatcagatttttgttgaatgcctatgaggtgttgaagcacctagttctgagtcctggagccagagaagagcaagacagacaaggttcctctatttatggaatgtatattccagtgaggaagaataaataggttcagatggtgctaagagctatgaataaattaaatacagagtaatgtgatttttwaaaagtgacttagagcaagctagggggtgaggagtgggggtggtgtttgaccactgtccagcggccagacagccggagaggcttctctgaggaggtgagccaaagcctggatattgaggaggactccttctccaggccaaggggagcagcaagtgcaaggcccgagctgagtagatgaggctgggagccagaccagtctcaggctgaccagtgctctgtcttgagaggagctgctggtcagctttttgtcttgggattcagaacgaggagacatgaagactttttacttggcagtgggagctgaagctgaaaggtccaggggctgatgaggccacgtgtaagcgaaagtttgggataagcagaaaccgagtgcgctgagggagtgagattgtggctgtatccggcrcctggctgagcaggagagtgaaccccgtgggtgtgtgtttgctggtgacgttcctggagctgtcttgaagtccgagctgccttgcagctctagtctgcttctgtttttggctttcccagatagtttcaattcttactctcagtttgtgaacctcccttcagtgaacctcccttyacttatgctggatatctcttgcgactggatgagcttcactaaagcacagtcatttggayctggattcgaatccctggttttccactttttagctgtgagtttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcctcccctttccttcatgtgttaaagctttttcagtacatacccctctctcaggattgaattgtaagtcatattttttaattacccttcttgtaataattcctctacctctgtagtcatgtttttcttttttcattttgtcttgtccccagaatgtctaacaaaacagccaaatatacctctgtraagacagagggtaaaataatgctagttctgtgagttctcttcttgtgcaaatccataaactgccaccaatctgtagtcattttaattgcycctaaaccgaagagcatcrtggcaactacctttcccctcgtagagtgacactatcactagtcttaytgaggccaaagttataaagatgggctctcgatctactaatattagtaaaatgggtttgggacttactaacatttgtgcttagaagagacagacctggcaaagagcttggagaagtgagttccaaagagagaggtgtgggaaccaggatggaagagtcaggcctccagatagcgtttacttctcctttcttccttgaatcactgtctcasagataattaggttcagragaggaggaaaaaaaagatgacgtcaacatggagcagagtttttcttagaccttagcctagcaaggaaagagaaatgcctggtctcagtgctgggaagctgttycagccagagccccgtggctgtgaagagagctctcctgtctggagccaaacagaaagctcataggtcttgaggccagaaaagttagtaggtggcggctctggtcggtgctggaaatggaggccaggatgaactaagaagcaaactaaagatacttgtaakataaggacgtgtaggctgggtgcggtggctcacgcctgtaatcccagcacttcgggaggccaaggcgggcggatcacgaggtcaggagatcgagaccatcctggctaacacggtgaaaccccgtctctaccaaaaaaaaaaaaaaaaaaaaattagccggccgtggtggcgggcgcctgtagtcccagctactygggaggctgaggcaggagaatggtgtgaacccgggaggcgagcttgcagtgagccgagatcgcgccactgcactccagcctgggtgacagagtgagactctgtctgggaaaaaaaaaaaaaaaaagataaggacgtgtatgttaacttgcgctatccaaacaagctgtgcttatggtcctctgcctgtgcgtcatgattttccaggacttcacaacgggataaagtgaagtagcttcggcttgtgaatgtgcattgcagagacgtgggagaagaaagctgcaaaagtcattatragcaacacccttgatcttaggggtgctggtctktgagaagagagctctaagccttttgtagaggyattagaaaggtatcggmgccacggtgaaatgcaggggagattgggtttaggggctttcctggtctgcattctgctacagccgttaaatgccgctagatggagtgcgtgattctggtatggcctcaygtggacctgcgaaggatggagagaacatggtctctgcttcccagaawaaaaggagaaatttggtaayaagtgtggagactgctcttaaataatgctccagatttcaagccacttcttcctggaccatgagagagctccctaatgttgtatttatttttcctaggtccatggctaatgaaacacagaaggttggtgccatccattttccttttcccttcacaccctattccatccaggaagacttcatggcagagctgtaccgggttttggaggctggcaagattgggatatttgagagtccaactggcactgtgagtatgaacagtgagagatactgaaaaggacaacttwacggcagctgtgctagcttttcctgtttgcccatccagagattttcatagtatgaagttgggcagaatagttgctctcagtttatctttctgagtaatagtcacttcctctattaaagtcttttttttttttttttttttttgagacggagtctcgctgtgtcgcccaggccggagtgcagtgggacgatctcggctcactgcaagctccgcctcccgggttcacgtcattctcctgcctcagcctcctgagttgctgggactacaggtgcccgccgccacgcccggctaattttttgtagttttaatagagacagggtttcaccgtgttagccaggatgatctcagtctcctgacctcgtgatccgcccatttcggcctcccaaagtgctaggattacaggcatgagccaccgtgccggcctaaagtcttaaacatagctctgtggtctgagaaaaattaggctgaagtcattggtgcctacctattacggtagatgagatggctttcttaccaactcttttccctccggttccccatccttcaaatataattctaagttttagtctctgctgagtgaaccagtgcgttatgattatgttttgaacataattttgtcttgaacaatatgtcttaatattctgttttytctagttaataattgcccttttaaagttagtttagtttttaatatacctatgccagttcctcccacatcatccagtggcctctcaatatgattttccgtacagataactcctgtcttagtcggccaggactgccatagtaaaataccatagactgggtgacttaacaggaatttattttctcaccattctggaggctggaaagttgaagatccagattctggcagggttctggttctggggagggggtctcttcctggcttgcagatggctgcgttcttactgtggagcaagaaaagasgaggaggagaaaaacaaatctttggtgtctctttctcttttatgaggacaagggctgctcccttatggctgctcckttatgacctcctttacccttgaaggccagatctgtagtacagtcacatggcagggttaggatttcaacatatgtttgtttgttaagatgggcagtctcactrtgtggcccaggctggtctcaaactcaagcgatcytcccctctcagcctcccaagtacctggtggctggcaagatccaagattactggtgcacaccaccatacacagcttcttttgtttkgtttttgttctttaaaaacttttttttaacatgcattttggtggggatacaattcagtccacagcagtgaccaattccatttttaccttggagccctcctggaatcctccatcctttccgtgtcatttgaattagttgctcctcagactgacttgacagatttcagcatgagtgttartggggacagacggccgcacccacaccacgtcagggtataygtccgtttggaggctttcctcaaacgtctggcagccctggactgcctgtgtatgctgaagaasagggcacagaaaggctgagtctgcagggcaggctggctgtggctgccaggctgggctcctttgttgggggcctccagttgccagcacatctgtgggattttccctagagtcttcggtctctccagagcaggtgcctctgagctctggcccagcaggtacagacgctgaagcccaatagccggtcttccgggaggtggtctggggaaggggatccaggtggagagtccccctcagtgcctgctttcagcctgaccctcctctccctccctcttgcctcctcaatctgccagttgcctccagggytctcctagctcagcttccacttagagcccacttcctgtsttctgcaaggagcaggagcagggattgcaacctgggaatctaattgttcttaaacagaatttcaacccgtccctttgttttcagtggcctgctgtgttcctaccacttcctgagtctttctgagaatgagtgggggagatctctggggacacttgggcttgagtgtctctgcsgaatcacttccatgtctctgccttctttccctctctcctaaaacatattactccttccactttctttgtttttgtgggtgtaagcctccatattactttggttaattttagtgtgctttggaacacagatgagtgcatgttcattctgccttgtttaattttagagacagggtgtcgctctgttgcccagggccgagtgcagtgttaagatcatrgttcactgcagcctcgaccttctggcatcaagtgatcttcccacgtcagcctcctgagcagctgggactacaggtgtgcgccatcacacctarctaattttttaatttgtagaaatgagatctcactatgctgctcaggcyggtggtcttaracccctaggctcaagcaatcctccctccttggcctcccatagtgctgagatgacaggcgtgagccactgtacctgaccccttttaccttgtttagcctgacaacccatcttctscctctcaggtctttccatctcagtcttctgcactccaggcttctgcatcttcctcctatgctcagcctttaattgtcgatgtttctggttctatagcttcatcttcttgtgtgcactctctgtgaatgtaccctgtggctttattacctttgacattcttctgtcttctaaatcatctcctgaatagagtgttttctcctgtcctgggtgtcccccagcccataggagcagccatgctgtgggacaccctgagtggggtctgtgttacctgttgtgcctaccatgcccttccccgccttggatgcacaggtgccccaccttagctgcccgagatgctgtttatccttgatagtcaccttttaagccttmtacaggtctatcaagttgagtcaccattaccacttggtgtgtgctgtgccttgtgtaayactgcagttccgggagtcntccaacctggaatgcatgctttgcggggatctatgatgccctcgaattgtatgttacatgtgaacytgtgagcattttctaggggctctgcacctttgtgtyctcagctctgagccccatgcttgctgcaaccagcaggtgttcagagtgaatgaatttgcttatcttggcataaatcatgtaactgttgatgataccccaggaaggtgagcctttggttataaatccttttaacattttccagtctaaaagttttgtggtcttattacasgatgtagaaaacagkgggcctcagttattcttttgctgttgtgccggartataccacggttgtttttgaaagataactttgaccatacccttaggaacttcctcagctcactttcaaatggagggcactggctttctaaccattgtgtctcccagcccagtgacagctgaagctgwctgcttccgatrtcacagrcagcacagaagagccgccctccaggtgctgctgggaaatgctgcctggaacyctttgccatttactttctatcaaaagctgagggaaatggtacatatggggctttcctaaaaatatgggatccatccatttgtcagcaatgtcattctatcctatcccagggcctttcaagattttggtgaaaactaatagatcccatattccagaataatgctattaataattttattattattacttaatgatagcaaaaagttagctaactccaaccgctcacttgttatttgccaggtaatcctctaatccagaggatttggccttttgtgtgtgttaatgtcctgcttgcaccagctctatgaggaaggtgctrctgttgtcatttccatttctgcactcgtggaaacaagcgtagtgaggccagcctgagccacagagctgcaggtaggggaggcagctggaaccctggcrcctggctgtggagtttgagrctctgactcctgcgccgcgctgctgccccaaccstagtcatacgaggtgtttcaccccgccctggatactctgagatcccctctgggttcagcaggctcagagagctgactgcctggagcagaaggcatggggtcctccagagactcccctgagctgagttcccctgtggacaccagggccgcctccttgtggcgctccctgaagggtcctctctggaagaactgtattggttccctggggctgctagaggaaagcttcacaaactggggcttaaacaacagaaactgacatcccacagcgctggaggctggagtccgagatcaaggtgtcagcatgcttggtcccttctgagggtcgygagggaaagatctcttcaggcccctttccttggcttataggggcgtgttctccttgggtatcatsacatcgcctgccttctgtgcatgtytgcatccacgtgtcccctttccaataaggatattagccctttaggctgggtcccgtcctagtagtctcatcttaactaattacatttgygacagtcctatttccagatmaggccacattctgagatgctgggggttaggatttcaacacaggaatttggaggaatacaaytcaatcaggcttatggacaattctggtcttaagtcaagagtagtsttctccagtctgtatgtggaggcgcacacctatggtcccagccacttgggaggctgaggccagagaattgtgtgagcccaggaggagttccataccagcctgggcaacatagcaagacctcctctcaaaaacagacaaaaaaagtggtgttccagagtgattagtttgctttaaaaaaaaaaaaacaaaaaaacaaaaaaaaaaaaacacaaaccgtaaacactggcactcgtgactgatcatcctgtatccacgcacgagctgcacgaaggccgcgcggtcactgtggctcccygttggcgagtacctgggatttcttgctcagcaktttggggccttaattcttttaggggactttttgtctaatgtctccccttcttctaattatgtgcgatatttacatagaatctgataaactgcttcaaatttgttttcagaacagtgagctggataattaaagaagctttttcctgcttcttgggcccagtttccatttcttycttttttctgtttttcctggctattctagtgctartttccttcctttcctttcctaggctggycttagagcatcctctcctatgtacagccagaccttctttcaagcttttattaaaatggggaaaggtcatttgggaggctttgttgttttcctgtttctaaagatcatttttcttcctgcaggggaagtccttaagtcttatttgtggggccctctcctggctccgtgactttgaacagaagaagcgtgaagaagaggcacgactccttgaaactggaactggccccttacatgatgagaaagatgaatccctgtgtctgtcttcctcctgcgaaggggctgcaggcaccccgaggcctgctggagaaccggcctgggttactcagtttgtgcagaagaaagaagagagggacctggtgaaccgactraaggtgagacctggggtatccggaagtgggagtrctggaggaaacagggcttcagcgattgttstggggcgattccgagactcaggcagtgcatgctcccctgccgttgctgtgcctctcagctcttccctcagctccttgggtcgatggtgctgccgctgtgctgtctcttttgagctggaggtcagcagggccttctccacacaaggaactgttggtgcccatttattactcacctgggaaaggacctgatcgttgccattggcagcatrgttcartggctgcaaatggatctgatggagagcgtgtggctttgggaggagygtgccgccttccacagtgagcagcgaggctgggacctgcagggatgaggtcccgggaggggatgcggcagcccttgagtgctggtbggrgaaggagagctgcccscagtgaggaggcgccgrgctgagtggcccagactccttaggagasgcctggttttgggcttcctggtgattttccttcatgtctgcctcctgtaggyggagcaggccaggaggaagcagcgagaagaacgcctgcagcagctgcagcacagggtgcagctcaagtatgcagccaagcgcctggtgagcctcatttcttggggggcaggattatgtccaggcagggtcgcyctgcttggaggctcatgggtgcgtggccagggycttggtctcccctccatgaccctcactggctatgtgctcccgtacagaagctgggctgtgagtggttgaggcgtggatcctaggagtcgacctctctccagccaggcagccaggcctatgtgaatgggcgtggtgtgctttgtctctggcaygtggggaggtgggtactggtgctgagacttcttcctccctccccacctccactgcccctgtccagaggcaggaagaagaagaaasagagaatctcctccgcctcagcagggagatgctagagacaggcccggaggctgagcggctggagcagctggagtctggggaggaggagctggtcctcgccgaatacgagagtgatgaggagaaaaaggtggcgagcgggtgagacagaggcggtagcactaccctgccccaggccaggggacacccttgaagacagctctttccctcatgccacagatgccatgaagcacctggcaagaggcatggtggcctctgccctctgctctaagccgggtccctcctagggtccatgagtgccagtggcagtgaggacagtcaccggcctggcctgtgtcctctcagctgtcctcacagcagctcaggcagggcaggaacatttgygtctgcaccttatacacaaggaggctgcagccccacaaggagagactccttggctgaggccacaagcctcggcagtggagagctgggctagaactcagcyggcctggctctasatctcaggctctgaggcagctgactgcactgggtaacctttgaggtgccaaccgtcaaggcgtccttagcctgagctttccttctcccataaagcctctgttggtccagactcaaggtttccacttgatgagccatgagctgctgggtgacttagccctgagcaggccacccaggccatttcgggcccacaggatccctggtgacagccccgttcccattcacactggaacctcaccaccatccctgagtgtctgctctgagtatggcactgtccagatgctgtggacrtagaagggaagaagacatggaggggacagttaatagacatgaaaacaaatagcacctatgtgaagtcagcatgtttgcctacaaggaaaacaaaatggtgatgtggatggggtggggggctgcacctgatgatgagtcccgtgtgtcctgtgacatcctggccaccacatctgtgggagggtaactgcaagaccagagaccctccgtggatattcctgaaggttcatccccggccttcacggtctgtctgcagggcgccttctgacgccacctccagccgccatccaccagacgccagcttccccgctgccctgaacttcctccagcgcaccaggccttcctctgtcctgtctgaggatttgctcatgcaacgtgctgtggccaaacaccctgccctcctcccttcgcagatgtcttcctctcctttaaggcctggctcaggtgtcgtcttggtggcttcgggtgtcagctgctctgttttgctcacgcacctgcttgtgcttctgttgttgcctcctctccctggctgggctcgagctgcttcagggcaggaaccacgtctttacagtttgatgttcccagagctgacccagtgtttggcatagrggtgtgctcaatamaatcgagttgacatgaatgagcagatgctgcctcgttgcagtctggtagtgtaattccaggctgcscatgtggacytcgacttctgsccctgcccagggcagagaccaccrtgytgctttatgcctcgctggtgagagggggtcataaacagtttgtgctccatgaaccsttcctgcccacctccraggtcrtgtttctgctccctctcttctcccttagagcccatggggacaaggcagagaacttgagtggagatgaaggtggtgaatattagaggaacaaagtgctccttcaggtctgggcaagagccgtggatcctgtaggtcagcttccggggcttcccatgccctcacgtttcaggagataacgtgagcctcrgaggacctgagttctgaatagaaaatttttgckcttcatttcttcacacacccagcctctcagtgagctcctgctggctttgtccagcatgcgacataagattgaatccaagccttttaagatagagccgcctgctctttagtgaccatgaagccaagcctgtaataattactcttctgatagcccaagacaattgtattctgctttgttagaaaggaatttcgaggtgaacaaaaatgttttctttttatgtgatgttgccataggtggcgtgtgcctgtcagatggttttgtgttttctgaggagcatagactagtagagctagctcagcttcaggccatgggatgcagggctggcttccctgccaacgcctggcgctgatggattcttcccgcattgctggraagggcagactgaggcgctgacamaagaagagttgyagctggtcataagtgacagcatcctctgttcactcgattggtcagttgtagcttcatccaggagatggtcatggggttcctgctgcataccaagctctaggtgaggccayggggactcagcagaaacaaggccgacctgggtcctcccttgtggacatgacagtctggggagatagaccgagaggaagcrattttgaatgagatgggtgtgaaggggccatgaatctgtgtcagagcagccagrcctaccagggaaggtcaaagaaggcttcctggaggaggtgatgtttctgctgctatctcagagttgactgggagctggtgaggggagacaacattccaggcacagaacatccgaaggccygagatgatgaagagcaaatatccsccctggggcctcagaggggtccagcttgctggagggagggcagagaggagagcagcctgccatgagtcccgaggcttccractcaagacttgggtttggggtgctgagctcatgtctcctttttacatttccctacccacagacctgagcggccaygggaggttggggttggcatttgcctgggggagtttctgagcragcagcacctgctaccttggtggaacccattgctgggaatggccagggctcagcaccagcgctcagcagatgctcagtgcgttttgctgagtttgctgagggaagactgttttctrttctctctcacacacacagagtggatgaggatgaggatgacctggaggaagaacacataactaaggtaacacgagtgtcctcagctggtgctgtgctgggggctrtgggctgggctgtgyacccttggggaagaggctggagtcactcggctacttctcaccctcctctccacaaaggaggagcttccagcacttggactctgttgcttcttgcacgcaaccctggtcctgagttgctcccttggccagctgcagtggaccctggagtcctctcctggggtcagggcctggggagtcctctcctggggagacctttcctgggagcagggccatgcttgccaccccagggcatagaggaacagctgttctgggctgaagtctgggtgttttctgtccctgctgggtggtgctggatatgactcgtggaaggagctgcctgtggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttccctctttgaagtgcctttctttctctctgctagatttattactgtagtcggacacactcccagctggcccagtttgtgcatgaggtgaagaagagcccctttggcaaggatgttcggctggtctccctcggctcccrgcaggtaaacagtagccagtatttccaccaggggccatcctgctcctttcsccacaactttgtcctgctcgtccaggcctgggagacgctgggtctgtgacaggctgaaccrtgtgaggagcagccccctccctgrcctggccggcccakcactggaaggcaaaggagaggtggcgggggcaggtccacgtgtgttggtaggatgtcatttagctggcaccatctctttgccyctttctttctcctttgytgcagaacctttgtgtaaatgaagacrtgagaagcctaggttctgtgcagcttatcaacraccgctgcgtggacatgcagagaagcaggcacggtagccaccrggaccrtggtgtagccgcaggtggtctggagagagtgaggcaggggtggcagtgactgaagaccattmagtgtctttcatagaaagaatggcagaggagaccccagttcctycctgagtcccctctccttgggaaaaagtgttcctactctctgggtgagcgtctggtccgaatcgttggcttggagatgattttacgggctctttctggagaacaraagtaaaacsttacagtgttccgatgagacacagtaggcagtacttgggagggtcttatagacccyaccctryggaagtgggtctcaacattacacaaccccctctygggcccgtggacagttgctgtcytctctgttttctctctttgtgcctgtgccmccctcagagaagaagaaaggagctgaggaggagaagccaaagaggaggmggcaggaraagcaggcagcctgccccttctacaaccacgagcagatgggccttctccgggatgaggccctggcagaggtgaaggacatggagcagctgctggcccttgggaaggaggccmgggcctgtccctattacrggagccgccttgccatccctgcagccmaggtgagggccctgcagggccagaaagccgctcttggctctcactgtrgtctaggccatgaggggsgtcctcatcacactgtagtttgggggatgccccccaccrtggtcaggttgatggcaccttaacccattctctcctgaggcgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgccwcaacttctcttgatttttaaacagaaggaagaactgctaatgtagcagatgaaaagtagtatctcactgttacttggtgggtgcagtttcactatttccttgctacttctttaacttgagtgactttggaaatgggatatcactagtggaaaattctgtataatccagaaaaaaatgtaaggttttaaaagattcagggaactaagtaaccgtttgcacagcagctaaatgctcaccagcatacctgctgagctgtgtgggcgctggcagagaaactgaggaaagctgccaggccccatggtgtcccaggccttccctccggtctgtttgcctttagagcaaaattagtgctataggcatttatacacaaataccataatatggcccaaaatctttacgatttttgaatttgtaaagtactttgaccatattttgcttttatgttaatagtattccagtgaaattccgtgcatggggacgctggagcccagaaaagttaagtgactcatattttctcaccaagcgtgggtgatggagccattcagttttccgayattttatttyttatatgagtattcctttaactggaaactttcctaacaacaaacacctaaagacctgcagagttgcttttatttttgttaccccagctccacgccttaaccctcactttgaaataggatgtrtcaaccctattttgcagatgaggaaagcaagggtcagagaggttagacaactcttccagagtcacacagctgggragtagcagctccaggagcagaagctggggccgcttcctggtgcaccgatggtcttcargtgttttgtggaaactcgggggcctccggggygaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgctacaagctgttttttgaaygtctctacacagtccaggcaggaartagaagcactcacatcaggagctcagtgtcaggcaggcaagcctcctgcaggggagcccygccctgctcaggtggcctcatctcccctcccagctggtggtgctgycctatcaratgctgctgcatgcgrccactcggcaggcygcvggcatccggctgcaggaccaggtggtgatcatcgacgaggcgcacaacctgatcgacaccaycacgrgcatgcacagmgtggaggtcagcggctcccaggtgcgtgggcctcccctccccrggccagggcctgccgtgaggtaaagggacttggatggttcctccagacaccygggccaagaattcctccggaggtggggcttgctacagggtgcacgagtcaaggyggtgacctcatcggaggctgaccatggctttccagtgcatcccagaactctggggaccccgctatgacagagtgcctcatttccctgcacctcacctgcccccatgctmctgagtccctccagccctggatgccagcagccagttctgcaagccagggagatggcatgtgtgaggcaraagtcccctcaggattggattttgtcattactgaagttgtctggaggggactgaattgaggaatgctcaagatcagygcaggctcctcctgctgccctatcatgcgccatgcatggcaccaggtgtctctggtcttcacgctgactctgccatgggkgtggtgttcctgttttacattggaaacktggagattcaragatggtcaagctctgtcctgaggtcatgcagctcatgagtgtggagctggggtgtgcccactggtttctgactgtgaaacccccacgacatcccaccrgctctactgacctgtgcctgggctgaattgaggctgggatgtgatggtgrccttgaaccatcactctttgtagactctaggtcttttcccaacccggtggaaactagcaggsagattccatacttgaggaattcagcctyttgctttttctctgacccacagtggacactggaggaaaccttcccttccttcccttttctcttagctcccacyagcctaagggctgtggaaaccmgtaccttttgtctgcacccagccccctctcctccctttggtggcttcctgtgtgtccagggcyagcrtcttctaggtgaatctaagatgtcagtaccttagccctcrgctgcttgctcagagcctggtttgtgttctttccccagctctgccaggcccattcccagctgctgcagtacatggagcgatacgggtgagatgtgactctctgaggtagtgggacagtcccttggtggccccctgcatgggcctctgagaggcagcactttggttcccacctctggcccgkgctgtggcggggtggagctgcatgccattcatgtcctaggcacatcatggtgtgtgctgcacacagacctggaaggctggggactgaccgctggctctgaggcctggggcygtggccagcctgctctctgggaaaggatttgtagcttgtgacccagtttgagaggcaccgggcagcaaggcttccactggggtgggcggggcgagtcgccatcaggrcaccaccacttaatgtccgttggcttcttctcaggaagcgtttgaaggccragaacctgatgtacctgaagcagatcctgtatttgctggagaaattcgtggctgtgctagggggtgagagcctcgccccccggctaacccccggcctgcaaaacccgccgggctgctttttccttggatgcccatcaggacgcctcagttctctgtgtttttaagaagggtcggccaggtgtggtggctcacgcctgtaatcccagcccttgggaggccgaggcaggtggttcacctgaggtcaggagttttgagaccagcctggtcaacatgatgaaatcccatctctactaaaaatacaaaaaaattagctgggagtgttgccgtggcctgtagtcccagctgctccagaagctgagacaagagaattgcttgctcaaacccgggaggcggaggttgcagtgagccgagattgtgccactgcagtccagtctgggcgacagagtgagagtcagtctcaaaaaaaaaaaaagaaccaaaaaaaaagaagggtcttggtcattgatttagaaaattcttgttctttgtagcttagttgagttgtctgacttgagctttttttagacccatgggttctttgcccatgttctgaggactttttatttcaggcgctgctctggggggatattaaggatacagcatcacatrgacacacggtgtttccgtgatgggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcrtgaccctgtcacgtccccttcttttatgatggggcacccccttgctggaaggtgtctgtggaagtggaagctgcagaaagcctgtgggagctcctggcgggagctggtctcgtgttgctgctctgagccrccagctctgctttgcctcaggctcaccagtggcctgggtagctcctctgtgctccggtgccctgcataccttggtctggctgctgtgtcccggcctcctggagaaggggtgaaaaacatgaacttacagggctttgggttccacgtgcaagcacgtgagtcagacrtgggaggctcctggacccacctgccctctaagtgggtccgttgcatrctataaacagtgaaaagcaaaacaaagccgttcaaatacagatgctcttcttacttgatgtgcagtgtggagggagagaagatagggaagggttgggggkcctgagaaccaccattgtgacctatttccattctcttttttagggaacattaagcaaaatcccaatacacagagtctgtcacagacaggtaagagagttgccctcagagsgcccagagctgatctgagccacttccgagcttaaccctgggactgaaacctgaggcttagggtgaagctcccaaggcccttcatgtgtttgctctcagggacggagctgaagacyatcaacgactttctcttccagagccagatcgacaacatcaacctgttcaaggtagaggtttccaccttgccatgttccacatccaatttccttyctgtcaccacctgtgggtagagtactatgttaagactatagaaggaagaaaaagcaaaacagacgtgtaattacttaacccttaacgcaacacgcctgtgagacaaaagtcatcatcttttagagtgaaggccacagggatgagggatgggtgagaaagggacctttcttggtgccccatagaacakatagagactccaggtccttgctgtctcaccccatcttctggcacagtctccctcaggcttatggacaggaataggatgttgatttgttctgtgcaacccctgtcacgtcttcgcacttgggccttgggtgtggttgcagcctcagacctctgctcgctccaggtctgtgtacccagcgctccccagatgaaacacggccactgccgcctgaaccccaagctcgtaactcaaatcagcaacagtgactgcccctgggtacagggttctgcctctgttctaggcgccatgccacgtgctgtgctctgagctaggatatccttttgccccggcaaggaaagcaaacaggcccatggaggtgacttcaggagggtggcgagcacaggcttcccacaagtgagccaatagcaagtggcagagacagcgtccaaacctggctgcactgacttggggccccacattcttcccatcgtgcctgccttttttttcttaaaaccagcttttcccctgaattacacatttgggtcactgtcactgccaccatccctgccagacaggctggatccacgtcatccttgatgcctttctccccttgtctcccacatgcctgtgacagccgccaggcctgacagcctcagacagtcctgccgtccccgcgcttctcccacagctgggacatgggtgcaggcactccttctctcgccttccctttgccctccttgctttccttctcccctcttcttcccatgggtctcgggtctcatcacccaccattgagggaatcctcatcgaaggacgtcgctctttttagaaaccggtttaaagcctccaaactcctcatctctgcatcccaagctaagatgtggcaccaaaccacacacattggatgcaccgactgagtggcactgccccagcccctgagcaggtcccagccatcatctcctctgtggctttgctcatagaagttcctttgttttaactctctgtcacctggaaggaaagccaaggggacctagattttactgggcactcttagacttgggagagacatttggaaagagggtctcccccctgaggaggacactgcgttgtgggcaggggcagtagaggcgggggtggcctcggagaggrgatgacaaggttggtggcaaggaggctccaggtgcctcagaaggtagcactgcgttgtgctgcctgggtggtagaagtggtgttttttgttttgtgtttaagattacagcttgctcagtttgcacwcatgcctacagctgggcttggtttttgcaggtgcagcgatactgtgagaagagcatgatcagcagaaaggtaactgctcccatcttgtggtcctgaacaagacccagctgtgccccaaccccctgccgttgccatgctttcctcccctgccctcaggraactccagagtccccttcrtctccaccctccttggtgcagtgggccttgctggggtggtgggatgtgcgcttcaggtgtcttgagcctggcagagcctccgatccacccagcctctctctcatggctgttcctcgttccyctccactgctctctctcatcccacccagctctttggcttcactgaacggtacggagcagtgttctcatcccgggagcagcccaaactggctgggtttcagcaattcctgcagagcctgcagcccaggacgactgaaggtgaggcaggagggtgagcaggcagagccggctgcacgcatgggcaaggacttctgttcctcatgtgtggacctgacmagagggaggcctcctccccrttctgctctgtgcagcwcttgcagcccctgcagacgagagtcaggccagcgtcccgcaaccagcttccccrctratkcacatcsaaggcttcctggcagctctcactacggccaaccaggacggcagggtcatcctgagccgccaaggtaatcaggtggttcttggccaggttcagttcccaggaaggagccaagctgagcccgggagccgcagcatgaaaggattctttccttccatcctgggaactycctgggttaggaggaagcagtgcagtgggcactggcctgctgtgacctgggcaagcagtggaggtggacgggaggagatcgaggggctgggatggaggtcctctagggcaggggtcctagggaaacttgtattgtggggtaggtgggctttggtttgggtcatgattttgtcatctatgagccttgtgatttggactattttctttctcaacttcagtttcctcatatgaaaatggagaggataggccgggcgcggtggctcacgcctgtaatcccagcactttgggaggctgaggggggcggatcgtgaggtcaggagatcgagaaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaragagatggagaggacagtatggtccacctctgtgggctggttgtcctagagattaaatggtgtttaatttaaagagaaagcactagcacttgtgcctcagacctggactcacctgggggaccccctttgctgggacgayagaagtgtctgttgggcttgcactcacctcccaccgatctgtttttccaggcagcctcagtsagagcaccctgaagtttttgctcctgaatccagctgtgcactttscccaagtggtgaaggaatgccgggcagtggtcattgcsgggggkaccatgcagccggtaaggacacctttcccagcccctcgtgccccaggtgttgggatgagatggggrcttgggagagatgcrttatcagtcctgttctctcctggggccscaagccagaaagggtcagctcgagcaggcccagtggtgtccrctgggtgacactgctattctctcactgctgtgccttttaggctgcaggagcagtgcagactcctctgctgctccattctgtagccccaggatcacacttctcccagagaaagctgttctgtggtttcaaactcaaggaaaaaaatcatgattccacttttaaaaggttcattttgatgtatatgaatataatagtctttgtaggcataatttttacttatgtgcatagctattttaaaaacaaaagtgcggctccctccatgtgctgtcactggaacttgctcttttcactcagcagccagagggtcataaaccctgtctccttgtcagcaagcatgcacgtatttcagtatcccagctgtgctggattccagttacccagatatacagcatttcatgtacctccttctcttttgttaggtgtgcaagctatttgcagttttctgttttgagcatgactgtgatgaatataaccgcatttccgcacagtggtgactcctacctagcaaagggcctcctggacaaaaagctgctgggaatcctgaagcagtgcttcccagccccagatgccttagcttttgatttttatatttttgtatggatagattcatagttttattcattcggcatattaaaagttgtttacagtcattattgtttctgacgttcacatggtgaaagccccttcctgctagctcaggtcctccccgtggcccggtcagtctcgcctccagcacagcagaatgtcatgggatcaccatgggtgtccttgccgcacactggattgattcatttctccaagctgctctggtttcttgtaatggggaatgacatttagaagtcaagctgtgggtgctagggtgtttgtcgtgctcctggggcattttggtagacagatctaggaaatgttttcagagtgaatccatactggtatttctttctttctttctttytttttttttttttgagacacagtctcgctctgtctcccaggctggagcgcagtgacccgatcacggctctctgcaacctctgcctccggggttcaagcgattctcatgcctcaacctcctgagtagctgtgattacaggcatgtgccaccacacccagctaatttttgtattttagtagagatrgggttttaccatgttggccaggctggtcttgaattcagttgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacwtacttatctgctctatcctataatatacttaaaagttttgaaatcatagtaccaatattacttctaacaatagatctgattgaaattgcctttcctctttgccyttagagtgtaacccactaaggatgcctggtcactaggctctaaagtcacgtggaaccaggcttctctccgtgtgcttctgttgtcagtttcatagatarctaggctgtttttgtttcattttcttttcaattttagaatttgctttyttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgycttcwtttttccctttcctgttttatttacayrgaaggcatcttagtcagttgtctgrccatcgctcctctagtgggctgcgtggttctctgttggacagatgtaggragcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctarcaggtgaaagcctggagattsttattcagtagtttgggctggggcctggccaygtgtatttttgaaaattttcgctggtgattttgctgcatggccagggttgataatgactgtgccagatttgctggatttcctttgctattcctgcacatagtttaaacgagactgccagcactgggtatcagtcaccatttttctttttgttagtttgccgtcagccttttctttgacctcttctttcagtttgtgtgtacttgctgtctcttaggccagacttctcgcttcctttctgctgggcctctgaggggtcatggggccatgacgccgtggccttggtctacaggtgtctgacttccggcagcagctgctggcctgtgctggggtggaagctgagcgcgtggtggagttttcctgtggtgagaagctgtgcccagggtggggcaggctagaggtcaggttctggcccccgttttctgtgggtaatacctcatacygtgaccaggcacagrggcggaggagaccccgggatgggagcctcacccttcgtgcgctcrcccaggctctcctgctttgctccctgctgcstgctgcccagtgtgactggcgatggtgggtgggtgagcgctgtcagtcgctgttcctgtgctggatgatggggcaggtaaatgccctctctgcagtgtcttacagcacacctgcatctccagttttcggcccctccctgatcttaccaggtcacgtgatccctccagacaacatctgcccctygtcatctgcagcgggatctccaaccagccgctggaattcacsttccagaaaagagacctgcctcagatggtcagtcccagccagctcgctgcaccacagcctggcctcaggcagcaaagggttttctggggcagggacgctctggcccaccctgagtgttttcaggtgttggggaaattgcacagggacacccacttagagccacacagaatgagcggcgtcgatctagatgcttatggaggaaggtctgagcttccccgcctctcacaccttaggctgcgaaatatgtattcataaaacctccaggcatcttctgaggacgcctcackcaggagaaagctgctagttccctttggctctcttgccctttggttatatctgcccctgctgggggcagggatgtggggcttgggggcatctcctgtggtgtgcctggggtgtgcagcccctgattgtcrttgtggtgcccatcaggaccctggacagaagaagggaggactcagtgccagggcaatagggaggcccccyagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccragggtctctcctcagttttgagtctcaaggtgaagacgcggtttgtgggtggctgaggggttgctccatgggggctccctccctyccttccttccttagatggacgaggtgggtcgcatyctctgtaacctgtgcggtgtggttyctggaggggtggtctgtttcttcccctcctacgagtacctgcgccaggtccatgcccactgggagaagggtggcctgctgggccgtctggctgccaggaagaaggtgagtggcctgtcggcagccttgccacttgtgaggacagtgycactgagtcctcctgggagctcttgtgctcatcgggtcrggacaggcttytggctcctcatccccaccgctcccagtccctgactacagaggatttccccmaagtccctggctgtgaggttctccagtccgctggccagaaaacacaaggccacgagcagacccgagacctggcaccctaaacctgtctctgggaaatgtcctstgtctttctcagatattccaggaacctaagagcgcacaccaggtggagcaggtgctgctggcgtattccaggtgcatccaggtgcgggcgtcatgctgrgcttgggtctgagaccrtgtgggggtggcagctggaaacgtgggtgtcatccaagttttggctcagcaactcagcrtctgggtttctcctacaggcctgtggccaggagagaggccaggtgacagaggccctgctcctytctgtggttggaggaaagatgagtgaagggatcaacttctctgacaacctaggccggtaagtagtggttctgctcatctcctgggtcgtgatacatggccggccctcactcccagcagctgggcccctgcctgctstctgctgccattagagcccacagctgggctgcgactgctcagaccagccagctggagggaggggctcagcagctctgggtttggccctgagagagtagttggattttaggctggycattgctgtatcaggacccaatcaattggcctagacgggatctctcagccttacaagccctctccaggtggtaggtacagagtggagagaggctgagttttgatcacagtcggagagggctgacgraaggggtagaacggagcagctggtgacatgggtgatgacccgggagttcctgacgtccacccactgggctcttgtctccyccccacgtgtgtggtgatggtgggcatgcccttccccaacatcaggtctgcagagctgcaggagaagatggcctacttggatcaaaccctcgtgagtgaccccagtgtcacagagggtgacagagtaggcagtgggtgggagtggcatcacccccagggctgatacagccaggccttccccactgcgctggtgtctcctgccccctccggaagcttggatgcccctccacaccctcttgatcttccctgtgatgtcacctggacccctgctgctggcattggccacraagcctcctgktctggctccaaagcctggcagggtcttttccccgggggagctgcaggcagggaacrgtcctgatgggtcwtccccttcactcccagcccagagcccccggccaggcacmcccagggaaggctctggtggasaacctgtgcatgaaggccgtcaaccagtccataggtgagcctggctgcctccagctgggtggacagatgggrgctggagaaggggagaacaggaaagaggggttgcctgccctgtttcctatrtaagtctgaggaaggggagggggtcgccatgggaatgtgctgtagggggaggcaggtgttgctcggagcsccagcctctgttcctatgcaggcagggccatcaggcaccagaaggattttgccagcatagtgctcctggaccagcgataygcccggccccctgtcctggccaagctgccggcctggatccgagccmgcgtggaggtcaaagctacctttggccccgccattgctgctgtgcagaaggtcagtcctacctttttctttctgagagcctcccmaccccgagatcacatttctcactgccttctgtctgcccagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccrggacccaggcacaggygttagctcccgtaggagaaaatgsgggaatcctgaatgaacagtgggtcctggctgtccttggggcgttccagggcagctcccctcctggaatagaatctttctttccatcctgcatggctgagagccaggcytcctkcttggwgtccrcaggaggctgtggcagcwgtggcatccactgtggcatctccgtcctgcccaccttaagaggygagatggagcaggyccatctgcctctgccctttctagccaaggttatagctgccctggactgctcactctctggtctcaatttaaaatgatcccrtggccacagggctcctgcccaggggcttgtyaccttcccctcctccttcctgagtcactccttcagtagaaggccctgctctctatcctgccccayagccctgcctggatttgtatccttggcttcgtgccagttcctccaagtctatggcacctccctccctctcaaccacttgagcaaactccaagacaccttctaccccgacaccagcaattatgccaagggccattaggctctcaacatgactatagagaccccgtatcatcatggagacctttgttcctgtgggaaaatawccctcccacctgcarcagctgcccctgctgactgcgcctgtcttctccctctgaccccagagaaaggggcygtggtcagctgggatcttctgccaccatcagggacaaaccgggggcaggaggaaagtcactgatgcccagctgtttgcatcctgcacagctacaggtccttaattaaaagtgtrctgttggtttctgctgagtttttyattgatatgtgctgctgttttctctggaagcctctttagggaatcgaggagcrcactggtgcaggggctgggtggagccatcctccgatggagcacaggcagayrgaagcccccaccccagctgygtggcctsaagccagcctcccgctccccgaaggtggtctccacacagamctgggacagttycatcccygccccttcctccagggcagcagggctgaggatcccattctggctgtgtccacgtccgggccatggctrgagtctgggtttaggggaggaaggcatggyggcgcccgctaggatttccagttgtcctcttcttcctctgcctgtggctgctgggggttagcagacacgrtttgttgtctgacatacgggctctctcytcccggcccctcaccagccccagaggtgaaaaggctggagggsaaaggstgagtgagggaggtctgtggggagcactggtttccccaggccccagagacttaaacacaggaagaaaaaggcaagagagaattaacgatgccacagcccatggcagacagcggccctgcctcctacscttgcgtctcaggaccagcttgttgaagagatcccacatcagttccctgccttggcttacggctctcactgcaataggaaagccacggagtggggtgtggggttcagtcacattkgacccccggctccgtgttcctgtcccctgtagtgtttttgttattagaccctttttyctccttggtttaggaatgggggccccagggccacccttgtccaggctccctctaccgtagaggtgagaattccagggcgctacartttgaaaaccactattttatgagccaagtagaacaagaaatgacaactattaaaaaaaataagggatttctgaccagctaacaaccccacagaaaatcyrccagggatccagaaatgagactgaggtggcctcagagagyggctccctcctgaaggggatgctgctgctgtcatcctgcccggcaccttggactgcagtgggcrgggcctggggtggggatgagggtgcactgaccagcaccgcagcagcttggggaggttggggtgctgttaacatgccatcktataggtcggaagtggaaatgggagaaagtgtggggtgcctagggaaggaggtgactgagtagggagcctggctgccatcctaacacmcagctcactgggcttgagagacttgagcctggtgccagggcagagtgggtgatgctggggcccaggctggcaccatacttgaggtctgccaggcaggtcaggtaggatggcacatcgaccttggggacttggcccaggtctggcgtgtagaagtagttctccgggacacacgggattaggtagggacatgtgagaggtgacagggacctgcaggagcagctagcgagacctcatgtgcaccctgcacagctgtggtggcataaggggttcaatagagcctctcctagagaggagcctggcaaggcccccagcccctgcccctgcccctgcccctccccctccctgtccacctgctgctccagctgctctctcattgatggacaaggggcactgaacagtttcttctctgtctctgcccccagcatcacatggctctttgttacagcaccaaccagttggtccgggaagacagacttcttgtatctacaggggcaacgtggaggtcaggcaagccagcacctgctgtcctgggaccatgttcctgacctacctctcccatgtcatcagggacactgcactgaggggtcccaggccaccgagccaagccaccctggtcaccttctggctcccgcctctgtgctgcacctgagtgtgatgccctgggaccccattaagtcaggctgagtcttgcacccacaccctgcgactccattttctgctacaaaggatctctctgatgttgacgagcagcatggagacttggggagacccccccaagcgcctcctccatgtcatccttgggctccagcttggcgctcacacacacaggaaaggacttcagcttctcctgggagggctgggtggctgaggggtggtggatttcggagttggaccagcagctggcctagaggctactggggaggagggagcagggagcacccactgctgatccagattcactccttccctcgcctctgtcatgaccccaaagaagcagatcctgaacctgggctcttgtcttcacctttgttctcttccactctggggtaattaagaatgatttgctggccaggcgcggtggctcatgcctgtaatcccagcactttgggaggctgaggcaggtggatcacaaggtcaggagatcaaaaccatcctggctaacacggtgaaaccctgtctctactaaaaatacaaaaaaattagccggtcgtggtggcgcgcatctgtagtctcagctactcgggaggctgaggcaggaggatggcgtgaacctgggaggcggagtttgcagtgagtggagattgcgccactgcactccagcctgggcgacagagtgagactccgtctcaaaaaagaaaaaaagaatgatttgctaattatgcaggcagctgatccagtgctgtgtaaccttgggggccaccagatgccaatcagtagaatgggagagaaggaaggatggaggaagtgaggacaaggggcaaggaggaaggtctgtccacctgtctcttytgtgcaggaggtgtccaagcaggaggagcacgtcacatccccactgaaaaagcccacagaaaatgaaaagcccacatgcttgtccattgctgcaggatgggggcaagtggagagggagaggtgtcaatgctcccaccttactcccagtcatggctgactcctccctttccttcgttcttgttcctaatctgtcaccatgtcctgtcgttttctttgtctcacccaaccctctgtgcctgmaaatcccctgactgcagcctcatccctgtcacctcctgactgtagttggtgacagaagaggaggctgcaccagtgaaggagcagggactccaggtctggcaacaaccagggatggggccgggtgggggtgacttggaccaggagaggggcctgagtcaggcagtcacatgcttcatgctggggtcccccaagtgaggcacagcccggggtcccgggaagaagaccaagcctcatttcaggttgcttgtggccaaagacaggacctgtgtacccaacaacccctgggacttttgcaggaaacagcaaacaccattcgctcactcgagttagataaacactgagcgaaaagtcactggagcccaaggactgtgcggggtcagtgctgccgatacaagaaccgcagccctccagctcggctccctcaacggcctgcgctgcagccacactggcctcctttcaggtcctccacctcagggctatagctcatgtgcttccttctttctggaatgtttttcctgacctacccactcaccgtgagatttttaccacaaatgctatttcctcacatccgccttccctgacccctgagaccaagctaggtcccccatgatgggcctcgcagcacctcatctcccctccacagaggcggtgataacccacagaacccagggccacgatccctggctttgaaccctggctttgccactcggccagatctctttctgtgcctcagtttcctcatctataaaatggataacagcagcgcctgctcataaaatgtggcaaggattaaatgagttaacgcactcagatcaatggtggagcaagctccatgatacatgaagattagtgattacaaaatactataaataggccttatcacaactgtaattaaataactgatcattaattggttatttaggtctgtctctcctgccagagtgtatacaccagttggacaaggacgctgccttattcatcactggatctatagtgatttgctcagtgccttgcacacaggcactgttgggtaaatattttctggctgcaggaaagagtgaaggactaacctccccaacccccctcccacccccgccccttgctacctcgtgggaggaagagcatgagttgggagagcagagccaccacaggaaaccaggaggctaggtggggtggaagggagtgagctttccggctctcaggagcgaaagcttccaagttgggctctccccttggccccttccacccagggaagacagctgggtccgccaggaccaagaatccccaaaggggctgctcccagaggttgtgttgcagggactggagagaggacttcccagtacagggggtggccctctgatcaggtgggggtgggtggcagcagagcatttggtgggaggtcaggagctcacaggagatgggattctgccgatgcctgctgaatgaatgagggagggagacggcaggaccagggactggggaattggtactaaggtgctgggtacctgccgggcactctgtccatacatgatctcagttcagctctccaccttggaaacacaagaaaggagccgtggctgcagagaaaaacagaggctggaaacaggggtacatgggcagggtggtggtggtgagagaattgccygaatcagctgccaaatggtgcccaggttggaaaagcaaatgtgcacacatgggttcttcccactctaaccctgaggaattmgaggcctgcttctgacacagactgggcagtggctagtgactctaggtatagagtrtccaggccctgctcacccaggctagagcttagggagccagaaggaaggaggtgcatgttggggtgcaggacaggagggaaaaatactcgaattgcaaggtgagggcacagtctatttatattgggttgaattaactcctccccctgatgccactaaagcaggaatcacactgcagatggcactgatttgattggcaagagacatgccaggaagaatattaagggaccggacccctataattaggcctaatcatagcctgttgtttgaaaagggcatgaaggacattcatcaggcctggcactgtgccctagacctgctctcctgggtagtgggaccctccgtggcaacagaggtgtgggtgggcctgggtgagtgtggcaagaaatgcctcggaggctctatttggccttaaagtgctgtgtgaccttggataaactgccctctctgaatctctggtcctttccatttcccattctccaggctgagaactgcactgtgatatatggttattcccataataataatgtgtgtatcatgcataatgcactgcacctcttcaccacgctggtgcccactcttctgctccccctgccggcttcctcagccccttctaccctgatggttctctcctttcctcctcaggccagcacttcccatgatctgagatgtccgtcctccttcctcttcaactttttctccagcagtgagttcctcctcctaactgaggcttccaggaaggatatcctctgcttctcagacctgaacctgccttgaatactcatgaggacccaggagctactcctcacctcccacttctcttccctcctgtcagataaccaaggcacggccaactgatctccaaccatctgaggaacccaaccgtgtgagaccacccacacctttcaagaatgttcctcccctccccttctttgtatttatactgatgcaaatttgctggccatcttaactcagtcctgtgcctcagttctcccacctgtaagatcaggaggaggataaagatgtaagactttctgcacacgttttaagatgaattccttgttaccacatctgagggtgtctgtgtttactgtactatccacgtgagaggattgtacagacacgaatctaaacaaggaagtagcaagtccattcaagcattaagaggctgattagtggtttattcattctgtctrcaagcatctactgatcatctattcagtrcagaccattatcacaacaaaggtgaataagacactatgcaatagccagggaaacagcctcaaaaacagttaaactctaatccagccatgagtacaatgctaaggagggacaaattcccttctagggctagggaagtcaggaaaaaacctctcagcagaatgtgtgcctctctaccaggcccagggagaaggtgcagagacagcattccaggtggggagcagtggctcacacctataatcctagaagtttggggggccatggtggaagaatcaagaccagcctggtcaacatagactcctgtctctaccaacaaatatatatattttaaattagctgggtgtggtggtgcaggtctgtagtcccagctgctagggaaggatgaggtgagaggatcatctgagctccaggaggtcagtggaggctgcagtgagccatgatcatgtcactgtactccagcctgggcaacacagtgagaccctgtctcagaaaaacaaaacaaaacgaaacgagagagcatcccaggtaaaaggaacagcttgaacaaaggtacgtagtgaaacggcaagtggtcttgagtggtggggacacagtcatccttgaggaagtaccaggaaaaagaatgataaagagaggccagtttgtgaaaaacacccaaaaccaaggctaggagtctggtcttgaaccaggaatgaaatccttagacctgtgctgtccagtgtggtagccaccaggtacatgcagccactcagcactggaaatgtggctagtctaaattgagatgtgctgtcagtgtaaatacacaccgaatttcagacttaggaaaaaagaacatagactatctcattaaaatctatattgattacatgctaaaatgaccataatttggatacattggagtaaatgaaatatattgctaatttcttctgtttcttttttttttcaactgagtcttgctctgtttcccaggctggagtgcagtggcacaatcttggctcactgcaacctccacctctggggtttgagcaattcttctgcctcgcctcctgagtagctgggattacaggcacctgccaccacgcccggctaatttttgtacttttagtagagacggggtttcaccatgttggccaggctggtctcaaactcctgacctcaggtgatctgcccgccttggcctcccaaggtgctgggattacaggcatgagccaccacgcccagcctctcctatttctttctattttaaaatcacatatgtgatttccatatttttcttttgttttctttttgccacactcagtgtcctgtgattccaaagaaatgaatcccagttcttttcaggcaggagctatcctagaatggattctggcgtaagcatcaaaatcattcataacattatcattttatggccccttcgttctgtatctggtagctcttaaactattatcatgaagataatcattattgtgcctctctcagcagatggtatttccttatgctacaatggtactacaaatattagctcataatacccatgtatgttagaaccattctaacaccttcccaagaactattccatttaactcttaatcacagtgaatttattattatctcctatgttacataaggaaatgaagttggaaagaccacatggcattttttttcaacattgaaaccctacttgagatcaagcccaaacttgaacctatgttgtctgactatagaacttctgttatttatcagtatgttttattatttttatacattaaaattgaagatcttggagtttaaaaatttttttagtactaccgattgtaagacccctttttatgatactttgtctttatgtaaacctaaactatactttttatatatatatatatatatatatatatatatatagacagaaaaacagagagtcttacactaaccaccccccccccgtgtggtcaacatttttgttactttaagatacaccaccccaattaacttcacaacaaactttggagtcatgtaatactatctatttttaggaatgagaaaatccaggcacaaaggttaattggcaattatcttttgcaaagtctgtggtgctcatctgaaaagatgacgatcacttcttatttagtggaaagacaataaatagttgataagtaatagtcttccatcagggagttttgtaatgagaaaccctgactcctcagttccccagtggatgactgcagttcactctcggtctttgctattgtgttacctgcttatccattttgttaccttttaatgcattacataaatgcataaatattctttaataatggtgctttcctcacatctatgccatccgtgttcatcaagatcttctttcagtttctttgacaactaaaactgtacatatgtattgtgtatggcgtaatatttctactgcacagcattgctttacacaatgtggtaaaaactatggactctcccaggaaaatgcacacacaccgtacccctgtctcataaggcagtttatagtttcaaagtgcatggagcccgtcctgcacaccattctcccacaccccgctccrgcgcctctcccygagttacagacctcactgtgggcccccggggaaccagcgcagaggtttaagcggtgtggggtcaactccaagggtcaggagttggcaactggttggttccccatataattgatgcccccgacacagcatctccccgaaccaataatagaagcttctgactccttcgcccacccttctgacttcttcttgcttctcccatggaagcaggtgtgggaaccgctgagcrgaacaccctcccccagcgggaaatccgggacacgcaggagcctcagtgaatccgaccattgtctcatctcaccaggcaggtgcctcctccatcctatgtgcgatcaactttattactacaattattaatataaagctgttgtaaccaagcgggtaatagaggaacgccacactttgagactaattcaggagttctttattagccagcgatcgagagacggctagcgctcaaaattctctcagccctgaagaaggggctagattttcttttatactttggtttagagaggggaaggggagcctagctatagcaatcttatagaagtaaaacaggcaaaaaaaagttagacaaatggttacaggaaaacaaatggttccaggtgcaggggctttaaatccatcacaaggtgatgggtgcaagggctttgggtgctatctactggatacaaatgcaggggcttaggatactatcacccgagcgaattcctgggaactgyggrcataacttgccacaggaccttatcagttaattgcactctgatgtgctgggagtcagcttgcacaagttaagtccttgaggaattgggtgggcaaggagctgcaagtgaaggagccaaaatggagtttgtctggctctctcagctaagggagactcaattcaggttaaaacaaggtagcatatcatattccccacttgttacaagagggttatattggactttaagatatataagtttgacagaagctatgtgttgctttataaagttaagaaaccagttttaacttacgaggtttgaagactaaacaagaggaggagaaaggggtcccgccaatccagtaattagagtagttagtcatggattacagttaaacatgctttggtactagggggtgttatgaatttgagcaggaatgctgtccactttcagagccgtcagtgtggtgaggatgacagtatgaggtcttttccaggcaggagtgagtcctttttttttttcttttggaactttttaacatacaccaggtcacccggctggaaagagtggcagagccccgtctggtcaggaactgggttgggatgagctccccggacaagcggctggatgatgtcttgtacctgttggagagactgcaggtactgtaataaattagcttgtgagatttctgctaaatgggtatcccttagcttaggcaagataggcggagccctcctatacatgatttcaaaaggtgaaaacctagcccggtaaggagtgcatctcactctaagargggctaaaggaaggagtctcacctaattttcaccggtctctaagatcaattttgtaagagtattttttagggtgtggttcatgcgttctacctgcccagagctctgggatcgagaggcacartggagcttccattgaatgtttagtgccttactgactgactgagctatggacgaggtgaaggccggtccattatcagaccctatggcagcaggcagcccatgtcgagggatgatttcattgagtgaaaacctaactaccgtggtggcagtctggcagtctcgttcttggtggcaaatgcctcagtctatccagaaaaggtgtctagtagtaccagaaggtatttgtactctgcctggtgtggttttatttctgtaaagccaatttcctaccttctcctggcgagcctccccggaggcggtggcctgagctgggtttaggaccttgcttggcgttcacctgggcacaagccgtacaccggagagctgcttggttcgctaagtcctgaaggtgggggatcttgaaacggctccttagaagctgggccaggtttcctccttctaaatgggtggtagaatgcagacaactgattaaagtttccccgagagcttggggtatgaagattccggaatcaggaagaatccaccaatcttcctgatttttactggcctgaagatccaaagcctatttttcctcctctggggagtattctgggtgatctggtaagtcaggttgcggaaaggacactgcaggcagcagagtcagaggcgtgactgggagttgagctgcctcccaggctgcagagtctgctctttggttaccacaggcaatggccatgtcttctttttgatgtcatttgcagtgaattacagccagctgttgagggagccaaacagcttcaagcagggccaaaatttcttctttgttcttgatagcctttcctgctgagatgagtagcccatgctcttggtagatggctccatgtacatgcacagtagcaaaagcatacctgctgtcagtgtgaattttaatacrttcgtcgttaccctatcggagggcctgagagagggcaatcaactcagccctctgtgccgaggtacctgctggcagtgcttgggcccacagtatattcgtctccgtagtgatggcagcaccagcctttcgaactccctgctcaaggaagctgctactgtctgtaaacacagtggcatccgcctcctttaaaggcacgtcttggagatcaggtcggccagtttccgtagtctctaacagttcttggcagtcatggacaggtgtggtaaggtctgggtcagggagcaaggtagctggatttaagcatcttgtgggagagaaagttaaatgaggctgatctaacagtaaactgtgatactgcaggatgcgggcatttgacatccatttgccagaggcacttcrtagtaaagtgtctacagcatgaggacctgtaagggttaaattttggcccagagtcagtttatcagcttcctggaccaggctcgctgttgctgctactgctcacagacaacttggctacttggtggaggccacagggtctagcctcttaagacaagtaggctaccggacgtcaccatggccstccactgtggcggtcaccgtgggctactgggggccaagagagaaggagccccggtctcgtcagtcatcagactcctccgctgcggggagggtgaggacttaatttttcttttctggtttttcctctggctttaatgggcattcttttttccagtgtctagtctgcttgcaataagcatgttggtttttctccaggggagcctgctcgcctttcttgcctttctggcggggacctggggttccctggccattcctctgtgatgggggcctttccttcttggcttcctggatggccgccactaagattttcgcatgtcttttggatgccttatcggcggccttttcagttgcctgagctgcccgttttcgcttttcaaactctcgattgtcaaaaactttctgggctatctctagaagttggctaatgttcattccagcaaatccttccagtttttgtaattttcttttaatatcagggcctgcctgagccacaaatgccaaattaatagcacagctattctcrggagccgccgggtcaaaaggggtgtaactcyggtaggcctcctggaggcgttccaaaaacgccccsggtggctcatcaggyccctggacaacttcaaatgtcttagacaaatttatgkgttttcgagcagctcctttgatacccgcaaggagatactggtgaaaatcatctaaagctctcttcctgcctgaggagtttggatcctaattaggccgggtagagggaaaacctcctctaggaggttatgagcttcctcctctggtctaccgtctgatgtaaggaaatattttctggcctctcttcgggtacgttccttctcttcagaggtggaaagggttaaarggagctgttgacagtcctcccaggtgggccggtgagtccggagcatggactccatcagtgaggtcaagacctggggcttttcagaaaagggggggttatgagtcttccagttgtacaggtcagaagtagagaagcsgacataaactaagaatgggcctgagtgcttatcgcccggagggacttgtgcctcctcagcgggaggagkggggctacctcctcctgccgtggccgcgatcaggaggcaataggtggagagcccacaggggaggtagtgsaggagacaagagaacattctgagggagcaggagggttataaggcggtggaactgggtgaaggaaactttcctcttcctcacaaggaggcaatacaggaggagccgagccggctgagggtcgaggcgaaagtgaggtctggctcaaaaggaccttggaggtagaattatgaatggcgcatgagcggagccgtggaggagggctccggaccaaactcagccattgatcaatgtagggaaactgatcggggtgaccgggagttccagcaacaacccgccacacagtctgaacaattgcgaggttcagtgacccttctgggggcgggggtgcacctgactctaaactttggccattctactccacagagtgtccagagtttgccttttttaaggcggagcctataatcctctgagaagcctagagagaaattttgtaacatacattggagagggctccaagctttatgaggccaggaagaagagtttcctattctggaggcagtttaacaaggtttgagcagagatattaaacttagcatggacagagaaattcatgacctaggggggctgtagtatcagaagaacagaaataacataaccagaaggagtggcaaaacagctataaccaacacttcctgccgcataaggtttgtmttcttaagctttgagacttagggagaggacacgtggcaggtctgaggcccgtgggacctatgtgacttccctctcccctttgacttataacctaaatatctttggtgtctccacgactcaaaggcaaagagttcagacttggccctttcttttaagggtttgaggagggagagaagagccaagtcttggaggcgctggacttgctgcgacacaggaaaacgagatgtgcagggcaagggatggcgatgaggaggaaaggggccacttggatctttcctaaggtaggagagtagtcacagaggataagagtccagctggagtgaagcagtacgggggtagtccttctattttagggttgccagataaaatacagtatgcaaaatcaatgtgcattggagaaaataatttattattagagaatacrtaatttctttagcataaatatgtcttgtgccattcttagtttgggacatacttatgctaaaaaattatttgttctttatctggaattcagaattaactaggcattttatatttttatttgctaactctggctaccttattctcttcttaatattcttcaactctmctagctttgccctccttccctgccccctcttctaggggagtcggatcgagttgtaaggagaacatgccctcccctcccctccccttcccttcccctccctccccttcccttcccttccttccttttcccagtttctatatactgtattagtcactaatctaagtgttctaggtacaacaaacaaaaccacatcaaaataatccacagctccccactgctctcagaggcctacatgctggtgggagagatggcaattaaacaagattagtaagtagggtagagaatattagagaggaagatgtcctgagaagaagaaataaatcaggaagaggatatgaagtgctggggagtgttgaaattttagatggggtggggcttgacaaagcctccctgagaaggtgtcttccgaggaaaggcttgcaaggaagggagggtaggtgtttgggggaagagcatctagacaaaaaaagacaagtacagtgcaaggttctggaggcaggcgcgcacttggctrctgtgtttgaaaatgagggcggtgcggctgcaggggagaggacggggggtggacaagaactatggggtggccaggtcctatggggctgtgggaaggaccttgaactttactctgaggagcatgggagccatcgcagagtattgagcagaagagtggcatgacctggctggattctttcatagagtccttctggctgtgatattactctctattagacaggmaagctccttgagggcaggcattgtgtcctattgacctttattataaggacatagcacatctagcctgtagaagacttcaatatgttttttcaaatgaatgaagaacgactgaatgaatgcatgaatgaatgctgtctcccgacagccagatcctggctcctaaggactccgggagtcttctcactgtcgaaggaaaactctggtagaggatgctgccagcagccaagtccctggggctcttagctgctgctgtggcagcaacacacatccaaacccgttttccttcttgccacatagcaggctgcttaatggatcactgtcacctggagggagaatttcaggggagaccctgccctgggctatcttctgattgatgatgtcatcgagcgttattaacaaaattatagacaaaggtgggaggaatggaggatttattaatggatggcctcaaaatttacaactatagattrtatttatcggttcaagccaagaggccctgtctacatttcaccttgacaacatctttgggttgarcctcatgcttctccttcctttaccacaggtcatcatctgtcttctccatagttcatagaacaaaaaacaacatgaagtcccrcaagagctagtatttcttgtgaggatttaatcctctgaataactatgaaatgggaagcataattaactccttttacagataatgaamctggagcttggagagttagtaccrtggccaagatctctgagataggaagtggtgatacccaggacaggaatctagatgctacgatgccagagtcttgaaccaacccctatgcctgctggccttgggattaaccagaaaaatgaaagtccagatccaattgcttgaatttgtttttttaaaaaaacttttattttaggctcaggggtggatgtgcaggtttattttataggtaaactcatgtcacaggggtttgatgtacagactatttcattacccaggtactaagcctaggaccaaatagttattttttctgctcctttccctcctcccaccctccaccctttgctaggcctcattgtctgttgatcccctcttcatgtccatgtgttctcatcatttagctcccacttatgcgaacatgcaggatttggttttctgttcctgtcttagtttgctaaggataatggcctccagctccacccacattcctgcaaagcacatgatctcattctttttctatggctgcatagtatttcatggtgtatttgcaccacattttctttatccagtcttccatttatgggcatttaggttgattctgtgaatttgtgtgttgaagcatagcatagcatagcatttcrtatgcctaaaaatatggaaataataagtgcgtggctcaatgaattrtccaaagcaagtgcacccagtaaccagtacccataagaaacagaacatcgtcagccctctaggagttccctcatgttgtcatctcaggccactgcgctggagaagagtctccagtgataacaaatattctcacttctgaagtgagaattttaatattttaattttaatattagtttaaaattttattaaatgaaatggtacagaataaactctgtcaggataatttattatatttgaaagtctcaygtgtatttctaaaggcagctatagttcactttcagttctgtatagcttttattatatgcgtctatatatgcaatatcatattttaggacttttgtatatatatatttcatgtmttctttttattattgatgtacatgcgagttgtttccagtttggaaaagtgctaaataatgatgtattgtagaaaagagaaaaatagtctaaggagaaactaaattaacccacagctccactattgagaatttacctcccttaactgtcatagttctggccatttgtggacgttcttttgcgtggtgaacagatgcaggcatttctaacggatctatacctgagtcaaattgtggggccatagaatgtatatgtccgtctttagaaaatattatcaaagggcttttgagggtgtttgtagcagtttacacacacagcggcatatgagagtcccagtcgctcagccccctcagcaacactcgatgttgtttttcaaataaaatgttatccattgcatagtggtatcacattgtggttttaatctgcatctccctgatgatggagaatgtgcagcacctttctctacacctgttggctgtctggccactctttgggaaatgtccggattgtttacccattctccccagtgtgtcgcctttcttcttaattgatgggagttagtcccacatcctacatgtcaggctcttgtcacacaaatggtaaatgtttcttcacactctgttcttgcctttttattttgttgaaggcatcttttgatgaagttcttagttttaataaagtccaaatgcatgtgcctgttctctgtgatgctcctgcctggggctgcagtgctagtactggtcaccagggggcagcagcctcccatgtccctggtgcccacggagctttgctggagcaggtggagctccgggatagcctcctgagaaaggcacctcctgttagtatcaatgatccccacattatgaggacaayggaagcaggaaggggtttaatcactttctccccgtgctgacttattcactcagcgactctgccctgagcactcaccttgtgccaggtggcctggtgggctcagcattggtgctgaaaatggcaaaggagtccctctccaccccaggagcccagtcttaggagacctgcacagaaccactaaagcaagtccacatgaaagaaaagagcaggtgctgtgataaaaatacggtaggatgacgggagggagggccggggagtcactgtgtggggagaatccaaatgcctcactgaggtgacatttatgccatggccagaatgacaatgggggaccaaygctgcccaagtcagggacagcrgtgtcagaaagaagccaccctggggcacagcctcacaggtggacctgagtttggcagaggaggttagaaaggggacagtgtggctgcagggaggctggggggagaggagcagagggagggaggagtcgggggaaatgagggtagagatctgcttgtctttgacaacattgtgcctccaaacttcgcaactttaagcaacaaatacttaatatctgacaatttgtgtccagcagaatctgggcacagcttagctggatgcctctgcctcactgcctctcctgaggctgggactgtggtctcaactgaaactggactggggaaggattaacttccaagctcactcatgtgggtattggcaggactcagtgtggactgagggcgtaaattcctccccgtctcttggcctgggcactcccttggcctctgccatgtaagcctgtacatagagcacctcataacagcagaactcgcttccccagtttaaggaatgcaatggagacygagagagacagagagagagagagagagagagagagagaaacaagagactgagagattgggggaggaaaaacagaagagagtgaacagcagaaaaatggcagctttggggataataaaagcataacagttgcaatagactgaatatctcccccctccaaaattcatatggcaaaatcctaacccccaatgtaatgatattaggaggtgggaggtaatgaggtcctgagggtggaattctcatgattgggattactagctttataaaataaacctcaaagagccaggcaggccattgatgccaggcactctctttgcagagctccatgcaggagatgggttcaacaacaccatctccttgaacgaagggcaggtgcaacatgccaycaaccayggccagtgctgggctagggtgagagcaggcacagaggggtctccacagacagagactcaagaagtccagggtggcccatgactcagacgcacaaatggggactccctgggctctgtccttcggctttcccacttgagtgacccacagtcccctcccaaaggaatctggcctccattagtacccagtggcaacttgtttaggtggaaagtccctgctcatctacttttaggaagatcagaggaagtgcttttgtgttgttttcactttacacaacgctatgattatctttgcatgttgctgctgtttttattgttttaacaacctaccccaggtgtctcctgtagcagacagctccactgtcctgccagactgcctccaaaccttacaagctgtcagtcttactggggaggttcttttttacaaagggtgrgggtgtcacacaaaaagagcsttcagctgctctatgcatctgtctgcaatatgtcacctcagagacctcacccccatagcaccatcggagaggagctgtgtcctcatatgtcttcataactttcaataagggaggcctctcaatgctgccggagcctcacatgataaaattctatttcgacatcagctatcttgtagcggtatctgatgcttttcagaataggccatgacagtttgttagcacttccatgatacagtgccacagactgaagggctttaacaacagaaatgcagtttctcacaattctgaaggcttgaaattggacatggagctgtgggctgcattggtttctctgaggcctctctgcatggctagttgatggtctccagctctctctgggtcacagggccttccctggtgcttcactgtgtccttactgcctctcttataaggactttagtcatattgcattagggcccgccctaatgaacgtaatctgtgtcacctctttatggaccacatgtccaaatacagttccattctgaggcactggtgttagacatgaacatgaactttgaagagtagacaaaattcatcctgtaacatatactaatgccttgcagaagacagactcccaggaaaggagttacttggtgaggaatatgcatacatgacattttcatggcttagtcagatgactttccaaaagggctgttgtggatacattgccaccagcagtcctgaatgtagctgcttcccagcatccagccacccctgggtgtcaagtcttctaatattttgtcaatccggtgtctgcgtgacaaataaaattccattgatcctttcatttccagcttccctgctgatatgtgtgtgtcacctttcggctgtatagtccccacttggattttctcctccctgagtcatcgctcagatccgtggcactgtgatgggctctttctcccacccaatgagtctcctggcattgggccctttgccgggtctgcaattgcggtagctgtttctcaagactgcctttatgttaaacaaagaarcagttattggctttaagtccaaagggttcttctagttttttgctgtgtcactgtctctaaaacagaggaggaaacaaggcctccccaggtccttttcctccgtgtcagcgcagaccaagcctcggggagttgagagggaaagtcacacagtagttcccgtgagcagttttggagctgccttcttacatccaaaagcctgtgtttgctcatttctaaaatgagggtgtgtttttgaggatttgctgggataatgctctttatacagtctatgaatacaagtccctgcgtgctagaagagaggccccaggcacgctcagttatctaggaaggttctggttggtgttcattcactaaacacacatatgttaagcatttactttgtgcaggcacttttatagatgactagcatattttaacaaacaaagcagatgccaacccctgggcctcaactccattctatccagggagtcagatcctcactggagacatcgaaagcaaggcacgcccacagagtgggagatgcaatgccctcctggcctcctctaggtataaacacttcctcccagattctgagcaggatgacagatcccaggaccaactctaaagtgggtggactctgggtccagaagaaggacttcctgggaccccaaaaggatgaggggattatacggcctgtggctggggagagactgacggaactctggatctcatacacctcataattcctccaagatggctgaggtctggggcttctgcaagaggaaagaagtcaaggtgagctgaagatggggcctcaygtccttgtcaaaggagaggggagttggagtcagagccggcccccaaaagacccatgcccagcacagtcacttcccagctctgcttgtcctcctccttcccacatccacctttcccaaccccagcaccagggggcccagacctgaagcagtgacgagccacctgctcacacgcctgcctggagccacagtcctggtgcccaggtacacgaagctgtgtgccctgggcctacaggaggagaatgtcagtgggtagctgagatccacaattgtctgtaaagtcctgctctatgaccaggtctgtccctgccaggacagcacaaagggcttggactgggatggggctgtcctctagacaggcagcagcacacaggtgctgtggatgagccgtgctggaggaaagaccaggcctctgactctgatgcccacttcctgcccccagcaccttctctttcattttggccacttggccagatcaatactctgtagatttctctcagcccccaagctttccatccttcaagcctaaggtgacctacatgtaggtcaagtggcctggatcaaagctgccgcagcatctgcacatttttcttgcctggatgaagcctctggagcccatcagatagagggagaggtagaggcagatagtgaggtggctgcagtctggaagattttctgaggtgtgggattttggggctggaattcccctaaattcagtgagttcactttggtgtttggaaagaccagtgcaaagtgatcgatgatggtaatcctatctcttttcccagctctgatccatatccagaagtaggagcatttccagtgctagctgttgagttagtgtcagcatgggatgagaaccttccagttacagtgctgcagttagagccacctccagagccttcttgcccttgtcctgggactgtgagaatcagtccagcaaggagatacctgacatcatagcatctgctgcaacctctcgcctcagccctgcagcaggaggctgaagagaagcagcaattggtgaggcccctgtccccaagccccatgctcctccagatcctgaacataggagttgtcacggagatggagagcagagcatgcraccccagctcctgggcctctctgaaaggcttcccaggggacaggcttgaccccgtgtgtctgggaactgcccctttttctcatacttggtgcaggctttgccttgttcatggcaggcttcctgrcaggaggtgaaggagcaggcagggtgggactccagcagctcctcctgctcccagaggccacctctttcttcagggactgaggtctgatttcagctgagcatctgggctagggtccttaacgggggaccccccccacagtatttcaatgtaagttctttmtattttcataagtgtcagctggctgagaaataaagagagagagaaagagtaaaaagagaggaattttacagctgggctgctgggggtgacatcacgtatcggtaggaccatgatgcccacctgagcctcaaagtcagcaagttttattaaggatttcagaaggggaggggctgcaagaacagggagtaggtacaaagatcacgtgcttcaaagggcaaaaaacagaactactgataagggtccaacaaagatcacaaggcaaagggcaaaagcagaattactgataagggtctatgttcagtggtgcacatattgtcttgataaacatcttaaacaacagaaaacagggttcgagagcagagaaccagtctgacctcaaatttaccagggcagggtttttccccaccctaataagcctgagggtacttacaggagaccagggcgtatctcagtccttatctcaactgcataggacagacattctcagaacggccatttatagacctccccccaggaatgaattcctttcccagagtattaatatcaatattccttgctaggaaaagaatttagcaatatcttccctacttgcacgtccatttataggctctctgcaagaagaaaaatatggctgtttttgcccaaccctgcaggcagtcagaccttatggttgtcttcccttgttccctaaaattgctgttattctgttctttttcaaggtgcactgatttcatattgttcaaacacacatgttttacaatcaatttgtacagttaatacaattgtcmtagtggtcctgaggtgacgtacatccttcagcttatgaagataacacgattaagagwttaaagtaagacaggcataagaaattataagagtattatttgggaactgataaatgtccatgaaatcttcacaatttatgttcctctgccacagctccagccggtccctctgttcggggtccctgacttcctgcaacaggtcctccaatatgctgcccaaaacaggctctttctggctgtcaggagggcggaggtatctggagggggtgcagcctccatagggtacaggtcccaaagcctccaagactagcagctgtgccctggggtctccatgcctccatcctgcccaaacacttattcatattgataagatttcaaatttatataataactttcaaataaagaatttgactttttaatgaaaatttccatgtcttctttacccctctatattgtcagatagcattgctgaggctatcctgaaaatacctcagagtttcatctttttgctgtggttgtttgtgtgattaaattacaatcattattgtaaatctttcaggtatggcttttagaggtctttgacctatatttggcattttttgactcttagatttattgtggaaggaaggctcatatggattcatttctgagtcagatcttaccaccttttggcatcaakaatttagcatcagagtttccagaaattatgtatgccacttgatatgtcagatgtcttagctagtctgggctactaaagcagcataccaaagactgggtggcttataaataagagaaatgtatttttcacagttctagagatggtgaagttcaagatcaagtcttcagcagattcagtgtctggtgagggctggcttcctggttcatggacagccatctttttactgtgttctcacatagcagaagggatgagggagccctctggagacttttctgtaggggcactaatcccattcatgaggtctctggtttcataatctaatcacctcctcccaaggtctcacctccaaagaccatcatataagggactggatttcaacataagaatttgagggggacaaaagcatttggtccatagcatcaggtaactcttgagtcatgtgcactcaaaataattctgtaatcttctgtgaatattcactggtctcctcttggttaaaaaaaattttttttaattgtaggtcttgattcagctaggtccaaagtttaacttctacagttgcctgcacaacttgtccacaggacaaaaggaactttagaagcaactgggcatttggagttttaggaaagttgttgggaggatttggggtctggacaaggagaagtagagggaggagaggacaaaggtaaagcaggaaagagatcagaatggaaaaggggaggaaggacccctgtatataagtgtcagctggaggacaaggaaggggagggtttcctaagaagatgagtttagtttgttgttgcttcagtttgctgagttgcccattatgtttggtcagataagtattttttgggacaatattttttaaattttttggagacagggcctcactctgtcatgcaggctagagtgcagtggcaccatcatagctcactgcagcctccaactcctgggttcaaatgatcctcccacctcagcctactgattagctaagactacagatacatacaactatgctttgctaatttatatatatatatatatatatatatatatatttttttttttttttttttttttttggtaaggactggatcttcctatgttgtccaggctggactaaaactgacttgaagcgatttttgtgccttagcttcccaaaatgctggctgtccaggtatgagccactgtacctggactaatgagaagattttttattccaaatgtcatttggaatcctctgcgtaccaaccaacaactactactcactgggcctgagaaatcttatttcctttcttgttaaggcacctctcaattgaggaattttgtttaaatcaaatataccccagagtggccacgggaggccaaatcttgatctagtgatgccgtttagaaagatgggcacgggaatgagcattgagaggaaagtacacacaaggagcaggagtttttcctagaagtgcaaaggacttgggcttagccagccccaggggagcaggggctggatgcttatgcacctcgtgcctgacagctgctcacctctgaatgaagacacaaacatttgtgcctctggcaggtagaaaaaaacaccatgcactctctggatcccaataagaatgcacagaaggaaggagaaaggagaacctaatcgagttttattggtgacccacagcacaatgtgtccaaacagatgcctgaccagtgagaaccccaaagtcaccacgtgacgctggctcagaaaacagccttttaaggcctatgactatgttctaccctctgattctccttgttatgacaacaatctttaatggcacaacacacaacagtatcataaagtctagtgaagacagagtagaagccctgtttacaatgcatggtaccattagggaagataaatcaccttttaaccagcacttttgtattttggctccaagcagccaaagaggagagacaagcatccatcacctcgtgcaagcaacaccaaatgccacaccaaccaaccaatcagggaggcacggactgactgcagcaggggagtgtggcaaagaaaacccaaggatgttcggatgaatctggggacagccatgtggtggtagagagcggtgcgaagtgttgcaaaagttatggaatgatggcttttgtagttagctgtgcattctcaattatatggcacttgaaatcttgcttccaatcattcccccaacctttctatttagagataaaatcctcaaagacagaagcaatgtttatttcagctgtgtattttggaagtggtttgtggaacctaacacatataagtgatcactaagagaatcagcatttagaaattcctatttgcacatggtatttcgtagtagctcatgctcttcagctctgattcctttcttcaaaagcttgcaataaacctggacaagaattgtatggtggtatcggctgccctacttttaaattcccttaaaaatgtattaaaaggttgattagccagaatatgtaggacttaacctatcctgggatcacagcatttctgaagctaaggttccttaacttcaaaaaagcaccataaaaggataagaaaagacaacaacttgacataacatatattttcttataattgcagtctgatgtcttgaacagctgttgcctgccaaaatggacaaagaaccaagagcagctgcaggccacgcaccaccactgggattgctgtgaccttcctgccttgcccctgggtcttaaatcaccaaactctatggctcacactgggctgacactgctgaccttacagccttgcaaatgatgtcatcaccatacgttcttcactcatgacgtggcatggatttgaccaaaggygtgatcatgtttaaaataaaaaccctttatgagagttcccttgtgcaatgcttccagtgtttaggcactgctgggtcaattttctcattattcacataagcttgcatttctgccttaagaacccattgtttgagtcacttcttatggtccttatcacttttgatctcgtgttagagcaaaatgcacactgccatcctctccactagtttrtaagctcttgaagcagggctgagtcagactcatccatagatccccygaagtgcctggcactctccaagtgaatagaggcacttaataaacttcagtagaatcagatttaatttaatggaagttgattaaaattcactttctccttctcctccttcactgcacaggaaattcaagtcagcatgagctgaagagcatcttcagcatcgaaactaaggaggattgtttttcagcttcttgctgtagctagatgacatgatggcatttagtgttccaggcctgcatttgaaacctcgacatttaccttaacaaggtaggtgaccctgagcaaatgttttcacatcagtaaacctcagtttccccatctgtcagcttaacaattgtacggatttttaacaggataacataggtgtcaagcatccagcatagtccctggatcacaatgagcatatgatctatcaaagttaccaaccacatcctgcggctagaattaagctccactgtggtattacttgaacctaaacttcacactgtgaaatagtactgtataaagaccacatayctaaattggaaactcaaagtttaaagaaaaaaaagactctcacactccttaattgaggggaagttaaagaatattgaccattacattcagttggttataaattggcaaggatgtagagtggtttgtgtgtgtgtgtgtgtgtgtgtgtgtgtgtatgtgtgtaacaggtgtataggcagagtgcactttttttttttttgagacagagtcttgctctggcacccaggctggagcacagtggcatgatctcggctcactgcaacctccccctcctgggttcaagcgattctcatgccccggcctcctgagtagctgggattacaaatgtatgccaccacgcctgtgtaatttttgtttttttggtagagatggggtttcaccatgttgcccaggctggcctcaaactcctgacctcaagtgatccacctgcctcagcctcccaaagcgctgggatgacaagtgtgagccaccacacctggccaggagtacatttttaaaacagaggttggtctactaatgtgaatgtagaaaaccctgcaatatcgacaatgtgtttaggggttgtatgtgtagtaaatggtttgcttcactcaatatctaaaagaacaaactttgttttttaaatattccttgatgggtttcactcttattcattttaactcaaacctccactcctttactcaagcttaccacccggcaccctcggtctcagctgacacctctgccatacatgtcattaggaagcttgaagccatccctagccttacccatccccagtctttctcttgctgccctgcatgtggtgttcctcctcttttcaagacaaagctgctcacctgaatttcccttcctcagctcctgccaccttcaagaccacgctctgtcagttatcatctctctcctaaatttttaacttctctctttttcctctgccagatgcataaccaagtctgtcagattaacctataagctccttttcaacccatttcaccatctggtcatagcccagttttagcttgccccattgctttactcaggacatccccaaatctgctgttctcaccgctcccctgacaaaaactttcatctgagatgagtctttctgtgtagatggagctatcacgtattttgttataacctgacagcattgtgaacagggccagttgcttggcagggctagagaacactcttgtagaaagggatagatagatgagcacacacctgctggcccacgggtgatctgctctagggaggtggtggtcatctgatgcactccatttgcagttcagcccatgtgtggagtcatcttctcctgccaacattcccaagagggctcaccactcaccttcagagtcaagcagttgtggatggaaattgacaggagtaagtaagcattccatcaatatttgacaatcactaggctaagtgccaggtttataacaatgaataggacaggtgggatgtctcccatgcagtttactgtttgcccacgagcctttcccccattttctacctccagtggccttggtgctctggggcctattctatgcctccactgtcactggctctatgtgtttgctctctgcagctagccttcctgctgttgacagtgtcctcccttgtcatcacagttgattgacccagaagctctgactggagcagggagggcttggagggtcagaaaaaatactattaattatagagagggttaaattgtttgctcagtgtcattcagtcagtaccagagataaaaactccccaaatccctcagattaggtcaaatcctgccataggcacctatagtaccttgcacctcttttttttttgtaacaatcatcattcttgtagctatttgtttagtgcctgtgttcaccggagtccaggctctactagagctggtatcacatctatccttttcactgtgcatctagcacactcttggtatagattgctggacaaaaatatttgattttattttagatttttaggcaccttgaaatttttagttaactgttttttaaagcggtttcctaaatctgcaaccatttcccttgcataaaatgggtttttgagtcaggagatcaggcactactgcaaaaaagggcctaggatccaaggcagatttagggagaaggaaatgttctaaacaaaaacaaaaaccagtggagccagaggtgtggataaggtatacgataagctgtgtggactcagaggtcctgggtgtgtaataacacaagatttcctccccacggcacacagctgcttgtgctcaagtcctgccagttgacagaaagctcccttgtcttgtgactactgcattaggcagaaggagcaaagaaagggcacaacggaccacgggcaaggtaaggagggaaagacagttgctttgaaaagtcaccagcagccgaggatcaaggccctttcagacctggccctacatgttggggaggtacttgagagcatcctttaggaggaggcagtagggggccaatgagattttgaggacagagcagctgctcacactagagaggccagaaatcctgaggttggacagaatttgctattgtttggatggtgcttcttgaatttttattcttttttcccctagggatatggctgctgtatattgttaatgatcagctggtttggtttctgagtactttcagggtgccaaggctttgtatgggttcctcagttgcaaataggttcatgcagtgacttccccagacactgcttcttgtgatatagttttgtttgaggtgtaatttaggctgcagtctagtagatggcatttaagagtaagaactggcaggtaggggtggggacagaggcaatggagaagtgtgtgtttgggatttaaagaacctcaagaaactgtgatattatgaaatatatatctggtcttcatcttgattcctggcataaaastcctataattcttggaatccaaaattttaaatctaaattgcgactgtaagaaaataacgtggtgctgccttgtgctgcctttcattctaaatggattttgggtgacaaggtttaacagagtagaatcacaggaatgattttctmatttctcaaagtgagatagtttttatcttggaccccccaaacattgaagaaccctttcttatgtggatttctaaatagtgtacagcacagtagtagggtttatttcctaaatggtaaaacaaaatcacagagaatctgagtaaccttggattttcctgctttagccacttggcagagactaagctttctaagccaaggaaccagacaatcacagcgttattgggtaaactgtagctgaccttgtgtaagccttctctggggtaacatatgaccatgatttataagtttctcccactatcaccgacacatatttttctgcttttttggtgtgttttctgttgtcctctttacaaaaaagctaaaggctttttttgagagacagtaccaggtatttactatggctgaatgcatcatacctaacatcactacatatgagacatctcttcaaaactaacaggtgacagaaaagacaacccagtcaactgtgatcaactaggaagtgaaaaaatatggagctccatattttaatatgcacaacctgaacaaaattgtgagaatatagcacaggcatgtgtgttacagatgccatgataattctcacaccaaattgtaaaaaaaaaaaaaaaaaaaaaaaaaaagcaaaccctaaagtgtttaatgtgcctcatatctttgctacatcaaatttttggatcagaatttataagatctaccagaaaagtatcaaaagattattctcttgcagtgcaggttatctacacactctatgttctgaatgtgtccttttaaaaatgaaaaaattcacacattttaacctgaggcaggaaataacaattgtgaagcctcaagcaagcatttcagtttagtggtggtgagtttgaggaagaatcagagcccctggtatttctctcagcaggaagtctgaagtctgggcccagaagcaaaactcagttgatggaattttgtctacatcaggaaaaaatgaatttgggatggactagttctcagctacatacaaccaagagtattaaaattataattcaatcagagagaccataacagttcattcctttggaaatcatacaataaatatgacatctttttttaaaaaaatttatttttgttgaaatgggagtctcactatgctacccaggctggccttaaactcctgggcttaagtgatctgcctgcctcggcctcccaaagtgctgagattaaaggcatgagccaccatgcccagcctgacattatattttctaaactaatatacagctagaatattatgcactctctgaataacagaaaaagaggttttaatataggtagattttttaactttaataattttaaaaaccaaaaagtttaaggctttaaaggaataataatcaaaacctataaagttacaaacaaagtacatttcttaaatatctaccactccagttctttgaatactacaattggttgcacacattaaacttgtgcggcgattaatgctttccatgtcttttccatctgcttacagttatgccacagacctctgggcataaggactagccaggtctgtctaacacatacttcggtgtgacttaacaaactggtttctactacattcagcctgaagtgacagtgctttttaatgttggttgcaggcaggggactgttgccccctcccaagcacttcagcttccttgcacggcctctccttggcttctgtctgtccctgccagcagcatttcatgggacccatcctgaccctccaagaaagcagaaaagggggttcctgatgtaaaaagtaaagaactatcatctgaagaaggtgagtccttttaaactgtgagtcctggagccacgttaaaatgagagcaatcacaccttactccctgctttgagctatgtgttcatctcttaaaactgcttgctattgccacaagtagctatcaattaattttaatttgggataattagcatagtgtcttatcagaactatagcccatattctttagcttaacaatggatagccaattgctcatcaattttatttctgtaaaccaaagagagttcctgatcaacaactttgtaccagcccactctctctgtcccccttttgtctttaaaaacctgcttggaacaaaggctctaggaagctcacagccaagggtacttgggtctgagtcttccaggcagctgtcctcactttggctcaagtaaactctttagattgtactctgtgtctcagcttcttcctttcaggtggatactgaggggagtaaatgaatggctcctgctctttctctgtctgaagcttggactattcatgagaggacttcctactccaagacataagggagtcttgctcagaaggaggagctcctgtctgctgaggacacrgttccatccaatgaggtcagcagggctatcagcagcttccgttaattccgttggggcaggcgcttggcaagcggcagttatttgagctgaggatgctgggatagattttaacatgagcagttggcccttagatcatgagaccagctaaagtgcccaaggaaatggaacagcagggagaggggacatcacacacaccaccaaaacctcttgttagtctctggcttccatatccttccccaaaacctcagcccaactcagcctcatttttccatctcttctcccttcctccatgggagagctttctgttggcacaggaatagctgagaartgggaaagatcaagtgtagtaaaagctgccccagataatctacagaaaactttgctggaatgaggttgtgcatctctgaacctgagctagatttgttgggtcagggaccatatttaactggctcaagaactgacacaggaggtgtctaataaatacttgttggatgaataaacagctaagtgagtgcttacaaaagcaaagctccagtaccctcaggccacacctactggaaaaatatatgtcagccccagaaaattgtgggcaagatgaggcaagtcctgagcaacacaggaaactgccctcctccttttctggccccgcttccactgtgatgctaaagatcgcatcaaggctggtcatccaatcagcaggatgtaagagggtcattcttcactgtggccatttagaagtttcctggaaacctggctttctcctgaccattgccccatgagcatggtggtgacaagcttgggctctgaaatcagacagccccaagtttgaaacctcaatattcttacttgctagctatgagactttgggcaaattcacctctccaaatctcaatttctcaatctgtataatggggataatattgggtaatgcactaagcaccatgtcaggaatgtagttagtgttcaataaacgtttatctttattrctgcgaaacctcattctgccattcccttctttgtcttcctctcccaaccccccagcttcatcatggcctatgaacagccaaagggtaaaatgatcagaaaactggacagtttttgacagtctgtaagtaactactgtggcctactcaactgcctggccttttgaaaagcacacttagaagctggtgatgtccatgggaccacataccgggaaatgacagaggtgtatatttacaaagtaactcttgacccaaagtacctctttaaaagaagacaagcatgttttgctcccatgatatcttatagtggcacctagattgctgagggcctgttgtccagtaagtaatgtcacctagagggggtatgattggtttggagtctgggtctgagaactggggtaaaccacttcttcatgtcgtagtccccttatacataaaacagagggattggaccagatggatcactaaaggtccttccagtgttaagacttaaagggtaaatggctctttgataaagagagatcataaaaaagtaagatccacacagcttaacctcccagggggcaattaagatgctttaatgtgaagtgaatgacgacgtggtagagtttgatgtgaatgtaatagcataggaaggccggagggcatgggggcctctcaacctcattctctgtactagatgcggcatctggagcatctcaagaggggctaagagattctgtcctcaccccagctctgaagatgcctccaccatgagaaagagacagggagcccctgactctctctgctccttcaccggttactcccacgttggaaggcaggagaggagcaaggccccagcatcttccatcactgctgcagacaccaaccaaccctccttcctccccacctctgcttcaactctcacctgagtccccgccccaaatagccctctgctagccattaggtgttagctgcacttcacttgcaaaaggttttcctctgccaatttttttttaaatttaaaagtaaactttaatattgaaaatgcaaacttggggagggcagaaagatcacacacaaggctgtcgcttcacacttggagggttgcacagtggctgggcaaaggcgctcctcacttcccagacaatggggcggccaggcagaggtgctcctcacttccgaaacagtgccttggccgggcagaggcgctggtcacttcccggatggtgcggcggccagggagagacgcttctcacttcccagacggtggggcggccaggtagaggcgctcctcactccctagactgtggggcgkccagggagagacgcttctcacttcccagacagtgcggcagccaggtagaggcgctcctcacttcccagacagtgtagtccctgggcagaggggcacctcacttcmcagatggggcagcgaccgcagaggcactcctcacttcccagacggcgggggagccaggcagaggagctcttcacttcccagacggggtggcggccgggcagaggcgctcctcacttccgagacggggtgtccttcgccaatttttataaaaaattttggcatagtgcttgcataaatttgcaggttgtattcaagacgccttgactccaataacataagagaaaacacaatgagggcacttgcagtcaaaggaagttttcaggagggcacacttgatttgctacacggggctgggagaggcactgggtatgtgaggctgggatgcccacgatccaggaatacagagctttttcaacgttggcttgaagtcatggctaataggcagaaaaaggctcctctcaccatgagggaagactcaggaggtgtggaggggaatggggtccatttattccatccaagatggggcaaggaaggacaggaggaagcccaagtgtggagctgtttcctcccaatagtgaatatctggtaatttacccagaagttctgatttttctttttagtcaaactaggttctgatttccaagataaggcgaaatccagagcagtttgggaaatgaaggaatctgactgaacaataagagtcagaaccrttgccctaccataagcaacaccttaacagaaacaaattcctttgtccgttcattctatccacagactattttcagagaagagaatgtcccagctagaaatgcaagtggacgagtgccaacccgatgaggccaatgatttgcgagtggagacctctgaggaacttggtaaagaaagcagggctttggccttcgcctgggaggcttgggacccctgaccaccccctgccccatcaccaataaacagacaggaaggaggaattcagggacagccttcagaaaggagtggctatccactggccacagcgatgactaaagagaggttcatgccacagcagaacacaaacggcgccaaagctgtctaaagcagacactgagtttattatttgctgaagaaggggagtgacccatttcattaagaaaggtcagaacagctctccaaactgaaggtaaacaggacggacacactgtggaaaagaggacattttgtttaaaggtctgattggcttaattgtaaactctcttgagggagtggctgctgttctggttgtgtgtcacagagrcttgagaacagctcgcaggagatcctggatgatctgacctgtggtgcacggccctggcagcctggtgtctgtgcctcctctcgttgagatgagatttttctctggcacccacttgggttaagagtgagaagccctggggcccatgggcctgctgcatgactctgtacccatcacctggcacatatgcagacttcctggtcacagggatgaggaaaccacatgaaaagcagttggagaaatttgttaccatgcagccatcctattttctaaacaggaaaactgagttgcagagagcgaagccccagtaagttggaggatagatgattaaaatgctgctgaataagggagaaaaaggcaaactggaaagacctaaccccaaattagtcatgtccaaatcctggtaggaagattacaagagatttttattttctctcctgtatggattttctatattattcttttctgttggtattctgtattctccaaatttttttactatgtgtggttttgaaaccatatttacaaaaatttgaagcatcaaagatgagctcaaggtcaaggtcactattaagtcaaaggcatgcatagatcaggcacagtggctcatacgtgtaatcccagcactttgggaggctgaggcaggcagatcactggaggccaagagtttgaggccagcttgggcaacagagagagaccccatctctactaaaaattcaaaaaattagctggtcatggtggcatgcacctgcagttcagctactcaggaggctgaggcaggaggattgcttaagcccaggagtttaaggttacagtgagctatgatcccttctccgtactctagcctgggtgacagagggagaccttgtctctgtttaaaaaacaaatctgtgcttagcaaagtcaggatattttcccagaacaggagttgagaattcagagctggtggctaagtctggcagccctatgctggctagagcctagggctccatctccagcgtcccagtccaattaccctcttccttgttagcaataagcaatgcacttcttcaagctagcatgctgctgtctcctctattccaatttcttgtcctcgctgttcactgccttgttacctggtggccctgtccaacatcaaggactcaacctttccatttcctcccaggaccctcgctgagtccccttagcctcttcacttgcttctgcatggcccgtcctgtcagttatttcagcaatccctcatccccttgacctcaccgcctgcccctggggacaatcacaagaggactccatttgactcagtccagctgccgccttctctgtcctgcctgaagcagctgagcgctgttgagaccacacggcctcatggatctagacgggcatgagctccyggcctctgcttcatccttggtgctgcccgtaagtcctgtggtctctggccagctttatgtcctactcccccaatggctataacagaccttcaccagtctcctgaagatttctttcctactgactcgcccctccccagccctagctcacaatgaacttaccctctgcttcaaggtagaagtaaatttccttatgtggggggaacgttcaaaatttctagcctccctctgcagagcccctctccccggcagcctctccttctacagctgtgggaggaggccttacttttgagtaaagctaatgcctcctcacagcactgagtcccctctcgtccccatttctcagggagcttattccatttctagtcctctcgtattttaaatatgaagccagaatacagccatggaactgcttctccctcagagcctccagtagaaactcaccctgccaacaccttgactttgcacttccagccagccctaggaacccaatacaccaactttcaagggcctcatcccactgacgtccaagcaggcctagatctatgtatgtgttgtctcagttctgaaagctcccatgagcctgcagagagactgcagggtcttcctgaatcgtgcctgaggatgagagggagacttagaggattgcccagatattgttccaccatttttctaaactctgctggcctctccccctcccccaagaaggcttcctgctaaattctgccctgcaagttggccctgcagcattctcaagtgctgcctgcccctgtgaacttaaatggattgcgctgttctttgcacaagagcaaaaacatctgcctggagtgcagcttgtcctagtggctgggacttccctgatacacagctctcccccatctgctgtggagtggtctcactgacatctggggaagcaactggaagaagcttcatccctatttccaaaggttcacagtgactggcagctggtgttgagacagacccgccgccttctgtaggtggactttggtgctggccttggttgtctttttatggacatattgtgaggagtgtgattttcgtcctcctgccccagcagtgtggcagtgcattttttattctttcaagcaggttgtttcatggtgtttcttggcatacgatgggaacagaattaaagatatgcctcttttggggcgtggctttggcaccaaaggctttccggaaggagctgctcagaccaaggggggctcccctgctaaagatgggagggaggagtcaccaggagtggccaccttacctatggaattgattgtagccatcctaaggaaggtctatgggctcttgaggaaggcaaaggtcttgtataataactgacccacaagctgtcttttgcctgtcttttgccaatagcagtgccaagctgtctctggctattgggcagctgatgagcaccgtcatgaaaaagtggggccgagacgtgctgcaagtagtgtggcgctggggcaggagctctgcctgcagaacaggggccaggctccctcctggctctgtcactcagcaggtgcagggccttggccagtcccctgtcctgtgttagtcatgattcattcacctatcaaatggaggcttggcctgagttttctctgcagtcctactgagctccagctttttaaattctcacctccctactgcctcctctgctgtgggccagtttctcagctacaatatccatgttcaagggtgtaggcagtggaaggcctcataggcagggcacagggaagccttgtgggttcattcatgcagctttcctgagacagctgggggcttagactgtgactgcaaaccaacaagctggtggagtgacggtggccttggaatgcttttcmtttttaggttgacatgttaaaatgggaaaaatctgcttacaaatctacatttcccacttcgctgaaagaactttaaaatggggtcacttagaacaacctggactctctcacaaccttcctccttctctttctgagtctcttgacacacctggccttcactaatttaggtgacttgcctggtgtagctactagaaatggaagaataccctgagggcatctgggaggcattgccctgtagtgggcttcccagagaccatgtgttagggatgtgagggccaggccagagccttgctgcccctcctgcaatgccagctgtccctgcagttttgtgggtggaaagttgatcccagctgacagtggcagccttgaagtgtctccaggagggtctggtacctcttgagtgttggaagtaaatgctcggtgctgccaagtgaaaatagcactcaggcaaaagttttctcagcaaggcaatttacttctacagaagggtgcatctcacggatggagcaatggcaagagcacactggacaagggaggggaaggggttcttattcctaatgcagctagtccctactgctgtgtctttcccctattggctggggttggactgcacagtctaagctaattccaactggctattttaaagagagcaggggtatgagccagagaggcggggtgagtagttttggtgggaaggatggttacagagcaggtgactaaggatgactaagaacacagcaggtgactaaggatgactaagaacacagcaggtgactaaggatgactaaggacagagcaggtgatagaggctgggagggggttgtttaccaaaactaggggcaaagagacgtaaagaacaaagttaaactttaaagtggagaacaaacaacagggaagctgaacatactgacatgttggttctttgaagaggaactcagaactcattgtacttaacaattttccccctcttgaattttttttcaagtttctgataactttatttctttttctttttattgtacttcaagttcaagggtacatgtgcacaacatgcagttttgttacataggtatacatgtgccatgttggtttgctgcacccatcaattcatcatttacattaggcatttctcctaatgctatcccttccccagccccccactccctgacaggccccagtgtgtgatgttccctgccttgtgtccaagtgttctcattgttcaattcccatttataagtgagaacatgcggtgtttggttttctgtccttgtgatagtttgctgaggatgatggtttccagcttcatcaatgtccctgcaagggacatgaactcatccttttttatggctacatagtattccatggtgtatatgtgccacattttcttaatccagtctatcattgatggacatttgggttggttctttgctattgtgaatagtgtcacaataaacatacgtgtgcatgtgtctttatagtagtatgatttgtaatcctttgggcatatacccagtaatgggatggccgggtcagatccttgaggaattgccacactgtcttccacaatggttgaactaatttacactcccaccaacagtgtaaaggcgttcctatttctccacatcctctccagcatctgttgtttcctgacttttttttttttttttttctgagacrgagtctcgctctgtcacccaggctggagtgcagtggcgcgatcttgcctcactgcaagctccacctcccgggttcaygtcattctcctgcsacagcctcccgagtagctgggactacaggggcccgccaccaagcccagctaatttctttgtatttttagtagagacggggtttcactgtgttagccaggatggtctcaatctcctgaactcatgatccacctgcctcggcctcccaaagtgctgggattacaggcgtgagataccgcacctggccgtttcctgactttttaatgatcagcattctaactggcatgacatggtatctcattgtggttttaatttgcatttctctgatgaccagtgatcatgagcattttttcatccatctgttggctgcataaatgtcttcttttgagaagtgtctgttcatatcctttgcccactttttgatggggttgtttgctttattcttgtaaatttgtttaagttctttgtagattctggatattagccctttgtcagatgggtagattgcaaaaattttctcacagatggtagtttcttttgctgtgcagaagctctttggtttagttagatcccatttgtctattttggcttttgttgccattgcttttggtgttgtagtcatgaagtccttgcccatgcctgtgtcctgaatggtattgtctaggttttcttctagggtttttatggttttaggtctaacatttaagtctttaatccattttgaattaacttttgtttaagatgtaaggaagtgatccagtttcagctttctatgtatggctagccagtcttctcagcactatttattaaacagggaatcctttccccatttcttgtttttgtcaggtttgtcaaagatcagatggttgtagatgtgggttttatttctgagatctccgttctattccattggtctataaatctgttttggtaccagtactatgctgttttggttactgtagtcttgtagtatagtttgaagtcaggtagcatgatgcctccagctttgttctttttgattaggattgtcttggcaatgcgggctcttttttggttccatatgaactttagttttctccaattctgtgaagaaagtcttttgtagcttgatggggatggcactgaatctataaattaccttgggcagtatggccattttcacaaatattgatttttcctatccatgaggatggaatgttcttccatttgtttgtgtcctcttttatttcgttgaacagtggtttgtagttctccttgaagaggtctttcacatcccttgtaggtcggattcctaggtattttattcttttagtagcagttgtgaatgggagttcactcctgacttggctctctgtttgttatcggtgtataggaatgcttgtgatttttgcacattgattttgtatcctgagactttgctgaagttgcttatcagcttaaggagattttggcctgaggcaatggggttttctaaatatgcagtcatgtcatctgctaacagggaccattttactccctcttttcctaattgaataccctttatttctcttgcctgattgccctggccagaacttccaacactatgttaaatggagtggtgagagagggcatctgtgtcttctgccagttttcaaagggaatgcttccagtttttgcccattcagtatgatattggctgtgggtttgtcataaatagctcttattattttgagatacgttccataaatacctagtttattgagagtttttagcatgaagggctgttgaattttgtcaaaggccttttctgcatctattgagataatcatgtggtttttgtcattggttctgtttatgtgatggattatgtttattgatttgcatatgttgaaccagccttgcatcccagggatgaagctgacttgatgttggtgaataagctttttgatgtgctgctggatttgatttgccagtattttattgaggatttttccatcaatgttcatcagggatattggtttaaaattctctttttgtgttgtgcctctgccaggctttggtatcaggatgatgctggcctcataaaatgagttagggaggattccctctttttctgttgattggaatagtttcagaaggaatggtaccagctcctctttgtacctctggtagaatgtggctgtgaatccatctggtcctggatattttttggttggtaggctattaattactgcctcaatttcagagccttttattggtctagattttctagtttatttgtgtagaggtgtttatagtattctctgatggtagtttatatttctgtgggattggtggtgatatcctctttatcactttattgtgtgtatctgattcttctctcttctttattagtcttgctagtggtcgactaattttgttgatcttttcaaaaaaccagctcctggattcattgattttttgaagggtttttttgtcattgatttttgaagtgtctttatctccttcaattctgctctgatcttatttcttaccttctgctagcttttgaatttgtttgctcttgcttctctagttcttttaattatgatgttagggtgttgattttagatctttcctgctttctcttgtgagcatttagtgctatacatttccctctacaaactgctttaaatgtgtcccagagattctggtacgttgtgtctttgttctcattgatttcaaagaacatctttatttctgccttcatttcattatttacccagtagtcattcaggagcagcttgttcagtttccatgtagttgtatggttttgagtgagtttcttaatcctgatttctaatttgattgcactgtggtatgaaagacagtttgttgtgatttctgttcttttacatttgctgaggagtgctttacttccaattatgtggtcaattttataatawatgtgatgtggtgctgagaagaatatatattctgttgatttggggtggagagttctgtagatgtctattagatccacttggtgcagagttgagttcaagtcctggatatccttgttaaccttctgtctcattgatctgtctaatatggacagtggggtgttgaagtctcccattattactgtgtgggagtctaggtctctttctaggtctctaaggacttgcttcatgaatccgagtgctcctgtattgggtgcatatatgtttaggacaattagctcttcttgttgaattgatccctttaccattatgtaatggccttctttgtctctttagatcttcactggtttaacgtctgctgtatcaaagactaggattgcaacccctgctttttttttctctccatttgcttggcagatcttcctccatccatttattttgagcctatgtgtgtcctgcacttgagatgggtctcctgaatatagcacactaatgggtcttgactccttatccaatttgccagtctgtgtcttttattwggggcatttagcccatttacgtttaacattaatatacttgtgtgtgaatttgatcccgtcattacaatgttagctggttattttgcccattaattgatgctgtttcttcatagcatcgatggtctttacaatttggcatgtttttgaagtggttggtacaggttgtccctttccatgtttagtgcttccttcaggagctcttgtaaggcaggcctcatggtgacaaaatctctcagcatttgcttgtctataaaggattttatttctccttcacttatgaagcttagtttggctggatatgaaattttggattgaaaattcttttctttaagaatgttgaatattggcccctactctcttctggcctgtagagtttctgctgagagatctgctgttagtctgatgggctcccctttgtgggtaacccaacctttctctctggctgcccttaccattttttcctttatttgaaccctggtgagtctgacaattatgtgtcttggggttgctcttctcgaggagtatctttgtggtggtctctgtatttccttaatttgaatgttggcctgccttgctaggttggggaaattctcctggataatatcctgaagagtgttttctagcttggttccactctccttgtcactttcaggtacaccagtcaattgtagatttggtcttttcacatagtcccatattttttggaggctttgttcatttctctcttttcgcccccgggttctgcccagggtggcctgatggaaagccccgacattagaatgggaaccatcccttaaaacctgtcttttccaaaagccagtttgaatttacatctttaaaatctccaaaatatttattttacaaggcaggagctgtgccccaaagcttgtggcaattggggacctaaggttccttgaaatcacctgagtgtggaagtggtgataaggtgctaaagagatgatctgaactcaccaggctgatgtggatagaatgggaggccccagttctgtccctccatccctgaggcccctccccaacctccctggaccccctgtccacagaggcmgtgctgtgtgccagcctcactcctgcattctggagatgccgttccaagatggaggttccctcacaccttcccccacccagcaaactccattggacagatccacaccagcaacagcttcacagctaggccctggaggtatggagctcacagacctcccactaactaagaaaaacacrgtagagagccagaagggtggcaggttccaacagagcccccaccatgtcccccacccagccccccatccgaccccttccctccacctggactcagcaccatcctgagtccctgtgtgagaggcacgttgagttctatggaagaataacaaaagtgagaacaactggtacagttgccatgaggccctggatgcccaggggactggaggctttgacggcctctgactcggcccctctcgggggatcctgaagactatggggatgtttgcctctccacacacacacagcatcccattccctggctgccactccacacggattaccttcctgcaccagaggtttcaatatttcttgaaaaggttggcaattttgaaatttttttcatacatttattccttatgatccactcctctgctttcttacaattgagcattttgagaataatttaaccttttcatcatgacttggggtcctgatgatgaacaccattattgtgttgagatgtcatttcccccagagtgcagggaccatgtctcagtcctctgtgtgctcctcggcacctcggccagcccatggcgatgctgtgtgtgtctgcggggttgcactgacagaagccaacagaggctctggcataaaggctgacagcctgctgctctgggcggttctgctttgtgaatatgtgttccttagtgtctttccttagtatcctctcttgctatcagtctatcagctcaccaaatcttgaggcccctctttttattttcactttttaaaaattgagatatcattcacctaacataaaaatcacccttttaaagtggttttcatatatattcacaaaattgtgcgtccatcactactatctaattctaaacattttcatcacctccacaaagaaacctcatacgcatggtcagtctccacacttctttcccctagcccccagcaaccacaaacctaccttctgtctctctggatttgcctgttctgcacttttgcatagaatggaatcctgtgccatgtggtccctttatgcacgatatccaacccagagaaaggccttgcttcctaagccctcctgagactcaccagccacgagcccgcatctatagcaagttcttttgaaggccctctttactgctggacattcttcctttgtgcaacaagtcaataaacccattttggttcagctacaggtgagttcttggtggttttttagcttaggaggattggcagaaatagaggttccctgagtcagctgaagccctcccccttggacaagaacccccgcctcagttagggtggacacagctgagacatacagggtgtctccctctgtctgaggtgccgggtggcccacagctggaaggcagctcgggctgaatggaggctgatatttccttgaggccccatggaggctgatatttccttgaggcccctccgcttcaggtgtgctctgttctgggaatgaggtgctgtgcgacttttcctggtgatctgatcagatttgccccgctccacggtgaaactgctgtctagccttctgagaaatgctcctatgtctatctggtggtcgaatgttctaagcgttgtctctaagtggaaaattcagtagttgataggggcccgggaagtctgtcctcaagctggtcttggaggtcacagtgctcaggagttcccctcagactagcattcattggaatgagctttgccccaggtcactgttttcatacctaagggtggattttcccctcaactttgtctctgtgtggttcctgagaactgctcactttaaagttccctctgcctggaatcaggaggattggggacaatcagcctgtggcctctgaccaagctctggaggcacgaagtctcttctcggactgctcgggtgcccgtgcgaccttcttcatcggaagtggctcttccccaggccaaacgcctgctgctttcagatttcctcactgtcgtgtgaactcatcttatgcctctgacacaatttcttgagacaccatttgaaactgcagtggccgctctggggaattttcacatgaatgaggttgttcgtttgagaggttctgtacagcaaacatggaaggagccccgtgaagagcttctcttgtgggamagagacatcgatgtgtttaatgcaggagacacagtcccttcctcatttgtttccatacttcagggactaataagtgctggggttttgttgtacagattgataaaactgtcgaaggccaaactgttgtccaaaacaggataatttcactagctttgagagtatttgtcaaaaatatgtttttctaacttttctttttttttgcaaaataacctaattagcctgatagtcataatttcatacttactggaagccagttccctctacttttttatttaaaacaagcttacatttcttattttaatatttatgtatgtatgtatgtatgtatktatktatktatttatttatttatttatttatttgagacaggatattattctgtcacccagactgcagtgtagtggcacaatcacagctcaccacagcctggacttcccaggctcaggtgatccttccacctctgccttttgagtagctagtactacaggtgcccaaccaccacacccagctaagttttgtattttttgtagagatgaggttttgctatgtttcccaggctggtctcaaattgcttgggctcaagcaatctgcccacctcagcctccaaacttagaattacagacgtgagccacaccatccagcctctaattttttgtttctatccctccatttttcttgggttagacgacattgactcatgatttttcagaaaagaaaacagaggctcagagaggttaagtgacttgcccaagttcacactgctaacctacagcagggccaggactcaactcagaccgtgagatgcggccagcgtttggaacaaaagcgtatctcattgtgttgcttccctcagcaccgaggagaaaggagagaaacttggggatcatcagaccagccacgccagagctcatagcagtcttactcagtcccacaagcccacaggacgtcagcacaagaacctgttcttaaaaccatccaatctcacctctcgattaacagatgtggagactcaggcccagagaggaaaagtgactcattcaaggtcgcatagattagtggcaatgcctagacttgaactgagatgagcagagtctggtgcactgccacgtcccaccctcctcctccacagcaggtgcagggagggtccattcttctggtcactgcagcatagtacagttttctgtgtcagtgcccttcctcttaggaagaaacacctctgggctggggtagctagctcccacttttagccatgtaaaatttctctctgggcattttaggtaggagtgttgtctatattcttaagtgtccgagtctactttggctacagagatgaattaggaaaaattagactctgctttgtatgtatgcagagttctccgtgcacgataaagtgtaaatgaaaagcagcaaatgctattagcaggagggcaagccaaaactgctaggccctttttaaatgtcctcaagtcatcctcaaacctacccatgtaattatcttctaagttcattctcaaaaatgagattctaaatttcagggtttatttacagccagatgatcataatactcccctgctcaaaaagcttcggtgacccctattccttgaaattaaagtcacagattcctatctcatcattcaaggccacctgtgatctggtcaaaatctatttctagtagtattgcccactgtttcctttccaggcactcaactcagtctacctccagctgattagatttcctagaaataactactcctccttctaaaccccatgaacaaatgttttctgaaaaggtatttggaggaaagagactttattccagtggacaaaactgggtgttaggttttgaagggaaggcgagggttaaagaaagacatacgtaagagggtggcttaatagcaaatgcaggctttatgtccagcataaaacctacagaagtcaggaaccagcataatgccagagcccactgctgcttacaggctggggcaatttatgggccaaaggggtctgggcagtatggcttgctgcctggcaggatattgataagatgttcccgtgatgagatggttctggcccttgttccagtgggatttcgttgtggtgttcctcggatctttgtccagcatgatatgatagagatgtgtctttggttaggcctttgtctgccttgtggtcaggtggttaggcaggacgtttctcacacccraacccctgtttcactttgactaaggtctgcaaaatagcagggagagcttatgacatggtgcagtttggactaacactgagagaccagagttcagtgtaaaatgaatgtgcgttcagagaacagagaggagtcgggctttayagcaaaatttgctgcccaggttccccatcaggttcatttgcatatgaacccagattcatttgcatttgctttcctctgatgcagctgagccctgattaaccgagcagatragctctgattgattggtttccaagccctaaactgggagtctctgtcagactgtggcwggctggtggtgggaggggcccagcagcagtttgtcctgggagcaacagcaggcgctggtttggcttgattgtgaaaagaggggtcctgtgatgctcttatatctttctgagaacacagagtatgtgatygctcccacacccggctgtagccactgggtttctgttttaaatatgagtacctcagtgagtcatagggagtccatttggtctgtgggctgtgaacatactttaaacaatcccaatcctgttctctcttgacaaatcactttctttacccaaatacagatactggagtacgtgtctttcctccccttaaggacagtacctcttgggcttactttagttagccccacctaggagagagcctggcacatgttaggtcttaataaacactgagcaaatgaatgactgagttgtatgagacatttcatttaccctccccggctccatgcctgggaggaatgagctacctctgaagatgggtaacgtcttgagattttcacaaaagaatataaagctagcaagtcaaagacagtgtgatactgctttaattttagttgtgttttttttttttcctgaaacacagcacattaggagttgagatgatggtattgactgtccttgtggtttgtgtgcaatttttaaccaggattcatggctggggaaacaaaagcacttctttgcttgcataacttttttcccttcctttattacttcaaagaggcaagatgtggtttgcattcatttcactgctaatattgctctcaaagatcgctaaagatctcttctccccttacacattccactcatttrtaacccagatcctcagtgtggctaatggagggtccctcagccctgtaacttctgtgcatgaagcagtaggtagtgggtccagttatgttaaacattaggtaatatcagtatcttttaaccttactatgagaatcttaaagatggaagcattagcctctgcttatgattgctgyaggcaagaatstgcaccaaccctcccaagmgtataaagatcatcaccgtcaccgtcaccattgtaaggtcacagctcttcacagttcacttatctttttcctagttattctccctcctaatcattgccaaagtcttgggagataggtgtgaatccttctaggaygcagctgaaaaagttaaatgtcttgtcctagagcacacagctcagcagcaccaagaatgaaatgttaaatctggtgtttttccctctctgctgtagtgaagctctgctagagatttaccgaagtccttgatattttaacctagctatcaacttcagcccagagaagntcttccaaaagtagattccaaaagtatattcatccatcaaccataaccttaaatctgaagccaggaactaaaaagaaattctcaaggtaacacaattgtcatgaagtctcactcccaggrccaattataatctggatttttgtcttcatccttccaggtgtctctgatcccactgtaagcaaaccctgagtcctagggcctttcttccrcttatttcactctttctgtacacattttccagtacctccaccactcaccaccctccaaaaagaactgatccctaagcttgtgcagtgattaaygattttcatgtcttttctatttgcctgcagttatgctacaagatctcttggcaaaggactagccaggcatgcctaatatatacattcgtgtgatttaacaaactggtttctaccactttcggcctsaagtgacagtgttttttaacgttggttgcaggcaggggactgttgccccctgccaagcacttcagcttccttgccyggcctctccttggcttctgtctgtccccaccagcagctcttcatkggacccatcctgaccctccaagaaagcagaaaaggaggttcctgatgcaaaacctaaagagctttcatctgaggaaggtgartcctttttaaactatgaggcctggagagacgttaaaatgagagcaatcacaccytactccccgctttgagctatgtattcatctcttaaaactgcttgctattgccacaagtagctatgaattaattttaatttaggattattatagtgtctcaccagaagcataaaccacatcctataacttaacaataaccaattgctcatcaattttgtttctgtaatccaaagagagttcctgatcaacaactttgtaccagcccactctctcsgtcccagtcttttgtttttaaaaacctgcttggaacaaaggctctaggaagctcacagccaagagtacttgggtctgagtcttccaggcagctgtcctcactttggctcaagtaaactctttaaattatgctttgcgtctcagcctctgccttttgggtcaacactgaggggagtaaatgaatggcacctgctccttctctgtctgaagcttggacttctcctgagaggacttcctgctccaagataggagggagtctcactcagaagaggaaggagctcctgtctgctgaggacacggttccatccaatgaggtcagcagggctatcagcagcttccgttaattccgttggggyaggcgtgtggcaagcrgcagttatttgagctgaggatgctgggatggattttcacatgagcagttggcccttagatcatgagaccagcctaagtgcccaaggaaatggaacagcagggagggggagggacatcacatccactatcaaaacttcttgttagtctctggcttccacatcctttcccaaaacttcagcccaattcacagccgcatttttccatctctttgccattcctccatgggagagctttctgttggtacaggaatagctgagaagtgggaaagatcawgggtagtaagagctgcccccgataatctacagaaagctttgctggaatgaggttgtgcatctctgaacctgagctagatttgttgggtcagggaccatacttatttactggcccaagaattagaagaggaggtgtctaagaaatgcttgttgaatgaataaataaacagccgagtgagtgtttatatgagcctgaaaactgcctgcaccagcacaaaagtaaagccccaacaccctcaggtcacacctactggaaaaatatatgtcagccccagaaaaatgtgggcaacatgaggcaactccggagcaacacaggaaactgccctcctcttctggcccctcttccactgtgatgctcaaagtctgtgatgaccaagtctggtcatctaatcagcaggatataagagggtcattcttcactgcggccattccagtttcctggaaacttggctttctcctgaccgtttccccakgagcacggtggtgacaagcttgagctctgacatcagaaagtccccagtttgaaacctctagcttcttactcgctagctatgagactttgggcaaattaatctctaaacctcaatttctcaatctgtaaaatgttcaaggtcaagcaactcacttttccacattgtaattgatgaaaytaaaattcagactcagatctgcctcactccacagtctgtgctttttccttcccactcatctttttctctttctattaaaaatttcataacacatttgagattctgtctcaactcatatcactgaaatcatctgtcacgtctgatgatcatatagaagccagactaagattcagccacaaatgttatgcctaaacatttcttattatttctttttaatgtttctcatgtatacaatcaaactcgcaccctagtattattggcaggctaatatatgcccatgagacatgtagcttaaatctctatgggataggataartattctccctttgtttgtgatttgaaagctttccatggatgctaaagcgatttgttaaaataccttcacctgtaagtgtttttcctctcttaaaagcctaattcatctctgagtttgtttactaaaataatctaatttgctcattttctctagccattccaagctaaatcccaggaagtactaaagaagcaatgcacagacacagtatcatacaatttgagacacagtattatacaattgatgtgaacttctaggcacagtgtgctcacagtctgtctggaaataactttgtagcaagcatagttccagtctagctgcctggcagcctggcaggatattattattactgatactaatttactttttaatgtaagtctacccagaatatattaaagaagtttcaagaaatcaggatcatggattataacctgacgtagtgctaaggaaccatcagttccatgtaagcatttggttagcaagtctttttcaaaggccatgcttgagaaacagttttgctctcccaaacaatgtgttgtagttttttttagcatactactgtgcagataaataaatgagatattaatgccattgcaagttctggctttgtgtagagttttctagtgaagcctgtttaggatcctggatttgtccaagctgttctgattatcccatcatttttaacatggataatctacaatctttcatctattacataaattgaattctggcacaagttcaactgctcttcattgaaactgagaaaaattttaggatcactttgctggaatccaaagaagatgttaaatactaccaaaaaaaaaaggctgaaaactggtttccaagaatctctggggcatccttaagaactccccttgcatgttcattagayggccctttacccaatgtatctctaatagtctgctgaaaatactcaaaggcaagtaattttcatgtaatcaactaaacaaaatgtttaacaaatatggcaaatattaatatttttaactgtttatgtaaagtgcaagagagttattgattaggagagtagctctgaagccgaacagcctaggtctaaatcccggttctttcatcaayaagctccattactgttgataagttatttgaattatcggtgtcttagtatctttccttatagaggtgatgattgctcctacctaatagcactgtagcaatcatatatgcagagcttatcacactaattgacattcaaaaatattagctcttaaaaaattattattagaaatttgagaaaaagaatcacactaaaaaaggataaaaggcattgaaaataattcccccaaaagaaaataaaaatttctcaaatcatataggacttattttgtaacattaagaagattccaattaattcaaattaaatggatgatgccttatcttcacaatgacattccaatagcttgttttcttaytttaatgaaaatatgtaatgatggtgaagattcagtgagacaggcacttccatactagctgctggaattctacgttgacacaacatatttggtgagcaatatggcaatcagaagactaaaagaatgttgcatattttgtcttggtaattcctcttctggaaatctttcttaagtgaacaattcctaattcaaaagctacttactatatagttatacacaaagacatatrctacaaaattattaattactaggaaaacaaaatgaaataatctatatgttatataataaaagcataactaaataaatttcgtgtagtcacataaagatatgtttatgcagcagaaaattggaatttatgaaaagattggcataatatagagacaagttttcttagttatcatgaacagaaaagtatgatggcagtcatgaaaaatattcattaaaaattagaggaaaataaatatgtctatctatctagctagctagctaattttgagattctgttttataactgaagtttagactctgtgaccctcccctaaaagtctgttcatctcttttttagttaagactgttgactgttttccacaacaaccagtagacatcagtgaccattaaccacttttctcatgcattctattttccttatttccagaatacattcccttaagctaaatacaacttctccctctacatctgttttccatgagcatatctggatttactggtatatctatcacttccatgtccttttcaggattggtgaaccatgtcatccattcctgctccaggcagaagcttgttctcagtccttggttttgagcttgtgtatctgtctctctctttaatttttattttaggttcaggggcacaagtgcatgtaggttagatgggtaaactcatgtcacatgggtttgttgtacatattattttgtcttccaggcactaaacctactacccaatagttattcttcctggtcctctctatccttcgaccttctactctcaagtgggcctcaatgtctgttattccccttattgtctccgtgtgttctcattatttagctcccacttataaatgtgaacattcggtatttggctttcttttcctttgtaagtttgctaaggataatggcctccagctctatccatgtccctgcaaaggacatgatctagttcttttatgtgactgcagagtagtccatggtgcacatgtaccacatttttttttaaatccagtctgccgtggatggacatttaggttgattccatgtctttgctattgtgaatggtgctgcaatgaacatgtgtgtatgtatttctttatggtagaacaataaatcacaatgttaatggctgttggtagaattaattttacgtaatttctaatctttttctttatatttttcaaatattctacaatgagaatacattgcttctctaataatattaatgcaagcatataaataatttaagttccctggttaatctcacttattatctctaagctttgtgtctccttgtgaaggcaaatctcctgaataaatgcttacttagcacgcgcatccacttggaatccatcatctgaaatagttactgttcrtggtgcattgactttaacttcaaacttgggcaacactggaaacaaagagaaatatacttcagcccccacaatcactggtgagcaaaatttattgcaatcatgtagcttaaggtgcttcccagcaccagctttccctgtatgtccatctggatagatcatgttctgttgccccagattccatgtggcaccagtctacatgatggtgtctcactagtcattaactcttcctttttcttttctctgtcctcagaatttcaagttttttcctttgtaatctcttagatctctcctggcagattgggctctagaaaatgtatatttcctaggggaaaaaaaacgacagaaattagaataacgatactgggggaggagtgaggaggaggaaaatgctgatgatgaagctgaccaggccaaggaagggagatgagaaaaaccagatcaagcttcacctactcctgcctacgtctaacaccaaaggtgttttgttccatgctttgaatcctttatctacacaggacaactacaaatagcaattggttaccctacccttgatagtaaattggtgtgtcagtgtctttcctgattttcttttcacgacaattgagtaacctccaaacactgtttctgaaatcartgggaatgagaggaatcatacagtatggactgttttgtgactggcttccttgtttccacattatgtctgtgaaattcatccctcttgtggcagacaggaggagctcactgcctttcactgtcttgtaatcttccatggccggagcaccccacactgtatccattctattccttccactttttgatgatgatgaatgaagcttctctgaatgtgtttgtatatgacttttggtgaacataaatgctcatttcagtttggtagatacctaagaaattgaattgctaggtcatggttttttcttacatgtagctttagcagatacagaaagtttcttatagttgtggttcaagttacacgcccaccaagtgcagacaaaagcactagtagctccacactcttgccaacacgtggtattgttagttcttttcattctagtgcatctggggaatgcagtgctatataacctgcattttctttcctttttttctttctttcttttttttttttttgttgttgttgttgttgagacgtggttttactctgttgctaaggctggagtacaatggtgtgatcatagctcgctgcagcctccacctcatgggctcaaggaattgtccctccttagcttctggagtagctgggaccacaggcatgcacaccatggtcagcttaatttgtattttcttgatagttaatgaagttgaacaggttttcatatacttattggctgtgtgaatggcctcttttgtgaaatacttatttgacccatttataaagatttttattgtcatttgttattaatctgtggggtttctttttctttttcttttttttttttttttgagacggaatctcactctgtagcccaggctggagtgcagtggctcaatcttggctcgctgyaagctccgcctccygggttcgcgccattctcctgcctaagcctcccgagtagctgggactacaggcacccgccaccacgcctggctaattttttgtatttttagtagacggggtttcaccatgttagccaggatggtgtcgatctcctgacctcctgatctgcccacctcggcctcccaaagtgctgggattacaggcgtgagcacaagaaattcccacaagaaatctgtgggatttcttgatatattctagataagatttgctttgaaagacatatattgtaataatcttctgctctgtggcatgtcttttcactcacataagggtattttttgatgaaccatatattttttattttaataaagttcaattaatctacttttactatattttatttttaacaaccttgtcaatatattatttattatttttgtttawcttatttttatagttagtggttttttatgtgtgtcttgtataaaaaatatttgcctatccctttgttataaagataaacttatttaaaaaaaaaaaatctagaccttttttttcttcaatacaccatgcttaacacagattgactttttttacccttcatgttttggtctaggatccatctcagatttatttacatcaggactgaggtggagagtcacggtttctatttttctatatggatgtgtggctaacccagggccatttattgaaagaccaccctctccccacttaactgtgctgtctcccgtgtcatctatcaggtgttaccgcatttttcacttcygtgcactcttgtttgcgccattggtcctagaatatatttttgtgccagcacttcagcatcttagttattgtagctttaaaagaagtgttgctgtctggcagttcagtcctccagctttgttctgtttaagggctgcattggctgttcttgattctttgattttccatatatactgcagaatcatcttcaatgtataccaaaaaaaaaaaatgctgggattttgattggcattccactgaatctgtacatcaaattagagagatttggcatctggaaatattgagtcttccaatacatgaacatgatataatcctccattaattaggtatttctttaatttttttcttagcaatgttttgtgtttcatatttttcagtgtaaaggtcttgcctgccttagttttatgcctaggtattttttggttttggtaaatgctcctttcaaaagtgtattttccaattgtttactgccagtatatggaatgcaattgatttaggggggttatttattttaattgtgatatgatatatataatataaaattgaccatttaaaccatttttaattgtagagtacagtggcattaagaatactcacgttgttgtgcaacagttcaattgatttttaatatcagctttgttgagctatggtcgacatatgttaaaatttgctagctttaggtgtgcagctcagtgagttctgataaatgcatgcagccacgtggtcatcacagtgaagacatggaccatttccagcatccttcagagttcccgtgtgccctttarggctcctccccagcagcctscctcctggccttcagtatccayagacctgctttctcgcattgtcattttgccttttctagaatttcaggtaaaagaatcctacagtaggtatcttttgtgtctggctgctttcacttagtgtaaagctcttgagaggtatcygtgttagatgtgtatcggtaagttgccctgttttattactgaatatattccgctctatggatgtaccacagtttgtttatccatttatcagctgaaggccacttgggctgctctcggtttgtggggagcagagggaagctgctggaacattcttgtacagattgttgtgtggaaatctgcttttatttgtcctggataaacacttaggggaaggatcgctgggtcttatgtttgactttataaggaactgctgaactgttttccacagcagctgtgccatcttrtatgtccgtcagcaccgtgtgagagttcccctgctctgcaggcttgccaacgcagatgtgtcttttgatttcacctgttctagtgtggatacaagttgcatttccctaatgaataatgatgytctgaatcttttcaggcactttttttttttttttttttttttgccattttgtatacttctctggtgaagtgcctggtcaagccttttacccatttaaaaaatcaaactgttttcttattgatttataagatakaagctaggcatagttgcatctgcctgtagtcttaactacttggaagcccaaagcaggatgatcacttgagcccacgtgtctgaggtcagcctgggcgacatggtgagaccctgycactaaaaataaacagaaagtaaagatacatatatatctcactgtgctaggctgaatgatggcctcccaaagatgttyrcaacctaatctgtaaaaactgtgagtttcttaccttacctggcaaaagggactttgcagatgtgattcaactaaggatgttgagatggggagattctcctgggttacctggctgggtctgatgtaatcacaggagtcctcattagagggaagcagaaagaccaaagtcagagacggagatgtggccgtagaagcagaggtccatgtgctgcggggccatgagccaaggaacccacgccgcctctgggaactgggaaaggcaagggagcaacgtctccctggagctccagagtgagccagccctgatgacaccgtgacttcagccctcggagactgactgtggacatcggacctctgtcactgtaagatcctaagtttatgttcttttttgggaatatgcactctctcttcagtggaggacttgaagctggctcttctgattctaagtccatgttgattttttcctaccattgttcggggtagaagggagcaggtatctcaggtggtgggaacagtgcgagaaagcccccaggtcaacatgmacgctgccgcgcagggagcaggctcctctcagattaagcagcgtgtgctgggactgcgggaggtgaggtccattgggtggatccactaagctttggaagcagagagtttgggctggagatggtgagaaaccacatagtggttggagcattttrgggtytgtcagaagggtcagggctgctggctggggtaggagcaggtgctggggagacagcactggcctgcccacctcactgggctctgacaggaggcatgccaggcgtgctgttcattattatttcagaacagtgctgcttaactccasggaccaagctgcttctgtgaatgaggggtagggaatcccagaggccaaggccgcctcatctctcagggaccttctggctcattagatggcctcgtccctcaatcttctccaaactggtgctggcttccctgaggatgctctgagctggtgccattaacctgggcagcacttctctccrgtccacacgcacttcactctattatcctgcaccctgaaaaggcatggattttgttgaacggggccttgtgcatcagaagccaagtgcacctctgtctgggagctggaatgtatgcagtggtcatctttgctgcttctgccctggtgccacactctgaagagtgagaacatgggcagggtggtcgatggcttcacacctctgtctccccaccaggatctctggctgagactcagggtccgaggacccagggtgcctccagaccacagaccaatgaattttctgttctcttttcaacttcttcccagcctagggcagttcaaagccagcttctttcaggaagcctgccctgatagtgccacccaactacaaacacttattttctgtgctgcatattttcagtgctaagtgattgtgcattcaacctttcagtacacatggtctcctgtggttctctagtccttctggagaagcaagtgtgagacggatgcctcgtctggtgaggttacagactttctgaggatggggagcaatctttcttcatttgtatcatgtctcaccaaatagataaaccattggaggacaggtactgtttgacatgaaaataaggtttatggtgccctcctgatcattgttcagtaaactcttcagggaaaggagtggagagatcattagttcattggaaaaggtatttcttgcctagaggggtggattcctaaatttagggctaaatgtgtcatgcagctctaaatttctacaccatgagaaggtagtcccttttgcttcttttatgtacaatccatgcatttgttccacagacatctgatgtttactgaatgccctgtgcaacagagattgaggattcaaaggtgaacaacagatkatctttctctgcagggggctgtctctatgcacatcactcacaaatatccatctacggtccctcacaaatatccatctacagtcccaagctccttcccctaatccacgtcctgtgttaggtgttgggcaaactttccaggtgtcaagatgcagacaattagacctgcagcccccagaggagctgagataatgctactcctttcgaggaggggcacatgacatcacctgacctgttgaagcagtggacagagtggggtttgggggatcctaaccagagtagctagccctccccacctgcgtgtcttgtatctgtaggctctgcatccatagattcaaccatgttgggtaaaactattcaaaaaacattgcatatgtgctgaacatgtacaagcttttctttttatcataattccctaaacaactattgacatagtatttacattgaattaggtatcacaagtaatctagagcttattgaaagtgcatgcagggtgtgcataggttgtctgcaaatgccgcaccattttatatcaggggcttgagcacctgcgctgttggtatctttaagggaggatcctgaaaccaatccccaataattactaaggaacgacggtatttgggttttgacagaaagctgagaagcccagaatgttagaaataacctcctaacagtaggaagctgagttaaaatcaggaaaagccagcggttaaattcagtctttttacacacaagagcaagccacatgttctacagcaatggaggaaaaactcagtgattacccaatgaagtgaataaaagctgcagtgatagttacaacaacacgacaacaggtgacattgagaaggaagatctcatttagggtttgttggagggagccacagccactaaggatgcagcctcctttggaagcactgacctggcccctgcgcccatggacgtgggaatagtgtgggagctggcagagtctcagcaacctctcaatctagtttgtctccttagacaacatccatctcccccattctccatcagctccttttccagcttccccttcctgcccttgtttttgtaaggccgggagggaggtgtctgggcttacgacaatgtctcacattgccccaggagagggcagcagacattctcccatcccaggtgcctcctctgcactgtccaggattccagtgaattttcgagggttattgaaaattacctggttcatgggagccaggctctgtgctaggcactgggaatgcaaagccaactgagatatggggctctgctctgcaggagctggtggtctaaaagggtgaggcagccgtggaaacagatacagggccaaacagtgaggtcaaacgctggggcagaaggctcttcaggggactgtgggatccccggaaagtggggagaggaggggtctcagaaaacacccagcaggaagaggtgcttgagctgagtcttggaagccggcaggttttcctggttcctaggccaggcagggcacaccaggcagggcaccccaggcaggggagctgggctgagtgtgacaccacagggcgagctggggcttgaacacagggtgctgagggcaggaggggtctcagggaggggacgatcatggagggctgtcctgcatgcccatgctaaggagtctggaccagggcctggaaggatccgataagcccccraagggtttcattaggagaacaaccagagcagacctgcactttaaaatgacagctccctgttctgcctgtggaggacagacgtggcaggatggagaagggcaggcctgarggccgctggcccrgtcagctgggcttgaactaggtggagggagcgagggcagttgtctgaactaaggcaggagcagtgggaagggcagtgaggtgaacatgaggttgaaatgacaggttctggtctttggctagatggggccggatgagggcagaagtctcccaggtttctggcttcagtggctggtgtaagtgttggtggagctgaacacaagggtggaggagcgatctcgggagaaagattatgagtcattgacaaatatggggcgtctccccagaccccactatttcatttcccactgcaccctcttatctagatccttggtatttttcactggttttgagacagtgccttcctgttgggtcttgtaaggtccagtctctyttcttgttggaagagcctgtgwattctttcactgcatgtttatgaatagccttcccgggccaggcactgtgatgagttccttctcccatacagctcatggcctggtacagggggagaaggtgaaggaagagatagatggtgaggctgatggttgtagtccaatatgcagtgtggtctcataagtgaagaacaggctgcaaggagaacattccaggacaggcctgcgatctggacttcagtgttgaggtggtttcctaaagaaattgtctgggctcagctggatgtgcaagggctcctgagtgacaggctgtggagaggggcttctctggggctggaaggagccagtgcagtgcccgaccctgtggcatagaacgtgagaagtgggcagcctctgcttgagaggatgccgagggtggtcagcamggataactaacggtggcagggcctgacggggtcagcttgcaccaagttgggtggagaacgagtagctccaggcctcccacagtggacagatcctcaggcctggaggggtgtcctyctgaaggagcattcccagtctctgacgaatgaggcctgggtctctggctggagttggagtgggtctgtgtctggagggggcacttgggctctggaaagaggctacaaactctagactaggctgggcaaactatggccagctcctgttttatcagaatgcacctttatattctccttcatgtatgtattgtccatggttgctttagtgagttgagtggttgcaacagagatcacatggcctgcaaagcttcaaacatttcctaactggctttttatggaaaaggtttcccaagccctgctctaaactggcaggcaactttctcagagatagttcaggcctagtctccatgtgtggacaagatgagcccataccgtgaagctggatctcccaaaacgcacatctgtctcaggtcttataaagctgtgaatcattaagtgtgtgaacatacatgtggtcatgtgtgaatatgcatgtggtcacctgagcacacatatggtcgtatattaacatgcatgtggtcacatgtgaatgtgcatatggtggcatgtaagatgcacatggtcatgtgaacatgcatatggctgtgtgaatatacatatggtcctgtgaacatacatatagttgtgtgtgaacatgcacgtggttatgtgtgaacatgcatatggttgtgggaacatagatatggtcatgtgagaacatgcatgtggtttgtttgacgcatgtggtcatgtgatgtgagcttgaggtgcaccgtcaggctgggatgggccttcccagggtggactcagccccttgctgcaagagaccacttcctgaatcctggtcctaagcctgtgagcctttgctcggcaccaagaagcaactctgttgataccgactgagattcagatgcctgaacctgaccttctacacacgtggccctagtggatcattccagcctcagtttccaygtctccccaaatgcctgctaaatgtgtcagccaaacctgactacttcccattctgcacacataccttctccaccttggtggccgaatcctttggagcccacctctcacattcagctcccggttcttggttatttgggctcctgtctcgtgtgctctatcaggttctaggctttgcaggagtgagttctgtctccactcgtttctatgtgcctcgtaggactggctcttgggagggtcttcatggtgactgaggccatggatccttagccctgtagcttgaattcacttggcactcaaacactcatcctgaaatgatgctctgaaagtgatgcttccagtcagttaaggatccactgtattatggatctccagcacccaatgcctggcacataagaaatgaatgaaaagtagtgaatgatctcaagtatgtctacaaggcgagaggaaagtgatcctattcaccagacatgctagggaggcatttggygctgttggctctgctgttgcacaataggcctgggactctgaaggctggcacttcctcatcctaaacctcaaattttaatgaattacctccaagtgggcaaaggtccatgggccagggttcttggtgtaaataacccacctcttttgggtgtggttaatggacagggactatacaaaactaaaaacaatgtttgaatgctgacttcctgtcagccatggtgatgaagcactctgtatacatgaccttattcaatgctcactacaaacccatgaagcagatttttagaaaaactttctatttggagcattttaaacaagaggatagtgtaatgagctttcacctccttatcagcagatttaaatatttgttaactcatggcccatcttgtttcctgtatactcccacccacttatccccctctcttgttgttttaaagcaaatcccggacattatgtaatttcatctgtgaatatcttagtatgtatctgtaaaagaaagggactaattttttgttgtttttgaaacagggtctctgttgcccaggctggagtgctgtggtgtgatcatggttcactacagcctcaacctcctgggctcaagaaatcctcccaccttagcctcctgaatagttgggattgcagatgcacatcaccaggcccagataatttttttatttctatttttgtagagatagggcctttctatgttgcctgggctagtctagaactcttgatctcaagtgatcttcctgccctggcctcccaatgtgctgggattataggcatgagacaccatacccartgataagaacttattatttatttatttatttttgagacagagtcttgctctgtcatscatgctggaatgcagtggcggaatctcagttcactgcaacgtccgcctcctgggttcaagtgattctcctgcttcagctgcacgagtagctgggattacaggtrtgtgccaccacatctggctaatttttttgtattttttttttttttagtagaaatggggttttgccatgttggctaggctggtcatgaactcctggcctcaaatgagcctcccgccttagcatcccaaagtgctgggattacaggcatgagccaccgtgcccagccaagaactcttttaaaaaaaaaacaaaattgcaataccattatcataccaaccatcgcacactactattctttaatactaccaactaccctactgtctccaaatttccagtaatttcatttttttgttagtttgtttgaatcaaaatccaaataaagtctctccttatgattgtttgatttgcctgttagtatttctggatctataggtttctcctttcatcaattgtttctcctttgcaatttatttattgaagaaacaagactgtttccctgtatttcagatcttgctaaatgtatcctcattatggcgtttctcatagtttggattttgctaattgtatccttgtggtgtttaacttggtcttcactttgttctctctatttactataaattagtggtacgatctaaaaacttggtcagaggcaggttggatttgtggggcagggtaaaaatactttgctaggttcttccatcaggaggtgtgtactggccggcatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttacaggcacaagccaccactcctggccctgtgtctttttttgaaaagttctttctcctcccatgccattccctctattcctttacatcctgaaaagccctactcagtaggccctcttctttgaacctcctcctagctggtgcataattatgccctcctctgtattatttcagaacattgtgtatgcctataatatcacatatgttatcctatgttataagtatttgtcatgtttttctctagatttatactagacttatcttaaatactctcataattgccagcatatagaaaatgcctaaagaatatttgttgaatccacctgaattaggatttgtctataagcctctttgcttttaataaacaattttctaatttgtcagacagtttaaatgcattttgaagagaacatacttaaaaaaataacattttaaatgtgacaatgtaacatatgcttattttagactatacagaacatattgaaaagcccttcgaagaacagaaaaatgatttttaaatgtacaatctgggtactgttagtccaaactgcactgttttgtaagccccctgccgtttcacagaccttggcagagcaaaacattccatgggggttccaccgtgagaaatgtcctgccccaccacctgaccacaaggcacaggaatgtccttatcataccctgccgagcaaaggcccaactgaaggaacatctttgtcaagcagcaaaccacgccacccagaccctgcccgcccatacctataagtaccctagcctgtaagcggtggtgggctctggcgttaagctggtcccccacctcagcaggtcgctctggcaataaacttgtgttgctgtcgagctgccagctcttcctgtgtctttttttaaccttcgccttcccttcaaaaactaacagatatgttaccattttgatgtatttcctttcagttttatctgtgcattcatatgtgagtgtatgtacacatacatatgtgtatrgttgtatgtatatatgtagtatacacataagtgtataatctggatatatccaactccgttatccatatcattggctatgtctacaacaatagtatagatactttttgtaacctgtctttttttgttgttaattattgtggatacatatcagttgtacctatttattgggtacatgtgatattttgatgcaagcatacaaaatgtaataatcaaaccagagtacttgggatgcccatcacctgaagcattgatcatttctttgtattaggaacattccaattccactctttcagttattttgaaatatacaataaattattaagtacaatcaccctattgtgctactgaacactaggtcataatccttctaactgtatttttatacccattatccatttccttgtcttttttaacttaatgtagtgtgagcatttccccatcatcaaatatcattttataaaattattttaaataactgcatttataaaatagccacattttataaaattattttaaataacctcactcgtgaatactggggtagctggggataaatttttargctcattgttattgtccctsaaaacgtggaagttattattccattgtctcatctactgctgctgatgatttaggctcattgttattttccctcaaaacgtggaarttattattccattgtctcatctactgttgctgatgagatgtctgctgttggcttggcaatcttttctttgcagcaaatctttcttttttcttttaaccttttggtgtttcctcattttttaaattttttcttttatcccaatgtgtctaggggtttatctactatctaataaataaatatgtatttttaatcctgtaaaagacttgatgtgccttttcaacccaagggttatcttttttaattctgaaaaattctcagccattgtcacttcaatgattacctcttgcccaactactcaatttttttttaattccccttaagcacatattggagtaaaactctattttactttgctcatctttctacatatctgtgctgtaaattggtcactctgtcttccaattcactcattcactcttcagctgtgcctagtctgctgtgaaacctatctagagagttgtttaaatcaatctctgtttttctgttttggacccattaacaaaaatacagctccatgtttcttttatgtaaaatgctgtatttaccttaaagttcttcttttaacttaattcttttcgatagtttaacacacataagtttatgaaacaatacgtacacctcaatgacttgtcacaaaggagtatctatgtcatcatcatctaggttagaaaaacaaaaaaggacactgccagcactccagaatccaccattgcgatgctccctagtctctattccctcccaaggtgaggattaacctgacgtttattatataaaaatcacttggttgattttctttaaagtttttattttgaaatgattgtagattcacagagagtcacaaaagtagtagacagagtcccttggatgctttaccyggctttccctaacagaacagctatcttacagaacagcaggacaccatcaaaaccagggcatgggcattgtctgactattgttagactacagaccttatgcagttttcacagtgtttgcatgcactcctttgtgtgtgtgtgttctatgcaaggtgatctcatgtgtagtatcctgtaaccacttgcaccaactgtccttgccaaagaactgtttcatcactgagaggaattcacttgtgctacctctttttagtcacatcctcgtaccttgtccctgtctcctggcaaccaccaatctgtcctccatctctatagttttgttagttggagtggaacaggaattaaaagaaattaaagaatgtgtaagcaaaaactcagttgtatgtaagaaaacccaattccccctgaggaagagaaagagctggagtcctttaaaaattaactgcctgtttttctgtggctagtgagccttatctctccctttcccaggcattatgaagaccctgtttctctagctgtgcagctccaaggtcactagacagataaactcaagttgtaaaatatgtttttccttgaaaagtaagaaataatgtaatgcaagtctcaattgaataactgtctttgtttctcgcttctgtaatatgcttccccctgcacaaatcttcccccacccatgaaatgcttaaaaggtaacttgactctttgttcggggctcagtcctttggatgttaatctgactgggccaatgcacctaaataataataataaatcctcctcaacccctcggtctctctgattcctaaattatcccacaacaggagaatgttttatacatggaagcttgtaagtgtaaaaccttttagaagattggcttttttcataagaggaagttttttctttcgtcaacaaaagccaaaagccaatcttcaacaaaagattggctttttttcaccaagtttcacgctctaacaaaacctccaagtttttgcctgtatcaataatttcttgctttttattcctgggtagtagtctcttatatggatatggtagaatttgttgagtctttcaccattgaaagatatttgggtggtttccagtttgaggctattttgaataaaacttttaagaacattgatgtacaggtttttgtgaacctgctttcattcttcaggttaaatcctgaagagtgaaattgctgagtcacataggacatgtacctttggttttataagaaactgccaaactcttttccagagtggctataccttgttcaagtgatgccagtgatgtgtgagttgtctggtttctaagcaatcttgccaggatttggtgtcatcattgagcttatcctttctaacagacatagcgatacttcattgttttaatttgcatttctctaatggttactgatgctgatcatattcacttgtgcttatttgctgttcatgttctttctttgacaaaatgtcttttcatgtcttttgcccacttttacaccggattgtttttttaaaaaaaatgtgttgaattttgaaggttcttcatagattctacatacaagtcctttgtcagctatatggtttgcaggtgttttcactcagcctgtagcatgtcttttcatcctcttaataagatccttcacagagcaaaagtcctacatattgaggaagttcattttgtcagtattttcttctacaaattgttatattggtgtcatgtctaacaacttagtcttgaatatttctcctatggtttcttctaaaagtttcatagtgttacattttttatttaaatctgtgctccgtttgaattaatgtttatataaaggtaggagctttaggttgaggttcaattttttgcttatgaaagttcaattgtttcagtagcatttgttgaaagattctcctttctctattgagttgtctttgcagctttgttagaaatcaattttccatgtcagtgtggatctattcctggatacagtctgtcccattgatctctgtgtctatccctttgctggaatcacactgtcttgattacttcagcattggagcagaactttaaaattgtgtagcatcgcttttctgacatcattcttttttctaccttttaatctttacatgtcttttaaaatcagattacctgatatacaacatatcctatggtgggatttcgatggagttgtattaaaagtatagatcaatttgggaagaattgaagtctttattaagtatttctacccatggatccatgtatttcttcattgatttaggtcttctgtgattttgtttacagcattttgtacattttcagcatacagatcttatatagactcaatcatttcattttttcagagatagtacaaatgcaattattttaaaatgttgattttctgttagttattgttagtatatacaaattaaatgagttttgtattttgaacttgtgctacttctggaatgtgtgtgtgtgtgtgtgtgtgtgtgtttgtgcacgtgtttatgtagtccttggaatayaccataaccaagtgggttcttcctgggaatgcaagactgcttcaatacttgaagatcagtcaatgtaatctgccatagtaataatctaacaagaaaatcaacatgatcacatcaattgatatagaaaaaaaatttacagaattcaacatattttcctattacagattttctgcaaactaggaatagaagcaagcttcttaacctgatgtatcgcaccttcaaaaagcctacagcaaacatcttacttagtgatgaaaaactgattgccttccccataagattgagaaccaggcaaggatgtttactctcatcactcctatccaacatggtactggaagtcctagccaatacaataagggaagaaaatgacacaaaataaaggtagtaagattagaaagaaagaaattgtctctattcacaaacaaggtgatttcttttcctttttcttctttttttttttaagagacaggttccttctctgtcacccaggcttaagtgcgatcatggctcattgtatcctcaaactcctgggcacacacagtcctcctgcctcagcctcccaagtagctaggactaccggtgcatgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagcgcaatccattcaagttcacaggggcgggtggcacttgaaaatgtcagggtcaacttgcagggcagaagttagcagggaagtctttcctgggggagtgggagagcccagcagagtttaggaggagggaggggcgacatcggggcaatcctctgagtctctctttcctcctcaggaactgtccaggaagaccctgcagtctctctgcaggctcatgggagctcccagaactgagacaacacacggatccaggcctgcttcgaagtcagtgggatgcggcccttgaaagtcgatgtattgggttcctagggctctcgtgaaaacatgccacacctggctggttttaaacaacaggagtttattctgtcagttgagaaggctacaagtgcaaaatcaaggtattgacgggatgagttccaactagaggctgtgaggcagatcaactccatggctctctcctggcttctgctggtttctggcaaccgttcacttcccatgcctggtagacacatcactctaacctctgcctccctttttcatgggcacattcgcgcctgtgtgtgtgtgtgtgtgtgtgtgtggatgtgtgtgttaaggacagcaatcattagactagatggggcccactctaatccactgtgagcttctcttactttggtaacatctgcaaagaccctatttccaaacaaggtcacattccatgttctgggactgtcttctgagagatgtctcccccaggatccttccaggtggaaggatgccctttgacctgcaaagccaggcagaaaaccaggatcagggcaggacaagaggatgctagcctgtgatggctcccactcaggtgggatgtgagaagtgcctgtggcctgggacacaccaacttgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcgaggcggggacagagtgtcagcccctcttcccccactggcttttgggacccccatcgcgatggggggaggcacccccagcgaggcggggactgacagccagcaactcttctgccccgggctcttgggacccccatcgcaggggcgggaggcaccccccgcgagccaggttctgagagccagcccctcttcccctctggctcttagaacccccatcgcagtggagggatgcaccccccgcgaggcagagactgagagaaagcccctctttccccccggctcttgggacccccatcgcaggcgggggaggcaccccccgcgaggcggggactgagaggcagcccctcttccccacctggctcttaggtcccccatcgcgggagggaagcaccccccacggggcggggactgagagccagcgcctttccccccggggctattaggacccccatcgcaggagggtgagacacaccccagaaggctgggactgagagccagcccctctccccccgctggctattaagacacccaacgcagggggtgaggcaccccctacraggctgggactgagagccagcccctctttcaacctggctcttaggacccccatggcagggggggaggcatcccccacgaggcggggactgagagccagccccctcttccccctctggctgaggacccccaccgcggattctaagatccttagcacccacctggaggactgtgggttttaggtgtccaagaagaaagctcagatcttccagcagaaggtgccttacttgggatttactatccgacaggggtctgaacgcagctcgggatcagaaaaaaagcaggtcatttgcaatgtaccggagccagccccccttcccctctggctcttaggasmcccattgctggtgagggaggcaccccccgcgaggcagggactgagagccagcctctcttcctcccctggctcttaggacccccattgcgggggggggaggcaccccacacgaggcggggactgagagccagcccctctgcgccccctggctattaggacccccatcacagcggggagaggcaccccccgcgaggcagggacggagagcctgcccctcttccccccgtggctcttaggacccccatcgcaggcgcttggcaccccacgcgaggcaggtactgagagccagctcctcttcccccccgtgtcttaggacagccatcgcagcgggggaggtaccccccgtgaggcagggactgagagccagcccctcttcacctctcgctcttcggcccccatcgcagggaggaggaggcaccccatgcgaggcggggactgagagccagccccacttcccccctggctcttgggaccaccatcgcagtggggggaggtacacaccacgaggcggggacggagagtcagcccctcttcccccactggcttttgggacacccatcccgggggggaggccccccccccgcgaggcggggactgagagccagcccgtcttcgccccctgactcttaggacccccatcgcagtggggggatgcaccccccgcgaggcagagactgagagaaagcccctctttcccccctggctcttaggacccccatcgcaggcgggggaggcaccccccgtgaggcacggactgagagccagcccctcttcccccactggctaagacccccattgcggatcctaagatccttaggacccacctggaggactgtgggtattaggtgtccaagaagaaagctcagatctgccgacggcaggtaccttacttgggattttctatacgacaggggtccgaacgcagcccgggatcagaaagaaagcaggtcgtttgcaatctaccggagcctaagggcagaaggcaggttagagaattcttaggagctgtggggttttgtagactgtggattccaaactttgcagtattagccaagcctttgtatgaggtcacaaagggggtggggaccggaaagctttccaatggggatcccaacaacaggaaggctttcatgagttaaaggaaaaacttctggcagccccagccctggggctacccgatgtgacaaagccttttccattgtatgcttcasagagagaaaagatggcagctggacttttaacccaaactgtggggacctggctgaggccagtggcctacgtctctaaacaactagacagggtttctaaaagatggcccccctgttggagggccttggcagcaactaccctgctagtactagaagcaaataagctgactcttgggcaaaacctgaacataaaggccccccatgctgtggtgactgagagccagcccctcttccccccctggctcttaggatccacggtggactcacagcctgtttaccatattgtgagtaatatcatctccccctctggagacctccggagattatgaactgtttcacagacgggtgtacaccctcagtgtacagagggcgtacacccatctgtattgggagtaatatcatcctcttcctccctgaatattaagaacagtatcacaggggtgtttctactccctgcgatatcgcgtgtcatatcctcctctcccaccttgcaattagaaacaatatcagtgggggcgtgtccaccttctgtcatattgaaagtaatatcattttcttcctccaggaccgtnnnnnnnnnnnnnnnnnnnnttgtgaagcttcccattttatctatttaagcaaaggacaactcctgtcttcttcagaaaagaaatacttctgagaaaccaagtgtttaagatggaaataacagcatatggtagacactaacatgaggtacgaggactgtcagtacatctaaattacagcaagtgggatcaccattcctcwgcagtgtaagctttgatttttcccttgcatttttatttctctcaactcaaaacacacacagacacccacccacacagatatttaattatagagaaaatactaggtaagatcagacaaactgtagcagtaatcagcaatgattcaccagtaatgaatccaataagaagaaagatgtgaagatgttttagaagagaacgtgggaaagtttttgatttttctatgaaggagtaagagctcwtctccatcagggtcctcctgttgtaaggaataagtttggaatacattaaaaataccacaaagcaatttgaatacaatttgcatgcaaattaaatatcagagtgtgtggattagatatgcattctgggtttcaagaacaggagtgmtgattatgaggaaggatgctgaagaaaagctcagggtatttcaggggccatcagagcatgctaaaatgccatgataggagattttgagcaaccacagggraaaaaaggaggggaaaggagatagaaratgggctggagatggacaggtatctgcaaagaaaggaagttggaagggagggatttacgtaaatatggacaggaaaagggttggattttgccaaggatatacttcacctcatttgtactttggccccggggcaagcttggcctttgaatttttccttgagagggtcttagaaaaacttgcttcattgaaacaatatgaattactagatattctccccagaactttcttgccattcatggacaggaataaactttccttcctcatacactcacagccccctccctttatacattgactgtctccaaatttatgaaagtttcttttctaggttccctttctctcccctcccttctatttctagtttaatttctgaagaggactgactcgggaaggactagagactgaataaggcagacaagagactcagaagragtcacatccaggctgtagttaaacatgcacaaagcaggaatggtgctgctgaccaacccaccacaggcccaggactgcagtgcctcagaaggtttcatakgcacaggaagaatattcatattccagatcaggaaagccagaggcagggcaaggcaggcaatgcccaggaacaaggaaagcctggtgcttctcctctctcacctcccaggsgtggttgaaaagctggccatcattcttaaagcagccgcttgttttctgttggcttgaaagccagattaaggtctgtttttgaacattttcatcaatgaatacawattttttcattctctccartgtcttaaaagtaagagcactgagyctgtaatacaaatcaccaaagcaaaagttagataaagaggaagtgacaatgtcagcaattccacagkttcatcaccaytgttccctttgagtaaaggatgcattcaactcatctactgtaaaccatctttattgttagtggccctttcctttgggtcaggaaaatattatgactagcaataagtggaaattagagtaggtaattttcagcatgtttgcacccaaaggtcctgttgtatatagcccattagattatctgcacatggagagagaaatgatgtaattaggtattttgggtccttctaatttcactttcccgaatctatatgggactctgagaagcacagagtaagacgtgccgtgccctcttcggtggagttaaccagcggtgcatgtmtaggggctgtcatgaagggatcagactgctaagcaaatcgtcatgagactgaaggaacattgttgcattagaattggaatcactaaatctttagttttatctatttctcttcygtaaattgactttgaaacccactttgcttctaaatccccactgaactctatcctccttcacctccttgcaagccctcctcaggtaattcctatattatataaaataaaatttttatgtctcaccatakgcttcctttctgaytctgctgccaaaacacactataggaaccatcagagtttttgaaagataattgcctttgataacctaaaatagaacattgtaggaaattattttttaacctaagaaagttagaagagaaagaatagtgcagtgcaagccctaggtattggtgttagacacaaatcactaggatgatcatttccatttgaacttctgaaactcaggttctgtattcataagggagaaaaaataactcttactttataggattttgatcacaagataatacacatggatatgtctggctcagtaattgcctcgtcattggtacctactaactattcagtatatttcccctaaggtcattttatttcagtgttatctttctgagaagaaaaaccaaagaagattattttatgctcctggacttktccttaacctcacakttcacaacattggccctctttstgtatacaaagccaatcacttcactgcaacagaccacagctgagcaaacaaatacagacgytgatagatgaaccactgacaacaactcctaacaaaaacaacaataataacaacaataaacaaggtagcttgcaaaataccagacattaaaaaaaaattaagtgcatagcttgaaaactttgcagctgtaaattatgamgctagctgaccacacagattttgaagtcagacggaaaacagcgctaggactgagagttcctcggttcaggttcacttttctttcaccagactactgcataaaaacagcttatgacrtcttggtaygagtaacaattgctttcaamaattatgggcagaaattacttaawtcttctcaccattagataagagaaagaaagccttagattgaacttcctctgtcagttgctcagtagatttcagatagtccagaacataagtatcagatgctagtagggcagcattctgctctccacctccatagggcatttggagaacaaccagattctgcatggcaagtcctagaatatcccctaaaaacaggaaaagcggaaagctgtattgtttatagttgccatctcagcattaataactatagacaaaagaggcatagtgaaataggtaacatttaaaattgagtctaaatggtggaaacaaagaaagttttatgaagcaatttgaaagaagagacagccatgaagggtgaagttaaactgctatgaaaaatatttctgaaaatctcattactagagagaggaggaagttaggagaatgcatttgtttgcttgtttgctagttttttttttaatcaatcaaycctatgaattacaaagtgtaatccatcccttccaagagatgttcatgttaataacagacaaagaagtttgcctttcgtatcaacaacaaacatttctccttttattgagaaaactcccaacatcattaacaggcaacgttaattcgattctccaagaggtgaatttcatatttcagattaatgattataaagaacctcttgctttctgaacactagttaccatctacccaagctaaggtttcctgggaatacaggtccggaaacggtactgtaatccctttagatcccatcaggaaacmtagaggatgatctgawcaataattccctccaattgatagcttaggaaratctctcyattctrttattttaaggatttttaaagaccacctcaaccaagattttcaaatcatagtgaaacacaaaatttrwtcaacttacccacaacagtgaaaaagcctctggctgacccttctdctacatcrtttggcaagtccaaaactccctgcttggaggctttggcacctagaatgaaaatactgatttaaaaaatgtgatggcttctttatatcagcagatttgggggataaacatattggaaataagattccattacttatttttattttacaagttgtttattagaggagatgaatttggagttttgacccagtttaggataatagtacattcagaaaatggcatayaaatctgtgtgttagattgtggcccccgttcttcactggtttagtgcctgaactatttatgtatgaaaaaatgtaaaaactacactgactgtaacacataaaacaacacacacaaaaggtaaagcttgaagactcwgatraaggagtataatcagatcaccatcaaccaggtaaaataatacccctcatggccataaaaccggagactgaggkgcaggggcagtgawgtatctatgggttattttctcctaagagtacaaaagccaagattatattatgtgctattgggcctcaatcctaatatctcattgtccaatattgtgtgacaaccatatcataagaggagctaagartacacatgatggraaaaaaaatagataggagcagaccagcctcagaaagtgaactaaaaaccacctcctgaatattctttttgatggmtaaamttataccataaagataaagcatgaaacacaagaatcctccaygagttatttaaagtgaaatcacagggcacatggactcatgtggaaggagaggacatgamctgattcttttggtgaattttatttaggactaatttgactccctaaaagatcctcttaccttctgtacagataaggaaactctgggtcctttccttttcaataccttcaggctgtcaaagaataacacaaacaagcacagaagaatgagtctagatcctctgtccatgaaggaaaagtgattaagcaccagctcactyaagcatggctggtgcaagtttatccctgagagaagatccaactcatsktccccttttgttcatatctggaaggcacgggacatcacyggyacccattttagcctctgcgttctgtagcttggacaggcattatcttgatgtcactgtgkgacactctcagctcctctgatcctgtatagcatctccagtaaacaactaaaagtgctttgtggagcagggattgccaagaggcaaatcaagagtgttcctctgacaagtgctgattcttgttgaggatgacgggaactgcaygggagtgtaggacaartagatttgtctcttgaatttgagaatcrgaaaaagagaaggaagagaaataggtgtacaggaaacatcttgactcagaaacaaacaaaaaattgtcaagtctrtttcaaatgttaagttttactatcctgggtgaggtattaattaaagaaaggatgaactttatgctgttttaattcatttaaaatggcatgtcttgtgtcaaaagtaaatgttgtcaactaattaagtctcttcaatgagaagatcttttartacaaaacctcttagatgtctgtttcttttcaggaaaagcttgactgtttgcatatccatacctctactaagaagctttkgaccacagtgtctttccagtttagcttttgctgctccattccttcatttgggcaagcactgctttgtttggactcagcaactacagtgatattcactttacctggaagacattcccaaatataaattaaattgatcattggtcccttctgtaatgagaaatgactagagtctgtgaaccatgtcttgaattggattaaccaaattctatcattaagttaatgcttagaacaaaataacttatttcttctccttcctaggtataatgtggtatcttccatttcacctgttccatgattttcatgattccttacattaaatgataaatttacttaattaaaacttaagaaattttaggaaaagtaacattttacaaagttgtctgagtcaatttcytgatattgattgtttataaaggttacttatgacaatataggctaataatgtcagcgaactagggctcctaacttcccaaaatcaagcaagcatagtaaaatatgatatagtagataggcactggattgaaataatgtcctagcaaggaatccattgtttttaaacttcctgatttcacattatgtaattagaactgatctccagtttccttgcttgtraaaattacaggattgaaaacaatcattcytttaaggttaktattatttacgtgactatataccaatatacataaccaatatattgttctytttgttgttgttgttgttgttgkgttttaktgtttctctgtctcaggaagcttgctatttcactcttaaaactgtgtcttcgacttaatgtcataaaactatacaagttggtacartattctgtctcaattgccaaggtaggattttgaagatcttgtgcagtagaaatattgagaaacttcaaatctartagaaaaatagtctgagaacagcatcacaactgagctaaaataatctcatagatatattatttgctgttaaaataatacaatgaatatagtacattaaagaamatttgaatgrccattttttaaaagtagtgattaaaagtgtcacgcacatygtatctagcattccttgtttactagarttttaaactttttccattccatgtattttcaatatttcaataggagacaagtttatttttccatcttgcagatagcataggcactaagacaatattctcagtttttkatctcaatccaatcatttagtgattttggtatccccatggcacatctagtaaatttacaaacctgacaattccctcattggtcattgtgatggagcagcaattttcktgaaggtggcctgggttcatgatggtaggtgaaggacccagcgagaagtcaaataattaaggtggcattaatgatarcatggccttcrtttgggatatggcatatgccaaacatatagtccrtgataggtcatgccagttagcatttatattgtattttaattacattatgctcttgtaaaaatgaatggtggttttgatctacacagcattaacaaccagaaattagattactatagattagaatttctaatggagaatttacaataagaattttaaaaatgtgagggagaaaatcacgtttgtatagacaatwtaaggaaagtaaatggagacaataaatatgggctggtttttccatgrgtgactggtgtagacagatagctgcttacccaatttcttaggtataatagtccagaygtttgttttcctccctccagcttgaataacctcactgccattgattttcmaggtatkaatatttgcttcataattctgagactcctccacttgaacagaaatctaagaaaacaatcatggcaatgaggatagcactggaacacacatcactatgaaacaccatgctcaatacactgtttaaactgtcactgtgaatgaaagcaattgtatttgtttgaggaatayggacctaagtcttayacctttatagtagcattttgcacttgaggataaagagaatatggaaatattaagaaatattttagctttgttagatttttgcctccagatcaaacagaacaackcacctctacacatgtattcmggtagctgaaggcattgacaatcaaatcaaattgttcattttgaacaaccraaaagggtgaggcaatttcaataaagaaaggttgggagacttctagagtggttgtagaggaaatgccaaatccaacgtcrccattcacacaaaagccacttgcctcccattgggttatcgtatcaggaatgaggaacraaagattggcagagcctgaggaactggaagaagaggttatcrgtaaaacacattctttgtctgaaccaagaacttaaaattaagtgcagagcaagcagaaaagtattgactgaagctcaaaagtgagttatattgtttggatggggcattagataaaaataatgagagctggatttttataaaatttgagtatagaaaggtcatttttctttaaacgccacatttttttttaattggggcaggttaaatctgtctgcataaaatgaatagaagagaaactcttggtgaagggaaaacaatgctagagaaaaaaataaaataaaatgtatgataagtacatgcaaatcaatgatayatattttacaaatatggtactgttttatatacccaggaataaacmtgaagaaagaaaaagaaaatagaaataaagacacayaggagagaaaatggttaaaactcactcgacactgacgaggtcccacatccatgtctctgggaagtttgttcttactgtttgaattatagcctgttctacatagtcagcattctcccctctgattccactagctaaaaaaaaaaaggaagaagtaccttattcagaccttggactctgcaaattatrgtctatatattatcagggtgtaaggtctccataaaacacctcactttcctgtatcacagtcacttactatgactgttttcctgtatcaccatacattgcctgttccyctacacagtcaggtaccacataatgacactgtgatcaatgacagaccacttagactacagtggtcccataaagttagaatggagctgaaaaattcctaccacttattgacatcaaagccatcataacgttgtagtgcaatgcattggtcatgggtttgtggtaatgctggtgtaaacaaacctactgcactgccagtcctataaaaatatagcagacacaattttgtacagtacataatacttgataatgatgactatgttaccggtttttgtgcttactatactatactgtttactgtttagagtgtactgttcttacttatcaaaaaaattaactgcaaaacagcttcaggcaggtccttcaggagatgttccagaagaaggcattgctatcatagatgatgacagctccatgcatgttattgccccagaagaactttcagcggtacaagatgtggaggtagaagacagtgatattgatgatcctgaccttgtataggcctagattaatgtgtgtgtttgcatcttcgttttaaacaaaaaagtataaaagttaaagaaaatttaaaaataggaaaaagcttatagaataagaatgtaaacaaagaaaatatatttgtaccctgactcactcagagtaacttttaaccttgcaagctccattcatgggaagtgctctatataaaagtataacttttttttatcttgtataccacatgttcactgtgccttttccatgtttagcaatgattagatacacaaatagttatcatcgtggtacaactgcctacagtattcagtatagtcacatgctgcggaggtttgtagcctaggaaaaatgggctgtaccacatagcmtaggtgtgttgcaggctacagcatctaggtttgcgtaagtacactctatgaygttcgcacaacaatatcacctaacaatgcatttttcagaacaaattctccatcactaagtgaagcatgaytgtatttctgacattgtattttatcaataaaaataaactacatctcacatctgaagctaatttcttgttatagccaaaagcaygtctagtctgtcttattctgctttatccaactataggatgtctaattgtagccaaaaacatggcataattcacacataaaattccaaaattgcatcatttatcccaaatacactaaattccacaaagcggtttggtcatcccccaacaaaaaaatgtaagattacctacatgcaattctagacggaacactaygcattggaccataattttctgtttcyagataaagcggcttagggagtggcagccttctctccatcacacatacttctggttttcggtaatggagattggtaaagactttkagacccatgttctttaaagaaacaaacaacaaaaatattgttcattcttttcatgcaagaactataaaaggcctattatttatattgcaaagataaatggatcataagtatccatattttctgtgttaacaaaggtctgagaagttacaagtcaacttacctctatttgacttatggaaaatccctaatttagagaaaaaattataatcactatgatttatctagcacttattatgtgctagcatttttctaagtattttccattattctccatttcatcctaagtggaaaatacttatgagatcagcactatcattaccctaattaacatcaaacacacacacacacacacacacacacacacacacccggcacactcagtaaattaaagaactggaacctgataaagtytgtctgattcaataccccttttcttacacacttgtgatgttaattataragattatttcatggaaggctcagcatgtctcattaatggcctagggatatctggagtccacactctcttagcctcttgatttgacaatctttgcataagatttattgtattaattggagrctgtcttatttttttaagtgaggttttgtaattatagctacatgatttattttcagcagaaaattttaaaatcaacaaaattaatatctcctttttataagacaatttctatgtactctattggcagattacagacacgaatctcaaagtataggaagaaaactacataattaagaaaacattaatatgcattatgaatactaaaaattgygatgaaatattttccaaaatccttagtgatcttaccctgacaatattatagatatctccatccccatagttgcttacaggtgtgtaatataaaccattgtagaacatatccctctgaggaatgcaagggtcttccttgccatcatcaagattgaggccatggtagaaataaccatacggctctatacttggaaccatgttatacacctatgagaaaaaacatttcccaataattttaagcacttcttttaaaattacaaaattggcaaattgtctactgtaccatttattyttgttcttttctttaagagsacggccatcatatttaatccagtattttcacataagctcttcctttcraaagagcaaaccagttttgttttaggcaactgatgtcatgttcacagaatttctcagcttgggcgcaggatttaagagagaatgtaagaaagcaatgcctgactattgattaatccaaggcccattgtacasacartcaattataatgctagaatttctaagtctggagaataatcttagctgcctgattttaaatcttcttacataatcttctgaagaaaacataaaatcaacaaagagaacaagtaaggatactcatgactaatatctytaacattactacaatwcagagaataccatgatcttcaaattatttcttagtagagaaacaaacaccaaatgccaagagagcttctactgctattgcagagggaaggcttaagagactgcagagaaaaasagagcagaatggcatggagaaatgagaagaaacacacaccaagtcaactccaggtaagagaaagtctagcattgttaaaaatacaaatyatagttttcggactcaacagttcccagtacagcacacagggaaagggcttggastgaatgggcctggaagtggaagcttccaaaaaacatggctaaggggaaataatcagatcacaagaagaggtatgcagatccttggakacagggaatttaaaaaaggaaaggatgtcataggataaaataactccctccaccctcatttccatcaccaacattttaaaaataatgcattttactaaaaaaaaaaaaatagaaagggcgctcttcacctatgaacaccctgcacaaaatatcaagaactagaaaaaatcaactccatacaaagctkctgtaagagaaaataggaaatgcaaaccaaaacacttcagctaatgaaacytctccactaaagtcactaagtaaataaataagtaaacaaagaaaagccatgccaaaataatttaacatgagtgaaatattctcaagcatgtatttgaggtatttaaaaggcaccatgagtcagaaattcwattaagaaaatacagaaatggacaaaacccaagaagaaataaaatgaggctttattgaactcaggaaaactagacaaaattatatcataaataaactctaaagtacaaggacatcaagagaaaattgttcagagaaaactttaaaagcagcayagaggaaaaacaamagaacaaaactgaaaaagaatgaattaaaacaggtcacaaagtgattgaattggaaagcaggcaaggaagatccaacaaatgtacagagatttttttagaacaaaaaaaatggaaagaccaatatttacaattataattcaggggaactatctgaaaataaaagaagatttgagtttacatattgcatgactccactgtgtacctggcaaaacttctacagaataacacattcttactgaaactaagtataaaggggaaaaaacattcaaggccttcagacatagagataaagtagcccataatggaaaatgaattaaactaatgtcagcactattaaaaggcatattcaaagcaagtcaatagtaaggtagcatttcaaaaaattttaaaatgtataaaccaaagatttaatatacaaatacctgtctttcatttattaaggctttagaaaaaataattctgaatatgaaaatgtcagagaattctatacttatgtgatrtcctgaggactctagyagagaatgcactttttaaaaattkttatttatttattyctgagacaggktctcattctcttgcccaggctgaagctcagtggtatgataatggctcacagcagcctcgatctcccaggctcaagcaatcttcccgtcccagcctcctggagaatgagctttatgtaaccaaaagatgactcaggaaattagtaagacttgatgaataggagaaacaatacagaatgtaaacattatatattctgacaaaaaaggaaagatgcaacaataaaatgagagaagagggagagaaaagtggaaactagagattactgactgttgtgtaggtagcagttaagactcaaagattaaaaataactgactagattttttttttttaaatggagtctcgctctgtcgcccaggctggagtgcagtggcgcgatctcggctcactgcaagctctgcctcccaggttcaygccattctcctgcctcagtctcctgagtagctgggactacargcaccyrccaccacgcccrgctaattttttaatatttttagtagagacgcggtttcaccgtgttagcgaggatggtctcgatctcctgacctcatgatccacccgccttggcctcccaaagtcctgggattacaggcgtgagccaccgcgcccggccataactgactagatattaaggttaagcaagaaaaaatgagattaggatattaggatattataaaatatgtaaatataaaaataaccactaaaataaaaattcaagctagcctgaatactcaaagaagctttaagcaagatarcaamaaacaaacataaaagctaaagaaataaagtagctttaaatacaatacagaatcataagaaaaatagtatgatagagctgaggcctaacacatacatcatatcaatagagtgaatagactttattctcctttagaagacaaagatatgcatakttaaaacaaaacayaatgctgtacttcatacaaaaaacaagtgaagtgcatayttcaaaaggtgaaatccaaaggaaaagtaaaggaaaataataagaatgcaaaggctgcaatcctcctgttatcggaaatcgtagaagtaaggccaaaagacatcaaacaagatagagaagaatacttactgctaaaagctgcaattcataataaaggcacaacagttatgattatctatgcagaaactacagaagatgcaagaagaaacagagcactatttgtagggtattttaacacatcactcagcagaagaaggttaaataaattttacaaaataagtaagaatacaaagratcaaaataatccaacctcrtggatagaaaacaaactgataatagagactatatcttctcaacacatgagatatattcgcaaaaactcattatatatttgggcacaaaaatatacyggtggaaatattgctgrccatgaagatatagaacttgaaatttaaaagaaaactctaaaataaattcctttttatatgaaaattataaagtactccagtaagtaaattttcagtgaaagggttaatacaaacagaaattacrgaatttctgaaaaataaaaatggtgcaattgctatgtatcaggatctatgagatacttcaaaagtasaaatcatggaaaaacttataggcttaaaaacacctagcccaataaaataaattaatgaaaatgaagtaaatttctaagtgaaaaagctaaaaataacaacaaaatacagcaccagtaaggaaataatraagataraaatagaaattaatgtgatggagtagcaaaaaacctcacatcatattacatcacattaataaattaaaattatatgtttttggaaaactcggcaaaataggtaaaccacyaactaatctaacaaggaagaaaaagtagctatctgcttaggaacaaaagaaaaacaacttcttccatgactcagttttcagcctcattttttgtccttttagcatcgtgaattggggtccggagttgtttgtatttttctttcacaatagactgatgtatgtaacctagtctcaaatgattcagaaaaaactgaaatgscataaactctgtgtgtgtgtgtgtgtgtgtgtgtgtatgtatgtgtgtgtgtgtagggktggagagagtgagaaagagaaaacaagtayggygaaatgttcacaaactggtgaatcaggccaagggtctacgggagttctctgtgtaattcttgcacttttaaaaattatttaaaactaaaaactaagcttacatagataatacaaaaaataacayaaacttatagaatataaattggaattcactcatttatagaacttcacttgatttatactattaatatagctatcaataataaacaagggcaayctcttttggctctgatatattctgagacccctgaawaatgcctctagaattttytttttgaggtcccttgatggtcttttcttgaggcagttttcctaagatattgccacctccaactgtagaaagaatgagcagaagctatttactctgaatccatgaaactctcaagggaaaaaaaaggwgtgtgtgtgtgtgtacatatataaacatatatatgtacacacacacacacacacacacatatatatatacatattccttttttttctttgagacagggtctcgctctgtcacccaggatggagtgtagtggcacgatcttggttcactgcaacctctgcccccgccagggctcaagtgatcctcccatgtcaatctcccaagtttctgagatcacaggtgcacaccactgtgccctgctcattttttatattttygggggagacagagtctcatcatgttgtgcaggctggtctcgacctcgtgagcacaaacgatctgcccgccttggcctcccaaagtgctgggattacaggcgtgagcacagcacatggccatattccatatttatagataaatttatcctttatttgttgatgycccctcagattctgaaagcttctaactaaaagtatttttgctcyctgtaatagaaaacttaaatgtatttatgttttgcattgagaaaaatgttttatataatgatcyatagttattcaatattattactgaattctataattttatacttaaaactggacttactayagaatgttgaaagcaaaatacaaaactattttttggtgagatctcaagtttgtaaaatatatatgccttcagaaaagagacttgaaaaattacagcaaaactataaagatgcctaagtgttaggactataaatgattttaaagatttccttctttatgtctttgtatactttgcacaaagtacacaatttaaattagatttaaatatgatcataaatttcaatagttatttatatgtaattgtgttagaaataaacggaaaatatccaacaattgttaagcgaaataaattggatgtgaacttctggaattccaggtctggaaatgtttaagaaaatacaatatccatttatagataataactttacactgaatccaagcatatccttgaacatagagatttcattttattccaagtttccacwtctgtgattacacctatgatttttaaaaatcacagttgtaaaattcctaaactgttataattatctatcaaattctgtattgttataagcatgctcttaggatagccaagaaaaatacgtatataatccacgaaggaacaaaggaagaaaacattcaatattttcaacatgttcaagacatcatctgaaggataagacttctggtagtccagagaaacatgaaaaacgaggaagtcagagagcttacactttcagctgacagctgttgttcagatttcagtagaaggacgttcccatccacagccccgagggcacagaataagacaggcgccgcttgaagatagagactagcattggaaccaggtaagccctgctcgttagagaactttatgttaacctaaagtagagaaaaaaaagagatgagagtagagaccattttatgtaaagatgatctgaatacatttaatctctcctgaataaatccttatagatttctatackgtatttcctttgcccactctcaccctcagctttctttgcaggagacccccttcaccacgtgctgccgtctcaggattggcactgctgccaaggatcatgcattgtgtttggtgattctcacatcccctaataattcaattatgccagcactgagtgtaagtttcccacgtgaaggtgatagcagtcaggcgagaagacagcagggagcaaactgttcccacttctcaggccagaaataggagaaacatcaccttgtgtttaaagcacttgtcaacctggaatctgacactgtcagccacaatttccccactggggtgaagggtgtagacaaacaggacggctgcaggagccagatcagcactgatgctgagtgggaacgagaagtttccattccaggctgtgtaaataggagacgaagagatacgatgctgaaagtttcctgaatcactggtacacttagataaaagagaatagctcatggacagaaagagtaaattgggccctgttttcaagacaaataaatcaaataataggaagtacatacacaaataaagaagactgcataatttagataataacaatactgggattttgtacaccacttttctttttttattttttatttattattattattattctttaagttttagggtacatgtgcacaatgtgcaggttagttacatatgtatacatgtgccatgctggtacgctgcacccactaactcatcatcgagcattaggtatatctcccaatgctatccctcccccatccccccaccccacaacagtccccagagtgtgatgttccccttcctgtgtccatgtgttctcaccattcaattcccacctatgagtgagaatatgcggttgtacacctcttttctaatgtactcaatgatctgacaataaaagaaacaggtagaactctccttcgtcaagacatttagtagcttccctcaggctgtgctaactattaccttcatccacaaattgaaataagtgctcgttctaacttcttttcactatataatatatacacatacatatatacacacatatatatacacacacatatatgtttgactaaatatattttcttaatatatataattcccatatatataatgtctatatatccttaacaagaaaaaatgaagttagagcacatattttaaaatgaatacattatgtatacctttgtttctgatttccttttgtccactgagtaagatagctccttttaccatcatctgtgtggaacaaagaaaacataacatgcaatatattatctgatgtcatcatattctcatattgagattaggtaattcattacttaatggtaattctgttccataagatagggtagcttccacaagcaaatattaaaaatagactttgcgtaagttggaaaagagcagagaaagtgactaaaactgattgagattctatcatgtactggaaactttgtgaactatgtgcaatgcactgtgcaaagtggcacataaagctctgaaattgtcaaggctgtccggtttcaaatacgccttcacctgctcattaactttgtgacttaaaacatgatgttttacctgtttgcctctgttccattatctgtaaaatggagatatctataaggctaattaaatgagttaacacatatacaatctttataacagtgcctgacacagaacacttaccctaagaggtaagtcttataatctccaattacactgtacacctgaggaagccaagggttaaagagttcaaacaatccgtccaagatgcactaacttgcatgctaactaggagagggtgggggattcaagttaatgtcttaatttccaggtctgtgtcttatcactcttcaatagcccttagagcagaaggccccagtccccaggctgtgtaccggcaggtacctatccatggcctgtcaggtactaggccacacagcaggaggtgagcagtgcggtgagcaagcattaccacctgagctcctgtcagatcagcagtggtattagattctcataggagcacaagccctggtgtgaactgcacatgtgagggatctaggttgtgcgctccttatgagaatctaatgcctaaaaatctgtcactgtctcccatcaccaacagataggaccatctagctgcaggaaaacaagcacagggttcttactgattccacattatggtgagtatgtaataataatagaaataaagtgaacaataaatgtaatatgcttgaatcatcctgaagccatcccaccatccccaccccatctgtggaaaaattgtcttccatgaagcmagtccctggtgccacaaaggttgggggctcctccttagaaagacaaaatggacagaaccaagagaataaagtccttttactgcttatcaamataagctttccaccttactttctggcatctgcccaatattttactattacaaagtgtcataaatacttgatatgagttacatttgaatgcttaaacaagtggactctgaacagcaagttcttcaaccttagggaaactttaattgccttagatcgttctatgtgtttgtttgttgttaatggatcgaacagtattcaccagcaaagtgagaaggctgcccttactctggtcaccgtggcatgactgatgcatgmtttctaagctgtgctgggctaagcagacgtgcaattgaacaggattccaggaacccactgactgagacttaccaaatagaakaactttacattggaatcatcctcatatgcttcactgtttagggagtaatgcacagtaacaaccttctggtgattacattcaagctgctttggttctggaacaatcttcaggaagctgttsgttcgggagtaaaagcgtgagactaagaagtgagcatccaagtactgaggcgtcaaccagctgggaagatagcagctctyaggtcgaacatatgtggcctgagatgacaaaagaaagtgaagggtcttagtatcatgacatccgaagacagttgttactgagaatggaggcttctcaactctccagagtagggaggaatctcagcttgtggctgacgttttaatgttaagttattggaatcaaaataataatagcacctgctctttgtatacaaaacgtgaccatgaaagaytgtgtaaatatttcattagactgatggtgaattgttatgttttttacactttaattgaagccacagaattgggtttcagttctgtttctttcagctacatgtgaacactgacaaattatttaactgcaaaattctgtttaagcagcrgaaaataaacagaaagtataggatctcccctatctatgcatgaaatgatctgaggaagaaagtcaaatcatcctcatgagctacttcttgtttcctaraggaaaatattagttgttagcaaatttataacaatcgtgatagacttttagcttcccatcctcttgaacaagtattctcatgtattatttagtgaacaagcaaatttataaaataagttacattttaaattttctttaaaatakattctgtatacaagctatcttttgagatattcctaatgtttaacatttctgatatccaaatcctctgtgggatgtctaatggtcttcttctgttctttgatgtcttacttttaggttgaactctggatcaaatatgtctgaagtgtcaatggaaaattgagcttcgccattctcatccgtagtgtaatttcctataaattcatcattgagctccagttgcaacaacttgttcaccataggtacattattgggatccgaaaatttaagctgtacgagaaaagaataattaacatgacttaaaacacaaaatgtttacatttttacagagaaatagttttctactcataaatgtgatccctagtcattttcctaaattccaacagacagaaagatgctctattaaatacatagatatataatataaagtatggaaaaaatgatactgttatctattgcttctttcaatctaggacactttctagcacctcagacatagtagtgcttaaaatgtattacaaaagtaggaaaaaagtgaccagaaattttcaaagggcaatctatgatccaagaaaatgaaatggaagcatgtattctttagtcaaacctacagttccaaaataagaaatccctcttctgtagaaagtatccatgttctcaaagtttacagttccaagcaattgagtgataaaaactgaggtcttctcactgatctgcatacctgtaaggaatgatgaacacagcagagtgaaaatatctaagttaccatccacagcaatataaatgtgaccagcttgcccagtgtgaatagcatcatgatattgatcaagtatgcttatatagagcactttacaatggcataatcacaaactcctttttaaataacaagaaataattagtagttaaatctgattttcccactccaaattaaataattaatctctttctcccttctttctggtttttttttttttttttttttttgagactgagtcttggtgtgtcacccaggctggaggctggagtgcaatagtgcgatctcagctcactgcaacctccgcctcctgggttcaagcgattctcctgcctcagcctcccgagtagctgggattacaggcattcaccatcatgcccggctaattttttgtatttttgtagagacagggtttcaccatgctggccaggctgattttgaactcctgacctcaggtgatccacctgccttggcctcccaaagtgctgggattacaggcgtgagccaccgtgcccggcctcttctttcattcttttaacaaatacttattgaacactcactttgtgcaatcttgtaaatttttcagtaataatttttgcacttgcaactattcccagttgtattaaattagaaataatctgaattttgtacttagtgctaactcaacaagcttctcccagtaagttgccatacatatatccccaggtcgtccaaaaaatacagtaattacctgtcccagattctgtaacaattacagcgacatgaaatgtcatgaacaatcccgaacggtagagttggaagacttttgtatttacaatttgagaaacacaaccattttccaactgaaaaataaagagaaggtataattaaaatgttagagatccaagaggtttttttaagtgtcttttaaaatatggtttttgcacaaatatattaacatccccaccccgtgccacggctctacctcataaacttgttgaaatggccaaagaattaaaggaggagtaggaggaggcgaatatttacatcagcattttaaataagggaaggaggtaatctgtattttacagatttcaaggaaattctcctggaaacattgtagatgagaaaagattaaaggatggaaatgaagctgaatggtattgtgaaaggaaagtaaatctcaggagcccaacatccctaagctaaagggaaagggcaagctgggaacagctgggcaaatctgtctcccattttattcccaaataaggtagctacaaagataaaaactacatacctccctcacaatttgcccacaaggaaattctttgtgggcctcaagaacttttccttaaaacagttctttggaaattcaccctggcaatataaattcatagcttatctttacaggcgtgggacaaaagacagactcagtcatccctctgcttacctgagacaaatacatatctgatttatctgattgcttcctctgcctaatagtttatgtaaaaatgcagatttactgagccacactaaggcaggagtgactattcctctatcctcctctcacatgtaatttgtgtattcagtgaaaggctgatcaaagacaaagacttattcttttttttttttttttttttttttagatagagccttgctctgtcactcgggctggggtgaaatagcccaatcttgactcactgcaacctccgcctcccaggttcaagcgattctcctgcatcagtctctcaagtagctgggattacagacacctgccaccacgcctggctaatttttgtatttttagtagagatggggtttctccacgttggtcaggctggtctcgatctcctgacctcacgtgatctgcccgcctcggcctcccaaagtgctgggattacagctgtgaatcactgcacctggcctcaaagacttcttctttatgcaactgtttgtctcttatctacctatgacctggaaacccccttagtttggattgtcctgcctttctggaccgaaccaatgtacatcttacacatatttgttgatgtctcacatctccctgaaatgtataaaagcaagctgtagcccaaccaccttgggcacatgttggtaggacctctggaggctgtcataggtacatccttcaccttggcaacataagctttgcaaattgattgacatctgtctcagatacttttggttcacagtgttttaagaggaagaaattctaatcatctagaaaggcactaaaacagatggaacagaagcgctcagcacatgtgtaacaacaaaacaaacactttttaaggtatattgcttatttaaaataacaaaaaatctatagttaatctatcatcagtaataataatyagagaaatataaatttagttatattttayaacacagtgtttattccagatttaaaatgttataaggatatatyagtttatttgatactcaaaactattacatgagctaggtactgttattatcttactatatagatgaagaaactaaactaggtccatcatgtaacctgtccaagatctcacagctaagagacggtggtgctgaggagctgctctggctccagagtatgtgcttctctatcttaaattaacagccattacatcaacaacaaaagcaattttattttgtctaatgataatatagtcaaattaaaatgaaatcatagaaagtgatcagaagaaccttaattatttcgaaaataagagaaaagccttttttcaggaatccttgaaacaaagagaatacataaagtaaaccaataagaatccagatattagagtaatgaaaaaatacttcgcatcaaagtcaatggtattcagctgcagttcagaagaaatgtaaaacagtgaatgtgcttattactaaaagaaacagctaatatattttttaaaccccaacaaaatcaactacaaatattagraaaaagaattaataagatgaaagagaaaataaattatttaggaacacaaaataataaaagaaagaaaatagtaaaaataagaaccaataaaatagacgaaactttcgtgggcatgatttaggacaaagagtgagagagaacaaaattgtgagataggtgctaacacaacacagcccacatctggaagaaaaattcccattttagaacatcattggaagtgaactttatgtctattagaaaattgtaaacaatcttaagagcatacttagatagccacatgtacaacacaggggccagtgagattttttttctaaggctggaaacccaggaacataaggaaggtgggtatgtcaaaaatatgacaaagtaaatgagttgcctatttaaataayrggcttgaaaaaaaatgcttgkaggatggaaggcagtacttacactgaaagtttccatttcacatgaacagaaaaacatgggtaattaagagttctcaaatccaaattgataacaaaaatatgaaaagttgctcaaactaaatmgaaattagatagcacaagttaaaacaagctaaatttgtgtctatcaaaatgacaaaaacttttaaaacttctaaatatattgctgaaagtaatttggaaaatatagtattctcatgtacttctgacaggaatttgaatgcctaaaaacttttaggagagcaatatgctaatatttattaaaattaaaattatctgtctatgaacattatctatatttcctttgactcaggaaactcactctaagaaatttatttcaagtaaataaagcctctcatatataaagatagttccaccggacagattttttttttttttctttttctgaggcaggtcttgctctgttgcccagsctygagtacagtggtgcgaacacamttcactgcagccttgacctcctgggctccagtgattctyttgcctcagcctccctgtagctggraccacagatgtgcaccactgtgcctggctaatttttgtagagaaggggctcactatgttgcccaggctggtttcgatctcctggagtcaaatgatcctcccgcctcggccttccaacatgctcagattagaggtgtgagccactgctcctagcctctaccagattgtttatgggtatttttttcacatgggggaaaaaaataaaccatttgctgagggaacacccatcattgtgtaaaacagttgactgaactctatcagaatgtactgctgacatggaraaattccaccctagttttctttgcctgcatttcctatgtaaaggtaggattctgcttgtctttgtcaattattgatatttacctagaggatgttcactaaatttgatgagtaactttaggacaattggacttaaaatatgaactatgtggcrtacacaagcttcactttggggagtcaaaagacaatttcaaagagataggaagagytgttcacttaaggttaggatgctgcagatagagcaaatgatgacttcacatatgaactgcaagtctaaagtaayatagtgggggtactctgaattgcagttgattgmaagtaagctgtttccactaaaaaaaaatccaggtggcatggagagtaatatcacagactcatttaaaggatgattaacgattctccaaagaaaaatcaggaaggcyacctaggcgatatayaaaacaacaaagcccacgatacctttcatattctaaaaatcccatgaatctataggtggagaacaatttacatggtctatggaataaaaaactgctttaagcactgtattttcttctctttcttcactttatttagctgcaaactccattatcaataaaatgaaaatagtattgttaagytccccttataaatgaaatcaaagaaagaataagaatgaaaaatgagtgagaactttttttggagtaaagatcatggtctgtacctgtgcaataaattgctcacatatttcattktcatttttctcacaattgcttgaagaaaaatactctctgcacacccggatttgggtttccccttgcacaggttggccaaaggtgtacctaatgggggaaggtgtagttatgattacagataagcaatatcatagcaatattttatgatcttcttcagaaattatataggaagtctctaaactgtgagtaacccagtctaaccaaattgaattaggaattctccctattggtgagggtttaggttccccacagaattcaggttaaactgggcatttcatctcaggaggatttggctgcctttaaaaaattgaattcagggtaaggcagaatctaaaataatctaaaatctcattgaatatgatttaatgcttaaattgagttttttaaaaatatattttaatctgatagaaacatcataacattgcagcactttcccttttatcagaaaaatatatatgtatataaaacttggatgattcaggatcctgaaacatttccagatcaacattttaaacacgaatttttatttaccactcactaaatataaaggctatggggctggcatgaactggttatgctttgaccaaaaatataaccagtttgagtatctcattttctcctaaaacacaaaactacaacacaagatttgtaaaggttcaaccaaaggcaaatccagtcaattggagttttttgttttgttaatagacaaccaaatgtaaaactagcatataataaaagtgaatattattttcacagattatattacttttttctaaytgttggacactgatatatatcatttatttttcccagtgaccctgatttgtaaaatgaggtcaagtaacttctccacattgtaattgatgaaactaaaattcgaactcagatctgcctcactccatagcctgtgcccttttctttccactcacctttttctctttctatttaaaaattcctaacacttttgagattctgagtcaawtcataccaataaaatcatgtgtcaggtttcatgattatataaaggccagacttagatctggccacacatattatacctgaacatttcttcttatttctacttaatgtyttttatttatamaataaaagtcttattgtattatctgtaagctaacatatgcctataagacatgtagcttaaattttaaaaacaggacagaataatcccttcgtgatttgaaaagctttcagtgaatgctaatgcagtgtattaaaatctcttcgtctgtaggtaaattttcttccctcttaaaagcctaagtcatctctgactttgtttgctaaaataatccaatttttttcttgttttctctagccattccaagctaaatcccagaaaaggctaaagaaacacagacacagtatcatacaatttgagacacagtatacaactgacgtgaaccttctagaaacagtgctctcacaatctgcccagaaataactttgtagcaagcacagctccagtctagctgcctggcctcctggcaggatattattattgctgatactgatttactccttaatataactctatccaaaatacaacatcaaagaaatttcaagaaatcaggatcatggattgtaacctgacatactgctaaggaactaccagttccatgttagcatgaggtttgcaagtattttccaaaggccatgtttgagaaacatttttgttcttccaatgtgttgtgggttttgtttttagcatactatcgtgcagataaataaatgagatgttaatgccactgaaagctctggctttgcgtttggcttttctagtgaaacctgtttagkattctggatttcttccarcttraatttatcacctcatcatttttaacatcagtgatctacacagtctctcatctattacgtatattaaattctggtattttcaactactcttcattaaaacttagaaaaaaatttataatcatttcctaaagtcaaaagaagatttgaaatgctactgaaaaaaaaaaaagaaggctgaaaactggtttgcaagattctctggggcatcaaaggcatcttaagaaccacscttgcacgttcattagacagccctttaatcaatgtatctttaatagactgctggaaatactcaaaggcaagtaattttcatgtcataaattaaacaaagtgcttaacaaatatggcaaatattaatattgttaactgtttttataaagtatatgacagttattgattaggagagtagctttgaagctgaaaaacctaggtctaaatcctagttctgccatcaacaagctccattactgttgataagttattttaattctctgtgtcttattatctttctttataaaatacagatgacaatagctcctatctcatagcactgtggtaatgatatatgcagagcttaacaaactagttgacattcaaaaaacatttattttattttttattttattattttttttctgagacagagtttcactcagtcgcccaggctggagtgaggtggcatgatcttggctcactgcaacctccacttcctgggtgcaagcaattctcctgcctcagcctccccagtagctgagattactggtgcctgccaccatgcccgtctaattttttgtatttttagtagagacggggtttcgctatgttggccaggctggtctcgatctcctgacctcggatgatccctcccccaccttggcctcccaaaatgctggcattacaggtgtgagccaccgtgcctggccaattgtttataaattattattagaaatttgagaaaaggcagtaaaaaagaaaaaaaaattaaaaataattttccaaaaacaaaatacaaatttctgaaatcgtgtagatttttttacattaagagaattcaaataattcagattaacttgataagatgctttatcttcactttgccatttcaatagctcatattctaattttaatgaaaatatgccatgatagtaaagattcaatgagaatttcacaccagctgctagaatcctacactggcacaacatgtttagtgaggagtatggcaatcagaagactaaaagaatgttacatattttgtcttggtaattccttttctggaaatctttcttaagtaaacaatttttcattcaaaagctacctattatatgttatacacaaagacatatactgcaaaattattaattaccaggaaaacaaaatgaaacagccaacatattatataataaaataattaaattgggtatagtcacataaaaatatgtgcagcagaaaattggaattcatgaaaagattggcataataygwaggcatgttttcttaattattataaatagaaaagtatgattgcagtcatggaaaatattcattaaaattagaggamacttacaatgttagtgacattacaatgttaatggcagttggtcaaattaataataggtaatgtcttgtgttyttctctatatttttcaaattttctacartgaggattcattgcttctctaayaacaytaatgtaagcatataaataattaaagtttyatggttaatctcacttctcattctctctgagctttgtgttttcttgtgaaggtaaatctctgaataaatactcacttagcacatacatccacttggaattcatcatctgaaatagttactgtttgtggtgcattgaccrtaacttcaaacttgggcagcactggaaacgaagagaaatatacgttagcctscacaatcacaggcaagcaaaccttattgcagtcatatagyttactatgattccttgtaccctccatctgtatgagctatgtatcatttgccccaaattgtgtggcaccattctacatggtggtgtctcactaatgattaattcttcctctttcttttcttttccctatcytcagaatttcacattttgtttctttttgtttgtttgtttgagacggagtttcactctgttgcccaggctggagtgcagtggtgcaatcttggctcactgcaacctctgcctacrgggttcaagccattctcctgcctcagcctcccgagtagctgggattacaggcatgcacgaccacgctgggctaatttttgtatttttagtagagactgggtttcaccatgttggtgaggctggtctcsaactcctgacctcatgatccactcrcctcagtctctcaaagtgctgggattacaggcgtgagccaccacaccyggcctcacattttctttctattgcaatctcttagatctctcctagaagactgtggggattctagaaaaaatgtatattttctaggggaaaaagaaggcaggaatcagaataaggatactggggaaggagagaggagcagcaaagtgctgatgacraagccaaccaggtcaaggaagggagacaaagaaaaccagttctagcttcacctactcctgcctaagtctaacayaaatgttgtgttggtccatcctttaaactcttcatctacayaggacagctacaaatagcaactggttaccatatcttttaacagcaaattggtgtgtcactgtctyccttgagtttcttttcacaacaatccagtaatctccaaacattggttctgaaatcagttggaacgagagttgggtaatatttcggaaagaagtcacattttgccwttgaaaaatccrattgttttgaggatcctagaaaataatgaaaaaaatataaacaatcagaatttgtatgagagtattaccctttgctgccatatttcggatagtttcggatagtttcacaagggttattttaggccaatattttctcttatgaaacaaacaagtagcttttggtagagcctgtgagggcttaagaaccctaatgtctataaatcttagaggattatacactatgctttggtcatamaaacttgtactgcctttattcttttttctttttttaaagtattgtaattgtacatacttaaaggatacaattggcggggcacagtggctcacacctgtaatcctagcactttgggatgccaaggtgggcagatcactagagccmaggagttcaagaycagcttgggtaatattgtgaaaccccatctctactaaaaatacaaaaattagttgggtatggtggcgtgtgcctctgtaatcccagctacttgggaggctgaggcaggagaatcgcttcaacgtgggaggtgaaggttgcagtgaaccgagatcataccactgcactccagcctgggtgacagagtgagactttgtctcaaaaataaaaaaaaaagtgggggggtacaatttgatgtttcaatacacacacacacacacagacacacacacatatctatatatktagtataatgatcatattggggcagtgttaccagtacttcatycatttatcttttttttttatggtgaagacattcaaaaacctctcatctagctattttgtaatttgctaaatcttactgtaaactattgtcakcctactgtgcaatagaacaccagaactcattccttcttcattcttttcarattaaataaaattttaaaacactygtagagtgtcagatgtgttccaaggactgatccaartgctcaaggcacaaaaatgtatatgacatgttcacagcccatattagcttaaaattttaagccactgtgctccttgttattatagtcatataattttcttgcattatggctgcaattcacattctgtaatcagggtatagatgtctaagtaaagtgttggcttaataattgttgttctaatcaaattgaattacacgttaacaaaacttacttaaattttccttgtatatttaattctatctcttcccaggccaagtcaaaaaaaatatgaaccyttggaasaattacatctagaagtgaccagtcctagtctaaatatttaaatacataacatgaggaattcaggccaaaagtttattctgataggtctattttttgatgtactaataaaactggccatctctgctatagttttgctaacttgttgcagaagtaatctcaagaagaaaayagccctattagattatgtttaggatggatagttcaatatatattttgccaaaatgttatattgagtttacacaaataaacacacacaagctgtcataataagttcatttagcaactgttttaggrtagatttttattctggaagatccataatgaattatattttatatgaagacagggctaccttttgcgtcaatattttgataktgaagagtgctggtacatcaataaagtacttgtatagtaaacaaattaaagatgttttgtgaactagctaggccttgaagactcacagggyttggtgtgtaatactgtcattcttagagataattagctccaggttgttctttctgctggaattgtgaattgcaaatccattcttatcagagtgaaatcagaacttcaaccctaatcaaaattgattggatgaattattgagtgttacaaaagtkatgcaatgaagggccctcatatttttgacattcatttttattagatccttcttatytggagattaggtatgtgagaagctcggagaaataatcttagaagagccaagcagaatttttatatctaaatccatgttacttacatagaatatattgttctttaaatataaaaatctataaatctgtacaagaccaatcgatacaagtaaaaaaaaatgtctgatcctgcttgaagtaaattatcaaagccatctacgttgagagatgaaatgtattacgtctctcctgctaacttgaggagtaaaggaatttaytaaaaagttactaggatgtttttattccttttctttttttttcttgcagtgaagcctgtagatccttaagattctttaccagttgtgtggtcttaatttcacaaattgaggaatctgatccatagatggttccacttgaacgtggtgggagggtaacattctcyttccatgaaatgtaaagactgcattgtgggacatggaggggctccatgagatccatttagttgcattcatcctcctgtccccaaagtatatcagtaaatgtaytgtttcttgacagtttggctgtgttatcccagasgmctggatgtgggaatctccaaatggccagataatactctcagcttccaattcagtgaaactattcttaagcatgttaatgaaaatatacttctttcctggatcctaaaaggtctaaatgaaaacaactcctattcytraggatggaaaacaagtattctgcaaaagccactaccaatccgtaccttggttcccagacatatctctagaagagacagaaacaagccctttaatataatttcattcctcaacttccttggaattagtcccttaatgtgtcttgttctaaatccctgatcatcttgccacacatttgttaaggcttataaaagagtgtacatctttacctcaggccatttgtagacttgtcatatactttggtaatttcccaacatatgcgtttcacttccagtaaagaagttagaagactccattcccagattaccttgaatccagggggcaggtaaatgacaggctcgaccartgagatgctctgttctgagactgggaatcagaagggagtgaaatggggaggccatggaagagtttattttcagggaactgtgagtataatggcaacttctagttcattkaggataagataggcagaaccttttcacatccactccaatgtgtttattccacacacraggagccacagtgggaattctgatcattgctagacttgtcaattatacctacacatttggaaaatgaataaataaccagaagatggatcyggtctctgttagwcctacaatgaagacaatttggccccaaattctggttattcctgatagtcataatctttgcctctcatctcagatgttattagtgaggtaatattcagtattttatagaatatttagatatttatctttccaggagctcatgtgctttggtaatgaggcagaatrtctttgagaaagatagaagtgagaccttagggatgggtgtctgcctaactgaagtggactccagtgaaaattatataaatatcaaggcatgaaaattcagcactccctatcatgcactggtgaaaaagataatcaaataatctcctgttcaccattgacaaagtgcctattgacagcaagcatttggggaccacaaatttccactgctatagaacgataccaggctgattacttctaagagttctgagaaaattaaagaaaagaaaaacaagctaggaactttaaattagcccttaccatccggagttctgtaacagaattatctctaagtctccaatacagctactgaatgtaatgaattaatattacatttattgatgcataaatagtaccattctctcctatatatcctgaatggtactatttatgcatcaaatggtctctcgaaacattctctgtggagttaaacaataaagcaattttcttatataacagttgagaaaggttgctctaaatttttggttgaagatatacattgaaaagtgagtactttcaatttttatgttaaaactctcatttattgcagagcagttctgtaatcaaaatgcctcattattgtatgtgcttagatagaggctgataatttacctgtgagggattttttaaaaaattactgactgtggaggggaggagccaagatggccgaataggaacagctctggtctacagctcccagcttgagcgacacagaagacggtgatttctgcctttccatctgaggtaccgggttcatctcactagggagtgccagacagtgggcgcaggtcagtgggtgcgcgcaccgtgcgccagccaaagcagggcgaggcattgcctcacttgggaagcgcaaggggtcagggagttccctttccgagtcgaagaaaggggtgacggagggcacctggaaaatcgggtcactcccacccgaatactgggcttttccgacgggcttaaaaaacggtgcaccacgagattatatcccgcacctggcttggagggtcctaccccacggagtctcgctggttgctagcacagcagtctgagatcaaactgcaaggcggcagcgaggctgggggaggggcgcccaccattgcccaggcttgcttaggtaaacaaagcagccgggaagctcgaactgggtggaacccaccacagctcaaggaggcctgcctgcctctgtaggctccacctctgggagcagggcacagacaaacaaaaagacagcagtaacctctgcagacttaaatgtccctgtctgacagctttgaagagagcagtggttctcccagcatgcagctggagatctgagaacgggcagactgcctcctcaagtgggtccctgacccctgacccttgagcagcttaactgggaggcaccccccagcaggggcacactgacacctcacacgtcccagtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaaacagaacagaaaaactggaaactctaaaaagcagagcgcctctcctcctccaaaggaacgcagttcctcaccagcaacggaacaaagctggatggagaatgactctgacgaactgagagaagaaggcttcagacgatcaaattactctgagctacaggaggacattcaaaccaaaggcaaagaagttgaaaactttgaagaaaatttagaagaatgcataactagaataaccaatacagagaagtgcttaaaggagctgatggagctgaaaaccaaggctcgagatctatgtgaagaacgcagaagcctcaggagccgatgcgatcaactggaagacagggtatcagagatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccaatgttcagattcaggaaatacagagaatgccacaaagatactcctcaagaagagcaactccaagacacataattgtcagattcaccaaagttgaaatgaaggaaaaaatgttaagggcagccagagagaaaggtcgggttaccctcaaagggaagcccagcagactaacagcggatctctcggcagaaaccctacaagccagaagagagtgggggccaatattcaacattcttaaagacaagaatattcaacccagaatttcatatccagccaaactaagcttcataagcaaaggagaaataaaatactttacagacaagcaaatgctgagagattttgtcaccaccaggcctgccctaaaagagctcctgaaggaagcgctaaacatggaaaggaacaactggtaccagccgctgcaaaatcatgccaaaatgtacagaccatcaagactaggaagaaactgcatcaactaacgagtaaaataaccagctaacatcataatgacaggatcaaattcacacataacaatattaactttaaatgtaaatggactaaatgttccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaactcagctctgcacggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaacctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttaaagcactaaatgcccacaagagaaagcaggaaagatccaaaattgataccctaacatcacaattaaaagaactagaaaagcaagagcaaacacattcaaaagctagcagaaagcaagaaataactaaaatcagagcagcactgaaggaaatagagacacaaaaaacccttcaaaaaattaacgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacatatacactctcccaagactaaaccaggaagaagttgaatctctgaatagaccaataacaggagctgaaattgtggcaataatcaatagcttaccaacgaaaaagagtccaggaccagatggattcacagccgaattctaccagaggtacaaggaggaactggtaccattacttctgaaactattctaatcaatagaaaaagagggaatcctccctaactcattttatgaggccagcatcatcctgataccaaagccgggcagagacacaaccaaaaaagtgaattttagaccaacatccttgatgaacattgatgcaaaaatcctctataaaatactggcaaaccgaatccagcagcacatcaaaaagcttatccaccatgatcaagtgggcttcatccctgggatgcaaggctggttcaatatatgcaaatcaataaatgtaatccagcatataaacagaatcaaagacaaaaaccacatgattatctcaatagatgcagaaaaggcctttgacaaaattcaacaacccttcatgctaaaaactctcaataaatcaggtattgatgggacgtatctcaaaatcataagagctatctatgcaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgatatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaactcccattcacaattgcttcaaagagaataaaatacctaggaatccaacttagaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgacatccccatcaagctaccaatgcctttcttcacagaattggaaaaaactactttaaagttcatatggatccaaaaaagagcctgcatcaccaagtcaatcctgagccaaaagaacaaagctggaggcatcacactacctgacttcaaactatactacaaggctacagtaaccaaaacagcatggtactggtaccaaaacagagatgtagatcaatggaacagaacagagccctcagagataacgccgcatacctacaactatctgatctttgacaaacctgagaaaaacaagcaatgaggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatagcaacaaaagccaaaattgacaaaggggacctaattaaactaaagagcttctgcacagcaaaagaagctaccatcagagtgaacaggcaacctacaaaatgggagaaaattatcacaacctactcatctgacaaagggctaatatccagaatctacaatgaactcaaacaaatttacaagaaaaaaacaaacaacccaatcaaaaagtgcgcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaatacttttacactgctggtgggactgtaaactagttcaaccattgtggaagtcagtgtggcaattcctcagggatctagaactagaaataccatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaataacaaaaaaccaaacactgcatattctcactcgtaggtgggaactgaacaatgagaacacatggacacaggaaggggaacatcacactctggggactgttgtggggtcaggggcggggggagagatagcattgggagatatacctaatgctagatgacgagttagtgggtgcagtgcaccagcatggcacatgtatacatatgtaactaacctgcacattgtgcacatgtaccctaaaacttaaagtacaataataataaaaaaaaaataaaaataaaataaaatagcgtcctgatgttctgctcttttcctttatcttgttttattttccttacagtagttctttgagagatagtaactcacgatagagaaacatggtctttgggatcagaacgtctggattataatcccatctctgttatttagcatctgttgcattggacaagttacttaacctgcctaagcttcatttttctcattgataagttgcagttaatagcttccaatctatagactgtgatgaataaatgggttgacatttgtaaaatgcttagaatgttgcttggtatgtagcaataattcaggaaagattaactatcagagcacttaataccatctgaaattatgccattgatatagtttgaatatttgtcccctcaaatctcaggttgaactgttatccccagtgctggaggtggggcttggcaggaagtgtttgggtcatgggggcagacccttcattgcttggtgctgttcttgcaatggtgagtgacttcttgtgagatctgattgtttaaaagtgtgtgacgcctctcctcttcttgctcccatactggccacgtgagacacttgctcccccttgtctttcaccatgactgtaagttttctgaggcctccccagaaaccgagcagatgccagcaccatgtttgctgcacagcctgcaaaaccgtgagccagtttaacctattttcttccttttttttttttttgaaaaggagtttcactcttgttgcccaagctggagtgcaatggcacaatcttggctcactgcaacctctgcctyctgggttcaagtgattcttctgcctcagcctcccgagtagctgggattagaggcatgcaccaccacgcctggctaattttttgtatttttagtagaaacagggtttcaacatgttacccgggcttgtctcaaactcctgacctcaggtgatctgcctgcctcagcctcccaaagtgctgggattataggtgtgagccaccgcacttggcccctattttctttgtaaattacccagcctcaartatttctttacagcaacacaagaaatatacaaatgacaatatgcagccatttgtatattgtctgcatcccaaattcaatgtaaacttcaygaatataaagatttacctgcattattctcactgtatttctarcatctgacatgacaggcacattaaatgaattaaaagacaaagcaaaagaaaataatcayctcccctcttttcccaatcagtttaaaagcattaagagattataacctgtcacctgcccttcgcattatactgtgacttacctaagggtatgtaatcagtagaktcaagatggttagaatccttgcacaatactggtttccggaggtgagagttggtaaaaatctttaatcctgttgcctttcaagataaaatcaattttagatcacataacaacatagactagcagtctggactggttttttgttctatgtatattttcaatttccacttatttatttctccatctctaattgtcatatatttagagatacttcactgacrtttcctaaattycatgtctttgagttccttagtttctctaattctaatggcttttgctctattttcctaattaagagctgttgatgaaaacctttaaataagagaggacaaaaaaagacatctcatatcataccccactrtactttcactactttgaatttggcatttttgttgaactagggataktatctcacttataaacactttaaatatagtagaatactttaaaatagtagaaatcaaattcgagggtagacgtargagcaaaatggggatttatattagacaccagtatataatgtacataatattatgtcaggaaagctgataattccctcacatattagttcttttcctaatattataatattattagttatttaaaatattattatagttttataatgaagttctaataaccttataacttaaccttattataacattataataaccttataactttataattataactttataacttttaaataaaattatattaatacaacttttaaaaatatattataactataatttattgtaactatatagaataactattatagctttataatattataactattatataattataactataagaactttattaagtctttttgctattataacattatttgagatattatttctcagacattagtactaattgtaaatttgtactctaagaattctgagattaaaaacccacaccatgaatatttctatttatttatatattgtcacatatattcaccattttaagacttagttgccttaccttcacaaggtcatagccatcttttccaaagtcagcccatgcaggtgtgtaataaattccattgtaaaggatatgtccatcttcaagacayggcactttaaggccatcttctaagttaagtcctctgaartaatagccatgtagtwmsctggaatrtagctgactatacacctagatgktagaagagartcaactgtattttttcatagaaaacaattcatttttccccacaagcagtatataaataacctatataatcctatgaatatcctrtgtagaactgtcatcatacctataccaaataaacacatattgagaaagtataggatcttagatctgtaaaaactttgaaatactatttaatcagttaaataaytgctgrctaaatcayattaaaactaacaaaaagtccatgaggctcaactggattttaatacattccagataaaggcactgctcaatactctttgaggactcattcaaggacattgttagagaatgttctcggttaatttactaaatctccctgagcctaagattagacattaatcaaaatgggaatactgcattagttctatagggttkattaatatgagaataaaattaaataatagataygggaatactcagtagagcaagtgtcaaatagtagacctttagcaattgttatttatttttaaaagtgttgstcattttttccataagagaatcagtataattggagtagagtcattktacatgatttctaacctaaaatattttttatgcctggaactctggacaatttttttctcctctagtttatttaaggtatcctgtttttatccaaaggtaaagacataaaactatactgtkggtrgtaaacaaagatggttttaatcactcacagtttgtgctgrcagctgaccataattccttagtagcaatacmctctggtctacmgcccaaagagcayaaagagagtttgaagcagccgagacttgaagatsgacattggatcctggtaaacttttttctttagaaaaatttaagttgacctgaaaatgaaaataaaagggcaaaaggayggcaagccatatgagaagaatcatcttttagactattcttaacttttttaaaaacacacataagttaaaagggctttctgtgctttacccacctaataatattattattaggaacarcyggatttggaacaacatccaaagtgaatgctataatcctgctactcttcaatcatccaacatattaacttctccatagctttcttttatttttcattttgcaattctatgaaaaattgggagtttaaacccaacastctcttaagttctccttagttttcccccaaattaaaaaagaatcatttttggcacctamctgattttcgaagcatttctcaattggaattgggtgctatcagtgaccatttctcctccaggatgcaagctatagacaagcatatstactgagggcgctaattcagggttaatgtctatagaaatggaaaatatgcccttcctccctgtgaaaagaaaatttcaaaccgaaaaagtgctttggtgagatagctgactgtcatcttgcagaaaccctccaytgagtttctagccatcctacccactgccaaagagactgccccracccaccaaatttaatttataargcatttctaggaggagttcataacctattccataaattataaaagaaagaaatagttgaacatttcttattacgtcaaacttcagtctacttttgtttctttttaaaaatcccttcttgtttgaatgtaaaartacttacctgtctttcttggaaaagaaagggaaggacaatgrccctttcccattatagtagtgtttggaatataattaatgcactattaattaagtaattattttttcatttggcattgtgcctattcacatgtctttacatgttccccaagggtagtttagggggcagtaaacagtcctaaaatgggaggattgtgacttttaaagaaaaatgtaaaatatatcccaattaaagcattctatttgtattaaattatatgctaaaattagaggcctcaccattttcgttgatctcaattttctgttgcccatgaagaatgattacaccttttgaaatcacctaggaaaatgaaaatataatcrtaaagtttagaggatagaaactaaatttcatttaattataaacgaatgtgatttacctccttttcttgtctgagcaatactattgacatgtttactagtaaactcaggttaccagtaaacaagcatatgactctaayagctatattcaagagaatttaggagtcacagataaacttgctataaagcaatttaatgttccacattccaaaacagttttctaagaccaataaacaactttttattcatatttgcaaatgctraattacatctaaatttattwagttcagtgaaacaaagttacacaaaggcattaagagtctcccagtgcttgtctggttttctgaaaggtgtgtttgatatgcaaggtataagcaaggcctgttcatccatctccacccaaaatttaaagaaaagaraataaagtagcaagctgggggtgctccagaaaaaagcttctctcacttcacctttatcagcaactgtgtgcaaatttgcatcagcagacttttgttatgatctctaaagtgcaaacaaaggctggagacttgaaatctagtacaaactccttgaatttttaaattacagttttagaatattattttaaaagatgctgagacttgcagaaaatttaaagcttccrtaagatcttgcagcttgaaattgcaggagctggtactcctagtccgtttaatatttcactgaatattaaaattgctttaaatctctgaagtgccaagtttgggttattagytcataaaaaaagaactgagcctcaactagctggaaaatattgttttgggaactagaacatttgcaaaaaggcataaagctcaaagtttaatgagcctgagaggtctcagcactgttggctgtagtagctcactgacttctcaaaatggaaagacagctctcgtaacagatgagtaaactgaagaggcacacagaggtactgatatttgtcaggtcacacaattaagaaaaaagcttaaaagactgagtatcaaattaattactgaaagcctgagaatcaaattaattcagcctctatccattcattctaaaatatgatattgagggttctctctgtgatgtgtaccctgctaggcagaattaaagtccacccagcctattatgaaagaatatgtagaagactggaattgtctaggagattagaaagtttcatttaagccaagagatgaatgctgaggaggaatcagctcggaaaatgaggtgcaggcaggttgggaactgyggtagcaaatgggaacgaagattgttatgggcagaagggaaaacctgtgggaggcttcggagccagaaaagcacatggcttgtccaagaaaatgaaagccctctgtgtctgcaataaagaaggctgaagtgtagaatgatgcaaaatgaagcgggcgagcttcacaggtgcagagcagatacagtgttgcaggcaaaagaaaggagtctggtatttgtttcaatagaaataggcagtcattaactgtatttcaattaggggagtgaaataaataatcctaattgctttttttaaaaatcactctagatttccagaataaagaaagaaagaagaaaaggagggaggaaggaagaagggagagaggaagaaaaaggctattagcagactcatttaaaatggaaatgaggtaaagtaattgtaaaggccttatcagatcagaggggggcaaacctacgctatttcaagagggaagctgatgacaagtagatcaattcacaccacagacctgcaaaatggctcagctctggattaggaagtattggatattaagtcgagcagaggtgtggccagaaaagaaggcaaaagtcaggggcatgtgggagtgtctttataaaaactagttaagaggttcagcttccctgtaatcccggtactttgggaggccgaggcgggcagatcacgaggtcaggagatcgcgaccatcctggctaacacggtgaaaccccgtctctactaaaaaaatacaaaaaaattagccgggcgtggtggcgggcgcctgtagtcccagctactcgggaggccgaggcaggagcatgccgtgaacccaggacgcggagctttcagtgagcggagatcgagccactgcactccagcctgggcgactgagcgaggctctgtctcaaaaaaaaaaaaaaaaaaaagaggttcagcttctcattcaaggatgcttggtatttctcacaccscagtatggcaatattattgttgacatgttgaaggatttctgtaccggttggtaaagagccacttccctgagctccccagagtcccctccctgcttccctagaacctctcctccacaaccagctcctcccactcccaccactttgcccccagtctaaatgagccatgcttggcttagctaagggcttcagtggaattatcactcataccttttctgatggtttggtgtccataccttgctggtttgaaatattttaatgtttgtggaaatgatgaaggaaagaaaaaatgcgagagataatataatgaaaaagtgatagaaattggtgatgcagtaaatagcacgaaaaaaagaagtatcaaaagactattccagaattctaagtttgcaaaatgtgagaaatcatgtggtactactttcattcttcacatagatagactcaaacacctttagttctcagaataatacacttcagacatctttgacctcttatattatttcctaaaataagcttaaatgtgtttctcatatcctctaatcatccagaaaactcctattcatcccacaaaatcctatttaggcatattctctttatgtattttttccttaaaaatatgtatatacatataaatgtaaatatataggcatatatctttttcctaaactagtggttgtcaaattttaatgtgcttcggaggacaagatttctaacttattcctatgttttttktttttttktttttttttttttttgagacagagtcttgctctgtcacccaggttggagtgcagtggcaccatcacggctcactgcaagctccgcctgctgggttcacaccattctcctgcctcagcctcctgagtagctgggactacaggcgcccgccaccatgccaggctgatttctttttgtatttttagtggagacgcggtttcaccgtgttagccaggatggtctggatctcctgacctcgtgatccgcccatctcggccccccaaagtgctgggattacaggcgtgagcccctgcgcctggccacttattcccagaatttctaaattattcctaggtgatgctgatactgctactctaggaaatatactctgataatcactgtcctaaactccagctagagttaatcattcatttttctgtaacacctcagtggccatacatgtttcrtttgtaacacttatgtaattctaatayatgttttgtccccagttatactttttctatttcttctattgtkacaattgctaatacagcacctggaatatgaaaaacattcaataagtgttggctgattgaattaattcatgtttcattaattttatatcatcttcmtaaatctcaatgaagtatcatgcaycyatttagacagtgtaaaataatccataatagcaatatattaaaatcaaactaatacttaatatcttytgtgtgccagaagttgggcaaagggctttatatgtattattaaataattatcttgatgattagacaatatattacaaaaaactaagattctctagaggtttaagtggctttcaaaaagtaacacaaagctagtacatatcagaactctggtttgatcccagcaatgtccaaatagaaatgggtaactctgaagaaagggtctgagaatgacagagtgcatatgggttgtggtgkcatggccttttccctcctttcttaaaaatagataccagttatataagttttatcatttatgttaactttgagcttcctcgtggcatataggtacagggatttcattaggttcaaagaagttttaaagaaaagaarcaattttgrttgtggaagaatrttttcagctcataccaaataattgaagtctgctgtgtaggttttgtcttcaaagtcttccatattgagaatgcagtgcactagcaccctcttctgctggttgcatctcagttcttccatctcttggacaatctttaggaagctattcrtcttggagtaaaatcgatatgcaaagtactcgggctgagggtattgaggcaacacccagccatgagcctggcaattttcattggccttgtaggctgcctagacaaaaaatcaaaattacgggtattttaggataaagagaaaggatgagtgaaagaatatttgataagatggtttatcatcatgctgctttatctctgcaagaarattttatagccattctacattaaatctaacccaattccccattttctagttatactctagagcgaccactatggtttttacaatttagtctattcaagtcctacttcaataatattacattmaatattttactgtattctttactataattattacttttgctagcawgtagattgctatatctccctcactataatacgaagaacccatgagtgcaaacgtttaccttgctactgataacataatatgaagttttgctgaaagatgggaaagtttttatgaaatacagcaaggagtttactctgaccatagtaatttaccattatcaacacaaaaagtctgaggagtcctttaaaaatatctaggaaggattgatatttaattattacagatagtagttyacttctctcttgaatatatccagagaaattctttacattattccaaggtaatagattacagggtttctcaaatatttccttctataaaaacacaattctctttctatttccttaataaaagtgaagcgttgcttattttcagctaattctcctttatacaatttagtatgtatgctawccttctgtcttttcccgggactcttaaaataatttttaacctacttttcatagggcctatattcttaatatttaactatttttcagtactctagattcacaccaaggtgtawcttttcatttctgttccataaatataatttcgcayagacctaaaccttagckagccagtgcagttttttgtttgcttgtttgtttttattttacttgcctttcgtttaacttactttcaaagtgatatttgggtatgtaaacgtatatgtgtccaagaaaaactgagcgatgccatttacatctgtggtgtagtttcccaygattttgtccttcagatgcaactgracaacttcatttgggattggagagttgtctggattaagcaatttaatctgtacaagaggaagaaaatacatttcggaagcatgtagtaaatttgggaatccattttgatggcatttgccaagcttctatcatggggacccccgctctccttcgtacgtatgcacttcctgcgtggtttcatctattcctgttgagtgtatgacatgtaccattaatatactaatgagcctaaactctgtttctcctgcccacgaagatctctgaaaactcaggcccatagaattaatcatcctgagtattttttataataaaaatgctacagaaaccctcaaattggaatgatttattactgtgcccaaccttccttttttttctctttctcttatttatctcagtgaatacctcaaccattcacttagtcactgaagtcaaatatctagagacatcttagactttttattttccttctcctataattttcaattgttgataaaatattttcaattgtatctttttaacattttctgtttccagcttatcacatttgttcctgttgctattccttgtatcaatagcttatcttttttccctcatacrtcttctatttttttctatccagtctctctctcctgtattgcttttgcttgttctttctctatactggcatcaaascaaattttctaaaatgcaaaatttagcattatcctccctaaaacattgtagtgactgctctgataggccatggttattygctagaaatctctttctcattctcttactagtacaggcaatgattgctttaaaaagtcccttctgaaattgtatgatttgyagtagatacaatgcctgcatcagtatctatgccagtttgaagcctttaaaggcaccttcttaacaacatctaaggccacaacaaccagaagaagactgtctgagmcatcctttttttagctcagtcagtttctgcaaaacaacttctgctttgagcctttcatcttatttctgccacttatcattttcctgctggtccaggcaaacacaatccttttttcttgctcagcatctgtagactgatgccttatttgcaccatctacgcagattttgaacttagtttcatctcaaggcttgatcttgtaagaaaaattcaacttgtctcagcagtccacaggccacagacacatgacaccatgcctttatgatcacacagaggtttgctctaattttagtacacctagactagaaagatcctttgagtcccttccagtcacagaaagatgaacaagccatgtgatttctgggcactttcctttctttctttgtccccaaacccaaatagtgccccaagtgatgacaccaggcccattatcaactgccggggccaggcatgcaacacttcattagcagatgtttcttgtggcaaaggtatttgtcgtatatcctacaattttaaacagtatcatttcagccatccacggatgctgctactgtcacttatgaagaaatacccttgttagcccaccgccttgcccagcttcctatgttcacatatgttactcttggagtcatagctctgaggtcttgaaatttgtaggggacactaaaaaagcagatagtatcttcattctggaaataaagcttactctttaaaagtgctccctagcaatactgagccacgtgtttgatggccttatgacacaacacatggccagataaaccatttttaatttccagtaatgcagctactgtagtgactcactatatcacagagaaaccagtcccttttccaaaagtagaacaggaatgacttgtttctcctggcacatctcccggaagtgatcagagcattcaccactgtgaaatggccaaaaacccaaaagataccactttatacaaccatgtttttgaactaaagcattttattgtttgagactcacatctgtttatagctgccactggtctccctaaaatgatcaaggaaataagagctcttatatatgagttttcaggaactaattctttcaaatgctaatgaagagggtgtgtccaggcaggaaactgtactgtattacaatatattaataacagactactttgtccacggatgcctgattcatgtaggtaccacctatcccctacctccctgataaactattaccaacctcagctagttttcccagctctcctctataggaaaaggtgtcttggagttcctgattataggataagataatactataccttaaagtgtcaagaagctttgagagggaatgggaaggagctgggccttaatgactaggctagggcttaagtacacacatacacatacacatacacatacacacacacacacacacacacacacacacacacacacacacacccctctcaaccatgtcttatgctagagaagacagaaataaaacccctgagttaatctggagcatgattgactggcagatttcagtggattattgctaattttttagaggggataataggatttaggtaatctttttaaaaatatctcaaatcacccttcattgagaatcactattctaagagtggcaaaattctaatttatcactttttaacttattagccaataaattttgccatttggcaatgtctgcaaacactttgggctatcacaaataggaaggggatggtgctacatcccaggtagagacctgggatgttgctaaactcttaccatgcacagggtagcccccacagcaaagtatcatctggcccaaaatttcagttgtgccaaggctaagaaagaatggtttagagaaacaatgcatctaagtaattattgtcaatgtctgctaacatctcagtaagagaggaagagtgctctctgtgaaaagtacatgacactacctacattatattcttgcctactgcacccaccaaaaatgaacttgaatctgatcaagcttctgaacctcactactggtttataggaaacacagtggactgaaagtagttgcttctggggaagtattcacgaaatgaacggattagaggggagaggtgctcattgttcttcatactttaatttacagtgttatttttcttgttaatatatgtgttgtccgcaatttaaaaattacttattttccttcccagtcatggtagctttgacagagcataatggcggtgaccacgtccacaggggtgctggcgaacttgtcagaaaagcaaagagttttatcagcttctgaagaacctgatcaatccaagctgtatggtgcggaggcaagcagaggaaatctgtgaaaatatcccaggatcctcatctaagggtaagggctccagcctgtactacacttggacagatggctacagattttgcacccaatttccaaaagacatttcatgaaacagtgattccagctctgttacgtaccatgcaaaatcaaggtaatcagcgtgtgcaatcacatgcagcttctgctcttactgtttttattgaagactgccccaaatcattcctagttctatatttggatagtatggtgaaaaatctacattctgtcttggtgattaagcttgaagagttgattcggaatggaactaagttggccctggaataacttgtggcaaccattgcatcggttgcagatacaatagaagaaaaatttgtcccatattatgatatattcatgccctcactaaagcacatcattgagcttgctgttcagaaggaactcaagcttctgagaggaaaaattattgcgtgcattagccatattggtcttgctgttgggaagaaaaaatttatgtaagatgcatcaaatgtgatgcagctcttgttgaagacacaatcagacttaaataatacggaagataatgacccccagacctcttacatggtttcagcatgggctagaaagtgtaaaattcttggaaaagattttcaacagtagctttccctggttatcgagcctcttattaagactgcttcagctaaacctsatgytgctctcttagacacacaggatgtggagaatatgaatgatgatgatggctggcaacatgtaaatcttggagaccaacagcgttttggaattaaaacttcaggacttgaagcaaaagtaactgcttgccagatgttggtttactatgctaaggagttaagggaagggtttgtgaactatacagaacaagttgtgaagctgatggttcctttactgaaattttatttccaagacaatgttcgagtggcagcagcagagtccatgccttttctcctggaatgtgcaagaatttgtggcccagagtatcttgcacagatgtggcaattcatacgtaaccccttaatcaaggctattggtactgaaccagatacagatgtgctctcagaaataatgaattcttttgcaaagttcactgaagttatgggagatgattgccttaatgatgaatacttggaagaactgggagggacactgagagcaaaacttgaagggcactttaaaaacgaagaattgtgacaggttaaaagtcaggaagaaaactatgatcaaaaggttgagatgtctctgcaagatgaggatgaatgtgatgtttatattctgaccaaagtatcagatattttgcacacattatttagtacttataaggaaaagattttaccatgatttgaacaactacttccattaattgtaaatctaatttgttcaagtaggccatggctaggcagacagtggggactgtgcatatttgatgacatcgcagagcactgcaatccaacttcatttaaatatgtagtccaacttcatttaaatatgtagactatttttggtggccaatgctactaaatgtgtgagataacaaccctgaagtcaggcaagctgctgcttatggcctgggtgtcatggcacagcttagtggagatgattatcattctttatgttcagaagctgtcccactgtggtaaaagttattaagtgtgcaaattccaaaacaaaaaaaaaatgtcattgctacagagaactgtatctcagcactagggaagattttgaagtttaagcctaactgtgtaaatgtagatgaagttctttcatactggctatcatggcttccactgcatgaagataaagaggaagctattcagactttgagttttctctgtgacctaactgaaagtaaccacccagttgtaattggtccaaataattccaattttcccaaaataatcagaataattgcagaagaaaaaattaatgggactattaactatgaagatccctgtgccaaacgcctagaagatgtcgtgcctcaagtacagactcctgaagatttatggttggaatgtgtatctcaacttgatgatgaacagcaggaagccttacaggagttgctaaattttgcttgaagcactttaatataacttgaatattatctaccataaaagtaactacaaataagtgttgtgaatggattttattaaaaatcagtgaactgttttctctctgctaagctgtttatagttcttcctatgtttctccagaattagtcaatgttagtcctctgtttatcttgtatgttttatctcccaaacacaaaccttggtgataacctgtgcttcaagctgtcttacaatatttgtcacctttcccctagttgatgtgaagtatataaattgttgctatttgtttgaactattatcaatgctagccaagcagtatacttgatgtgaagatgtcatgctatcatgatatgctaagagctcatgaaaataagacagaatttccaggacaaacatctttggaattgtgagtgaaggatatagtggcaggcttgtccctccttgattaatactcttgatatttgtggtgatgggaggatgctggaactaggagagagttttgagatactgcagaggatgtgggatgtatataaactttttcatggtgttctcctgggaactgggtgggacatatccatattctagttcccaaggtgtccagctgagagttagagaactttaaatttctttagccagactggtctctatttttttaagttatccaggactccaagaaccatagttactgaaaagggattcctgattcatctaacactggtagcatgtaacagtgttcgacaaatagtaagtcatcaatattcttgggagtcagtgttgtgtgtttcaggagagtattattttgtatatgtatgccatttcccccctgcaaagcagttcaacaagaagagaagctctgattatagggcttaaattgatttatatttcaaagaatttcctaatagattctatagtagcactgaagagtattctattgtaaaactcggaggaaagcaaatgtaattttctttggacatgaaaaagaaagcaactttgagagtagtcatttagcagtagatgtgcattattatgagaaaacagttctataaattcagggttaattmtattaattggaatgtcggtctctaatgtctagcttattatagggtagaaaagagctttctactcagctaatcattaatcattgatccaaaacttaaatacatctatcatttcctggggctattgtgagtactgtatatgtatttagcaaatatttaagacctagtaagtgctcaataaattgtagctgttactacaaaagaaaaaattactttttaaaaaaatatacaaccataatcacacatactagagaagaaaacttaaaactctaagtaattcttaggtaaaaataaaaataaaaataatgaaatcatcaraaatgattttaattgaacttaaaaattgttaagatggtaaatttgatatgtgcattttttcataatttaaaaaataaaaatagtatagaaaaacacctgtgaggaggaaagwagtattcaggaaaaattgtataaatytgaaaacatggaagtttaacataagtatttataacaagatgctagaaaaaaaaaaccaaaagaggtagaagaaaaaatataataaaaataaatgatgtaatgaaaatcatttaaaataacattaaaaataaagataattaacaaatccaaaaactaatgggaaaaaaacacaaacacaactagtaataaaaaaggggaaataaattatgatagatttattttttcaaatcataagtgaacatattttatgccctctattttaaaacctaaatttaataagaaatatctagatacagaaactaacatattatagaaaattcttagtgaactaaaaaaggaaaattttttgactcgataaagtatgtctcacaaaatgctacagttacttagtaggtttacgcattacatttttaaaagcattccccaaaatatgcaaaatacaaccaggaagtccactatcatctctaatattcawattggagatctttgccaatcgaataaaacaaactaataacaaaaacctcagaagattaagttcagaaaggaagctaaaatataacattttcacacaaaatgctctttacacagaaaacacttttaaattgcacagaaaagatacaagagacaaatgggaacccaagaaatcatcttgggtaacaacaacgtaagagggaggaaatggagaattctcaagtctagataaaattattttatattcagaaaaaattttatattctttgaagatatctctcagttttatatatttagtaacagaacatggaaatatataaagcaaaaatgtacaaagtgaagagaaaggttagaaaaaattatgttaacattatccaccactattcagtaagtgaagtgaacatatatcaaatttatctatctgccaaagctgtatttcaatctaaatttgttcattaaatgacttttactgaaatttgtttcagtaagtcctttaggtgatgctgatgccagtttgagaaactgctytgtaagatgtaagccaggctacccacttttgtatttcttttttagtgttcttgtgtcaacctaaatattacttcctcagggaaactttccatgatcatttagtccagattttagcaaacttctttygtaaaacaccatggtctctctctcatatattttkttattttttaaataatcttttaaaaatgttaaaaccactcatagttcactggctgtatcaaggcaggcctctgtctgatttgcctatgggctgtggtttgtcagctcctgatgtagagtagttaaatggtcagtatttcactgacatagcacctatcacractacaataattctttgtaaaattatctgtttaatgtttattatctctattacactataaactccataaaagcagtgataaaagtgcctctctacatcaccattttattcctaatactgatrtagactatataatttattgtccaaacttggacacttttagagtgaagtggttgtaactattaacagttacaacttgataaaacatatacaccaggacagatctatgaaaatcaacagtgtaggtcaccctacagtgcttagcacagagattcctacatagtaatttcttagggaatagctgttggaagattagtagataaatgaaagaacaaatgaatgaatgaataaggtatgtaaaaaatgattgctttctwacctggccaaaataagggagtccctgtttgtaggacatatccatattctcaaaactaatcttcaccactgatgagtctatgtataygtacttggagcctgtaagctgcacacctgcagtcaattaagtattattgagaaaatgtcacttccaaaaacagacaaacagagcttctgaaaaaaaccacaaaagctcaccattccttctaatagtttcccttccctttcctaagcagttttaatatrtaggtacttcagatgtcttttataaagaaagttaatcaagayggcacaaaatgcttgtgccaactggtgttgctgctttttataaaatatccaattcacttaccatttcttcatgatggattagtaaacgttgatttctcattattcctaagtgattgtttaacaacatttcttttactctctgcttgcctaaaacatatgctttaatttattaatagtaagaattgtaatatatgtgtattattaaaaatggaaatgcttaaaaaagaaaatacaaattaccaaatatcagatatctccaagagaaycaaaattagcattttaggctttttcccacaagttctatttctytttatatttatcatttatattaatatgtttgagattgtgtgtgtatatgtgtacatgcacacatacactcaatatgtgcaaatgtrtatgtagttttacatgttttttatcattattttataaagtttttgtaaaaccttataaaaacttatttttaattgctacattatttctcatataaatatggacatatgttatcatgtagcaagcccttccctccttccttccttcctgccttccttcctttccttccttccttttctttcttcctttctttctttctctttctctctcttcctttctttctctctctttctctctctctttctttttcttttttttttcttgagatagggtctcattctgttgcccaggctggagtgcagtggtgcgatcatggctcactgcagccccaacctcctgggctcaagtgatcctcccaccttagcctcctgagtagctgggaytacagctgcatgacacaacacccagctaattttgtattgtttgtagagacggggtctcactatgttgccaccgaggatggtctcaaactcctaggctcaaataattcttctgcctcagcctccccaggtgctggggttataggtgtgagccactgtgcctggctattcttttattatttatttagttcagtatgacaaatatacctaattatcaattaaatgtttgtttaatacttgaatttcctctggatgtgacagatacctctaaaactttgaagactgatataagtacattagtaatttaatatttcasgaacagaaattttgctgaaatatcagttacatatgcrtaagtttaaaagyactayagtaacacaaagtggtcagcacagaaaaaagcatttcaaggattaagacttaccattttgtgctttaggaagaaggggtattaggtccaggagatacaagaaattagtcattagaaatattattggccgggcgaggtggctcacgactgtaatccmcgcactttgggaggccgaggcgggaggatcacctgaggtyaggagtttgagactagcctggacaacatgatgaaaccccgtctctctactaaaaatgcaaaaacctagtcgggcstgatggcgggcgcctgtaatcccagctactcgggaggctgaggcggaagaatcgcttgaacctggcgggcggaggtcgcagtgagctaagattacgccaccgcactctagcctgggcaacaagagcgaaactccgaaaaagaaaaagaaggaagggaggaagggagggagggagggagggggagggagacagattttcctggatgagataaagatttttcactggatttattttcagaggcttagtaaaatattctccccaaactattttacttcccatgttctaattctatgctcaccaaaaaaattttataatcgacaactacatgtctcaattatatttatctgtggaatgattaaggaaaaggaatatgcttatatctaaaaccagatactcccattataaatcaataaattggcattcttacttctattgtagccttatttgaatgtaayacttgaccatccatcaacatgtgtgtgaaaattttggttgatatatgaaacattcagaatttgaatcagatgaacccaatgaaaagccctcagggaaaaaatgattgtattracattgtatagttggcaatcaggtaacaattcgaatgagacagtgatatccattggggtctggcttcttagagagcattacctgttccgttctctgtaacaagagcatgcactttgaggaaactccagtatccttaccgatttmactcaaaagcayctgtgttaatraacttggagacacagccatctttccccaactgaaaagaacaataaaaaaaagttatattktaaaggaagactgtaagaaatacctatataatataatagggaaaatgtgtgacctcactgaagcaactttaagaatattgtattacccaagttttagttttttaaaataatccattgtgtttctataattatattttcagttcatgtatttacctataactatttattttttaataaatattaactcttacaatattgtgttttaaaaaactcttcatggtgacattattttgttattrtacaagataataaacacatccatcactagtcacgtattcacacatgatatttgcaattttggtaatttcagccatattcttttacagttttgaaactgagttttataytatttagttaccatgccttggacatttatgggactatttacacagcagttaggaacacaggctttacagtcaaacaccagaatttgaaccctggctttacyacttattacttcatacaaaatgaaatcttaataaagagcttgtagaaytgtattacattagayaataactggaaagtgtttatttagcacagggcctggcacttagtaaacattcagtaggtagtagatttttwaattagattcctttacatttctctcagtgtctagtcaagtgacaatgtctcactaagtgaaatttttaaagtgtcacaattagtaaccaaaattaaacaggatgaattgtcaaatatttttaaaatgtgggataaattgtgctcataggttcctggactttaatattggggaaaaactgatttcttattctactccttcatcttatgatgatatgaggaaatctagtcctcaagatgtgggtgagatgtcaaaatcctgtgctacttcagggggtccttgaaactataagaaggtctagaaccatttccagaagcttaaagatctagaaaaatttccactatactaaaggtgaataatkagataaattatttagtccacactcctgctttacatgtgcatttgattattttaacttttattttaggttcaagggtrcctgtgcaggtttgttatataggtaaattgtgtgtcatgggggtttggtgtacagattatttcactatccaggtaataagcatagtatccaataggtagtttttttgatcctcaccccttcccaccctacatgtacattttaartttccagakctctcaaatctcctgaagggcatyctataatatagccrccttcgataatgcattctgggatctacctaccctgtgcactcggcttatattggtttagtctcttctagagtgtgcatctttaaagattatgactgcttcataaagtgcaaaacccatgaggatagtacctgatctgtcttgctcaacaatgaagcttctaaataaaattattcttgcatattaaaagacctcaatatttatctgttgaatgaatttgtggagaaaatttttgtatccctgatatccctaaagatacagccccactagttatttaaatatttatatgacttggttggggtgcagtggctgacacctgtaaccccagcactttgggagaccgaagcgggcagatcacatgagatcaggagttcaagaccaggctggccaacatggtgaaaccccgtctctattaaaaatacaaaattagctgggcgtggtggtgcacgcctgtagtcccagcttcttgggaggttgaggcacgagaattgcttgaacccgggaggcagaggttgcggtaagccaatatcgcgccactgcactccagcatgggcgacacagtgagactgtctaaaaatatatatgtattgacatgtatttatgatctagttttgctgcacccatgatcttgagcaatgtatttaacctctttctgctttaatccactcatcggtaagggggcgataatagtaccccctcatagggtactatttgttttgagaatcaaatgcacataaactacttagctcagtgactgacacamaataagcatccattaaatgttagcaattattattattataattgttactattgttagcgtttattgtccacattttttwaatttaagaattagaaggttcttmattatttccaacctaaagtattctctaaacrggacaggaatatgtgacactgtgtgtgtgcacctgtgtgtgtgtgtgcacacatgtgtgtggataaatggtatcacactrtagtatggggattgcagctggcagttgtatattagacagtcagatctggcatgattatagctgaaagccttgctacatcctagaccagcctgtttgtgtccgttttctgaatgttggttctcaaaccttccaagtagatcttttaggaaattcctcctttgtcagtttggaaaagttgattcttctctttagtggttaagaacctgactgatagggttcccatcyggagctcctatatacacttatttccagtgagaataggttgagaggaaaataattatacatctaatactcttgaatatgcagaaacrtcacatctccctgactaaattcacaaagtataaaataaagaacaggacatatgttcccagtaaattgatagggtgtagattttgatatgaaaccaaatgtatttttaattaagaatcgaaatttactactcagtttctgatactataatttgctttttgtcagtcaatagaaaatgaaacttagcatgacaaaagaggaatataaaatttacaaataggaatagaaatatagaataaaagtatatattttaactgtaaagaggaaaacargaagaaaggaaggtaaatggaaggtgaggataaaaagttaaygsaaacctatttataattttgctgatatacctcttacctgaatggtaaaatttttacagagtgaactgataagatgagcacatgaatgataagccgtagattctctgcacacactaagttggaccttcccgtccacaggttcaccataggtatatctaatagaagaatataacaayaacacaattacagaggtcaaggtcgtttttaatctgtatagggttttgaaacctttatttagtagctgaaaccagcacygtaacaacatttaaatagctagttaccataaattttattttctggaggaaatctaaaacaatggtatggactaaaattgagttgaatgctttaggcaaaaatatattttaattaaaaaggttgaaataggcatgtagacgttatatatctaagtcactaaaatacaatgtaaacaaaaaaacaaaaaaatacatcagtcattatttcattaaaaataatattttttgcatactgatagcaatggagtattgaaaaacaaaaaatraaataaaataacattttgcttcttttagtttttttgtttttaaactgctattatgagcatattttatggtttttacttttaaaatgtaaattatatttatttatttattttttataaatgtcattttaagycatcagattttggggtaatttctttttgtttgttttggaaagaagtaaaactgttcattattttttattattatattttaagttctgggatatatgtgcagaaggtgcaggtttgttacataggtatrcrtgtgttatggtggtttgctgcacccatcaacccatcatctacattaagtatttctcttaatgctatccctccccttgcccccaacccccgacaggccccggtgtgtgatgttcccctccctgtgcccatatgttctcattgttcaactcctacttctgagtgagaacatgtggtgtttggttttctgttcctgtgatagtttgcagataatgatggtttccagtttcatccatgtccctgcaaaggacatgaactcattcttttttatggctgcatagtattccatggtgtgtatgtgccccattttctttacccagtctaacattgatgggcatttggrttggttccaagtctttgttattgtgaatagtgctgcaataaacgtacgtgtgcaggtgtctttatagtagaatgatttataatcctttgggtatatacccactaatgcaattgctggtcaaatggtatttctggttctagatctttgaggaatggccactgtgtcttccacagtggttgaactaatttacactcccaacaacagtgtaaaagcgttcctatttctccacatcctctccagcacctgttgtttactgactttttaatgatcgccattttaactggcatgagatggtatctcactgtggttttgatttggatttctctaatgaccagtgatgatgagctttttttcatatgtttgttggctgcataaatgtcttcttttaagcagtgtctgttcatatccttcacccactttttgatggggttgtttgctttttcttgtaaatttatttaagttccttatagattctggatattagccctttctcagatggatagattgcaaaatttttctcccattctgtatgttgcctgttcactctgattatagtttcttttgctatgcagaagctctttagtttaattagatcccatttgtcaatattggcttttggtgcaattgcttttggcgttttagtcataaagtatttgcccatgcctatgtcctaaatggtattgcctaggttttgttccagggtttttatggttttaggtctaacatttaaatctttaatccatcttgagttaatttttgtataaggtgtaaggaaggggtccagtttcagttttctgcatatggctagccagttttcccaacaccgtttattaaatagggaatcctttccccattgcttgttttcatcaggtttgtcataggtcaaatggttgtagatgtgtggtgctatttctgaggccactgctctgttccattggtctatatatctgtttttgtaccagtaccatgctgttttggttaccatagccttgtggtatagtttgaagtcaggaatccaacttccaagggatgtgaaggacctcttcaaggagaactacaaaccactgctcaaggaaataagagaggacacaaacaaatggaaagacaatccatgctcatggataggaagaatcaacatcgtgaaagtggccatgctgcccaaagtaacttatagatacaatgctattcccatcaaactaacattgactttcttcacagaattggaaaaagctactttaaagttcatatggaaccaaaaaaaagcccgcattgccaagacaatcctaagccaaaagaacaaagctggaggcatcactctacctgattcaaactatactacaaggctacagtaaccaaaacagcatggtactggtaccaaaacagagatatagaccaatggaacagaacagagccctcagaaataataccacacatctacaaccatctgacctttgacaaacctgacaaaaacaagaaatgcggaaaggattccctatttaataaatggtgctgggaaaactggctagccatatgtagaaagctgaaactggatcccttccttacaccttatacaaaaattaattcaagacagattattaaagacttaaatgttagacctaaarccataaaaaccctagaagaaaacctaggcaataccattcaggacataggcatrggcaaggacttcatgtctaaaacaccaaaagcaatggcaacamaagccaaaattgacaaatgggatctaattaaactaaagagcttctgcacagcaaaagaaactaccatcagagtgaacaggcaactgacagaatgggagaaaatgtttacaatctacccatctgacaaagggctaatatccagaatctacaaagaacttaaacaaatttacaagaaaaaatcaaacaaccccatcagaaagtgggcgaaggatatgaacagacacttctcaaaagaaaacatttaagcagccaacagacacatgaaacaatgctcatcatcactggccattagagaaatgaaaatcaaaaccacagtgagataccatctcacaccagttagaatggcaatcattaaaaagtcaggaaacaacaggtgctggagaggatgtggagaaataggaacatttttacactgttggtgggactgtaaattagttcaaccattgtggaagacagtgtggtgactcctcaaggatctagaactagaaataccatttgacccagctatctcattactgggtatatacccaaaggattataaatcatgctgctataaagacacatgcacacttatgtttattgcggcactattcacaatagcaaagacttggaaccaacccaaatgtccatcaatgatagatggacatatacaccatggaatactatgcagccatgaaaatggatgagttcatgtcctttgtagggacatggatgaagctggataccaacattctgagcaaactatcgcaaggacagaaaaccgaacaccgcatgttctcactcataggtgggaactgaacaatgagaacacttggacaccgggtggggaacatcccacactggggcctgtcgtggggtgggggcagtgrggagggatagcattaggagatatacctaatgtaaatgacaagttaatggrtgcagcacagcaacgtggcacatgtatacatttgtaacaaacctgcatgttgtgcacatgtaccctagaacttaaagtataatttaaaaaattttaaataggtagaaagagcaaagaacaaaattgcttgtaaggaataacagtagattcctctgggctacgttttakgacaatttctcaatttcatcttccaaattactaattctctcttaagyatcatcgatccttctagtcagcctttctacacatatatttttaaattaataatatgcctamttccaaggtctttaattatttttaaagttacactattgactcatatctgagtatacacattttacttatttctaaatytttttctgattgatgttcaacagttttctcaggtatatattgctcttttttttgtttatatwataccttgatttcaagtcattagaatcttcaaccatttagtgattcatgcttatgttttgggattcccagctggcttgtcctagagtgctttattttgcttatgcaatacttctccagtaaaaatgacacaggagccaacacacagccactgtgayagggaagtacctagacatttgggctttggggatttctgttactcaggggattttccagcaatgctggcaattccctgcctytatgacccaactacaatgagacttttcagtctctgccttttctgtattcttccamctctggaggtgaagcacaaggtagtgacatcaaaaagttagccatgcttcttcttgactcttaaagacttccagcctaaagtagacacaggaaggaggrcaggcaaagctttcaccttaaagtttggcatggaattttagattactgtartgaagctctcctaataactagaaattwccaggtcacttttttatttttaattatgcaaaattaaaaggaaaagtagtacacatgagtcagggaaaagtagtacacatcaggtctgaggagacaaagttttaatgtttgyaccctggctctctttgctggttatataaactcygtgaatgttgcttamcttagtgacaagaggggaaaacaacctgacctgcttcactgctactcctgccacacgttaatcctcactatttgcccctaagtccctgtctgcccttagtatcctccacactgtgccccgccattaccctagagccacttgtaactcttacagcagttttctctgtgatacatcttgagcttcagytttcttttataatcatgtaatacataaagattgaattgagaaatcrtcataaacagaaratattgtccaatggaaatttctgggagatggaatgttctatgttttatgtctatgctctccaattcagtggccactagtcacatgtgacagcttgaaatgtggctaacgcaactgaatatttagttttaattaaaacttaaataaccacatgtggtcayggctactgtattggctggtgcaaaacaatatgttatcttatgatgtaagaaagacagtagtcagttgtcttaaactgttacataaaaccacgtgtcataacatgcattaaaagaattatagatgcatggaagaattcataaaatcagcaaaanaatttmacaccttctttttcccttaccttctacacatttatattttacttctttttagccatctatcccattctantatctttctatgaatacattattctattgtgtacaatttcaacttacaaggcacagacattcactttgaattcagagtccacaactaagatattttctggtgcatccacagtcatttgaaatttgggtaacactgccagtaaaaaaaaaatatatattatattataatgtgtatattatatattattaacataaatacatattaacataaatacattcatacaaaacaattgtttctcctttacaaaccatcaacctttgcttatgtttgccattaataaacagtgtgaggaggacgytgaagtgcctaagactggattttggaattggatagaaaaatgcatattttgaattccaaattcatcacttytcaggtgttgaacttgggaaagtgtttctcaatatcttcatctttaaaatagtaataaagatactacaatagaaattttatgaagattttaggagaaaatatgaagggactaatggctaacatatgactaatgttaattccattcttctcataagaagtgctttacatcccagaaactatcatataaaatagaatccagatactacaaaaggaagatagatagcctaggttaacagagaattgcaggaagattatgggctgaactaggagataaaaatcacagtagatggagaaccctaaaatagtaacagaggacaaggaaagaggaaaggaagagatactcacttgaaaattcattatttaataatcytgcccttgcaaaattggaaakattttataatttttttattrataggtaatattttcattgctattatttaccatattcttccacagagaaggagtgatatgttttcttctcattgagcatctccayggtgatttcataccatccgaggatgggctctgagattaactggaaggagagttgtagaatccctcccacagactcctcattcacccactgttgtattcgaytgccttctggatcctgagaataagaaagcgtatttttgcatgctggatgtttttattcattataaagtttcagcaaggtgtttcctacttaggtttccaacttacttaggattcaaaacatgagtgcgtcctcacatcacccaaggagaattggttactctcctatctgaggtcacatagatgcatattacagyacttagtatattttagagctagctgtgatttttttacatttattttctgtgtcaatctctgatttcttaaaggcgagccatattttatccccagtgcataaaacattaagtgtacatttatatacattcaacaactaaacattaaattaaatacaatcatacttgcccgttgtctatattattattgtctgtattaatgggtgcatgctaatatgaatcacatggtggtgggggtggaaacctatttctgtcctcttgrggctgtctrcatgaaattaataattctgcracaatttaaatagacaatcttccctgtgagctgccttttgattttgaggtttrgagagatgttcaaaaaatgagaaaacaattcttcaactattagttatcttacctgaagggtgatcactggatactgaaataaaaataaaaataatgttaatatatgaactcaaggttttttttctagatgagtgaagaggttaattataaatctattatkaagcaaagaaacataaacacatttaggacaacccaaacaaatactgatttctgactgaaagtttgaatatctattgattatattgaaactcatctgcctagttttcaagaattttcatttacttctctctctttcacaacatacaccctgcagtctcagtaagcaaycctgcccttgggtctctccaacataataaaaatgccctcttagatgaatmataacttccttatcaacaaattcgtggtcagtcttcactctgacagttgcaatgttttacactgctggttgcctctttttgaaatgcttcaattttgatttctgtatctagcactaattktttttgtcttagattattggccattcctatactccaccatttccttatcagacaagtaaataaaygtagacatttgcccaagtttcccttgcagagtttcctctccttcttccttctccttccacctctctgtatctcctctcagttctctccatgtttaccactcttgccccctctaaacctatagtcaacagtttgactttcatctcttagtgttttctctcaggaccttaaaactaacaagttgaaattaaagactcctaggccagaagccctcatgtgaataggctgatgagaattttaaaaatgagtacatagggtcctttgcccactccccaagttgctaagtgctccttcccactaattgcagcattcattcactaataaaacgtaatgtgtctggagatargaacaggattcataaaccttgtccagaattcttggaactgagaaatataacagttgaattaagggcctacttgttattctaaattcatggaattgaatcttgatgaaatattgagatggtattgaagaaagctactgctgcaacattaactcaagcattaagagaggtagagcttctcatgagatttcctcataggaagaaaatgawtatattacccaaaggtgccatgggaagacgttaaccatttggatgagattctaataatgagaaatgaacctagagtactatccctttttgtttgctatttgtaatacttccaatgcagatggcttcaactgtgttcaacaaatttagtttttattacttaatttgtcytttttttttagatttttttttaaactcagcttggtctatttcaaaaaactagtgaacaagaacctagtaaaatcacattttcattgttctaagctgcttgatttttctctaaaaacaattattaaaatgaggctgattctgctstagtcactaatgactgtctgcactaaatcttgtataaaccagccaagaaccaatacaacaactccttcatgtccccttctggttcatactatctctccctgtccatacacagggcctctttttagaggactagtagttccaggtcttaagataagtttaaagaaagatctgaaacttcttgatgcaaatgaaactttctggaaaaagtatgtttgaataytctacaaaacactgacttaaaggaaaagaaaggcaccatcagcaatgaaattgcagaaaatgaaagaaaagaccgatgtargatttgggcagaagaaactaggtatatgctcyatatcttggctcatttgataatgagcccagttgcatcattactatatttttattatgtagtcaaatttattatgaatrcccaaatctcataggccagccatgcattgaatctatttatctaaatggaatactgaaccagataatgtccagcaattagaaacactggcttgcaaagataaaaccacataatctcttagctgccatcatttttggaaatgctacatcaatttccatctctatacataagcacatgcagtttgttgtgccatggaaactccttgccataaacatttggtacaaaygatcttcttatctatgacccatatttgagggaacagtccattaatcctgttcttatgcaaatgtagttattactaaagcagggagttggntaatcatatttggcctaattgacaataataagtcaacattcggggggtgagaactaataagggagttatgataatgctgcagctgctttgattttcaagaagncctttacttccccatggtgcttccaatcaaggatgattgtcaaaggattgcagtagaaattctcactgcnttggttaaatagaggagttgcattcttagaaatagaagcttcaaccatgaaccaaggagaacaggaaccacatgctatcttacngaagtgatttcggatttagattactacaaggtctttggagcactaaaaattagattcctgctctggaaattaaaattaagcaacagtctagtgaatgtagcataactatagaagatggggaaaggaggtggattaaaagtgacgatgtcttaaggatgaagtacaatttggagggaggaaaaggcactaacagagaaaccatctgcacagcttctgtaagcttcagaagcttcttcgtaactgcgctcagttgatagattgatctgagagaccacaaaagaatgcttagttctaacaggtttctaaactacatgaaatgaaatttgtcaggtatcctgttgtaaagactgaagtccaggtcatrattcgttgtcttttgacagttttcactgttgatcgccttggttctcagattgtcgctagctagattgtagtcttctgctgaaatactgtcttagactaccatcaccatrttagtctggtctcactttctattttatctgtttactatgctttttcatattttgttcatgccactatatagtagttaatataytgcattataaatatgaagcaacaataaactgtgcaatgaggttttagcaatcatagttaatatcacaccatatttttattcaaaaagaagcatgatgctgrgtagattatgaatatttgtagcattataatctcagattgtaatgatcaattttttgaaaactgaatatctctcaattgtgtaagactcctggctcaatttctttgctatgttataacctttcctctgtgcattagactctttactagactgtggatggataagaaattttaaaaaagcaattttaaattaaggtttaatgtttctgtgctctttgaagtagcagccaccttccccacctctgccttctatagctctccttagcaagaatcctagaagccttccttggacatcctcttgtgtcaagcacatatactcttccccctcataagcacctcccacgccagcatgcatgctctcgtaatgtttgttccaccgttgttggtgccagcccaaactgtacagccatgccctgtctttcttgtctagtccttctttctctggtgcctaaatactgacctgaatgccctcttttgtgaagtgagggagggaggcaaagggtcaggggaagaggagtggaaggctggggatagcacaatgcatgcagtgcattcctccatctccagcacatatccctcacctccctctgcttgtgttgttctgggatcacagtgtgttggtgcctaagcaggctctgattactgtgattcccagttcatccacgactgcctcctcaagccatgatccccacatctgtagtgactcctcatgggtgttacttaactacatgaaaatgcctctttagttctatattcagggatttcctttaactcttctattcactgcagcttcttttccttcctttttttttcttttattatatcacattttattttatttttaattattatactttaagttctagggtacttgtgcacaacgtgcaggtttgttacatatgtatacatgtgccatgttkctgtgctgcacccattaactcgtcatttacattaggtatttctcctagtgctatccctccccctctccccactgcacgacaggccttgttgtgtgatgttccccaccctgtgtccaagtgttctcattgttcaattcccacctataagtgagaacatgtggtgtttggttttctgtccttgcaatagttttctcagaatgacggtttccagcttcatccatgtccctgcaaaggacatgaattcatccttttttatggctgcatagtattccatggtgtatatgtgccacattttcttcattcaatctatcattgatggacatttgggtttctttactccaaataagtctatctacttctcattttacggcatggtttttaaattaattctacctcagtgcttttttatgtaccattcatctcatcagaaatgtctatcttctgactgctgtaatctgtattcatcaactccttctgtacccaggaggagagaggaggcttttcagcttaattcaacatcatgctgatcattctattacttgggcaattctctagtcactaggggtatctcattacatgttcatgacatactttgttgctcttttgtttctatttcaaccataagcttgtaagtttgtgtaaattaaattcaaaatccccaaatatgtgattagaatgttattagaataatacggatattattagaatattattagaataatatggatattattagaatagaataaggtgctctttaaaaatrcactttctgaggctccccmccccagactcatggaaatgaaatctctaacatttaggctatgtaatctatatttttattttgtatttttaagcaggttctctaataaactttaatacaataaaatttctgagcttgtattgtgtaccatcaattcaaatatcatataagtgacattagttgagggtaacctgatttaggtacactcacctttctgtccaggcttgtaggtgggtttatcagtctgtacaaagaccacaytctctctggatctgattgccacagatctcctctcttccaggttgagagtggctcctttagcagaaaatgtaataaatgccagtgggtcagatctggcctgaggaacctagggaacaaataaatactccatgaaactgattttttgttaagaaatctctatcactgtgtgttggtatcactaaaagttttaattcataatttgtcatatctatttcttcaataaccaaccttgtttatttctcttgctttgtcacttccttatctcaccatttaaatggattcttttgcctttcttaaaacttcccttttctgcacaagagtcattctttctatatgtcttattcccttcaacarttttctatcataaaatcaaatgttttggctcttgcccttgttaccatttatgactgtacttaacatcatctcatactgaggactatattattcttttaaaaattaaaataactttacacatacagtcaaatagcctgatctctgtccctaaaaaatcagttatgtgggtggtgttcatgcacctgtaatattcttttctatattaagcagaaagaagtatttacctcaaagctgatgcatttgaagaaattttctccagtaacattttcttcaaatattttggtctggacctcaccatagttgagggagaccgtcaaaacaacagattcagtgagattaaaaagctgggcacaagctttatccaaagagccttcttgtagaacagaaggaatcagcagaacatactgcctacaaaattcaagcaagaccattacaattgaatgtgtgattagttacttagcaattattgtgttaattgaagaatttttgagtttaagagaagtatgttatttttaaatgttagaaatacatcaaatggctaaatctgtatgaaacagaaagatgttggcatatgaattaaatttttaaaagtcaaaaaggaaatcccaattaaaaatcagcaggtaatttgtcattagttctataaaggttaacatcatcagtgttcttgtacaatgcttttgcccccaaactgacacagcacattctgttttatatttgcctactgtttgtccagttccttccccagcagctgtcagacacctcttcctcaacataaatatagcactgttacagctcttactcagcattctggatatctacgaggcagagatgatgatgccaaccaaatttgaaatttactagtcccatgagcatattttgggttatattgtaaaatgataaaattatttaaaatcaaatcactgcaataaaaatgtaatgtttaattattattattattattatttatttttttttttctagacagagtctccctctgtcgcccaggctggagtgcccagtggcacgatcttgcctcactgcaacctccgcctcccaggtttaagcgattctccagtctcagactccagagtagctgggattacaggctcatgctaccacacccggctaatttttgtatttttagtaaagatggggtttcatttcactatgttggccaggctggtcttgaactcctgacctcaggtgatccgcccatctcagcctcccaaagtgctgggattgcaggcgtaagccactgtgcccagcctgaatttttaataccaagctctatttgccttccatgtgaaataataaactgtgtaatcactgacaagtttggagactgagaaagagacagatgaaagagaaaaacacccagatgtattatcttccacatcatgatccaatgagatgaagaaaaagtcaatatgccgtgtctgctagatccacatacaggtcagtgttctaggagcccagacgttctcactagtcagggaagccgagtatgggactatatatccatgcaggagattttgccagtatttcctgagtcattcttaaagtttaagtcatgtttaaattttagccatctcccagtgtgttacatgtcattaggtgtgttatctaatttacaaaacagtcttgcatcagcatttcctagacataatttacaatgcctatgagtgaaaatttcaagaacaaattaaatcccatttcagtaaattcaatcattgtaaattaatttgtatctcactattatttcttggttgagagctaaatctattttgagaactcagtaccaatttctggttggcaatgctctgtatagttattacaatggaagcaatgtaaaaataacaaaggcttaaggaarctctaattgaaaaaaaattaaatattaccatgtcttttttattactaattgttgatgttgtattttccatacgacatatttttatataaaagtatcctggtaggaaagtttattgaagcattactttttctttttttgcatttcattttcttcttttcctttaccaaaattattgccaggtattttgtgtttctttgtctttagagttttgactaaataagatgctcttagaagacaatcgcacgattgctgtgactttatcaagtatcacaaagtggtttcattgggctcagcctctgacattgcccttttactgaaaacagcaggaaatctatttaccaactgttttttcctaaaattcaagttaattatatcatatcctctttaaaaatccttaatggtccactattacctacaagataaattccaaactctttagaaaaaaaagtttcttaaggctcttatctacctatagcccccactgcttgcccacagacgttctgctttcttccctgaaaacaccagcaatgtgccacaccctttcatctctacatgtgtatttgtgggctcagtcttctgtctagaacctctctttatatgacttcctgtctaccaggtacatatatcctccttgttcttttgtgattcggttcaaactttcataattcccaagctgaagttagttgttgctgcttttagctcccataacacaggtactcatctctattacaggatgtcatgtcacactacaaatatttagtttttatgtaatacatgccacttggctgtgggaatctcagagatacagcctgcatgttttattcattgttgaatttccaatgggtggtatatgaatgcaagcacttcttgagtcaatcatgacttttagtcagtctcaggttttccatagaatcttgtgtctgtgtacaactaaccatattcttggggagcaaaataggagaatattaaccctcccaggaggagagcttctttccattcacttctttccattcaacccatcctatgctgcatttgaagtaagcactcttgactcccagacttttaaagcaaacccattattggggtgctagctttctatccagaggttttacacaggttttgtaatgcagtgagaagcagacgcatctttctgactaataatgtcttctgctggtttcccactgctatatattacagagaactagaaaagattaaagccagtatctgtatttagggtatggtcaacttaatgagrcattagcttttattttattgttactctattttcacataaccctttctaaaaagcctgttatcatgcacttctttacctatgaaattttggccaaatctaaagacaattgcccttaatcatttgactaagacaatggactttatgctttcaatctactccttcctctttatatcccagttggctaacagtctcagattagtgactacttgtgttgttctttgtgaaaagcaacacccaaacctacctctctttatgtttgcctgttactgattccttggggtttcgttaccccttgctacaacactcattccaaagtgtgaatctaaaatgatcacttactatttgaggaacacagtcaggcatgtacttacatatagagcatctttactaattaaaatgcaaaatataaatcataccaatagtagggcacatctggagatcaaatgctttctcagactttattaacccattacaatttagaaatccaaatctaacatcgataacaggaaagttaatataagaaatttccaaaagacaaattagtacaaatgtttgaatttgttgagtagaaggtggatcttgcagtgcacttatcttttataaggagaattaaattcatctttataaacacacatacaatctcatctatctgatttgattgaagaaatcataactattaaatatttgaataatacccctctgataaataaatatatgagcatactacactgacttgcacatatgagaattttctagattgccagttagcasctaaaatttggagtaaatgccctaaccttctatctgggactcatgtttagaattatgatttattttcttattccatggaattataatacatatggagtaattctattaatattatttatacttgcctccaactctctaagttacatctgacttaargtatgattgttcatttttttagattttcccccagatctcaaaagtgaactttgtacataaacattatccaaattgagagatagatataaatatagacctccctaatacaccttctaaatttggtaaaagtcttctaactgtttaaatgggaaacagtaagaataacagaacacatatacacatgaacacagacatacgtaagttttttacagtacaataacaatgttatttgcatacaggatacagagcagttgtttctaattctcagtctacgcatgggaaatccccttctactgtgggaaaagatttcatcatttactagacaagaaggatctcattcataaagttaarggtgtggagagagtgggaaaaatgatggtgtgggttgtctgttargcaaactgggaatgccgtttccagcatatgaaaaaaatccctctttattcacatacattccaatgttcacttcctcatcctgtaaagcagagatgtgtttcattacaactataaaagtgcaatgctgggctaaagcctccttaccattactacaaaaaaggattctaaacaaaatctaaatcaatgcttctaactttaagatcattgctctaatgttttaaaaaaatgcatctgggatgccttttattataattttttaacagcagcaatttattttatgaaattaaaaaaatgagttcagtaattgtcaaaataaaacacaagtaagacataagtccaagtctgagtatattgtgaatactttggaataatgttattaataaacattgtctgcttttatggcagtgaatattcatatatttaatataagaaaacattttatattcaagatgcctttccctacaatgcaaagtaactgaagtttataggtaatatatactattaaaaaataaaaattaatatatactcatgaaaagtaaaaagaaaaataagaaaaagaataaattatgcttccaagcttagtgaagatctattcactcttccaaagtcattttcagaatataacttctctcctgtgttttcaccacctttcttgcttcactttctttaaagtatgaatctttaggtagtattgatcatttttgatattaagaaaatacaaagcttctggaaataattcaaatcattttgcaacttttggctgtgatcactttgcaaagcatgcagtgtttcttcgtagccaattgatgaagggtttagggaaatttgccaggaacttaccatgagtcatgggacaaatgggaacccgtcattccctctgcaaaacctgttcttgagaagccctttgtycagagcctcagtaggcagctggttcataccaaccaatggtaagcaatgctcatctgttctctcccttaaggcctctctttgtgtraagacccacaagcataagtatctgtggtggggctgtgtcatgagggcaggctcacagtgctctcctctgagttaccactactgaacataatcagggtgtgtaaacttgttttatttggcattaaagccgttacaacaagttataaacatttccagagcttcttactagtggaagcagaggtagtctctcaggcagagtgtggttaggaccgaatgcactctgttgggaaaggcctgtggtaaatgcaacaccttggcacaagaaagttatacttttgttgtagtgtaaaccaaaaataaaattctaagccccccaaccaatagaatgaaccccttctgtcagccaaggacatcctacagtaaatctgaaacactagttcaggccatgataggagtgggaggtcagatgtatctgattacaccttccccctttggaatacaggcactgctgatcagcattaacatcaaaacagagagcttaagacaaaatactctttgtagcaataagacatcaacatgacagataacagggcctaaaagaaattgaagtattttaccctcaaatatatttctttcttttttttactcgaacatgatcattttttaaaaattttactttaacttctggtataatgtgcagaatgttcaggtttattgcataggtatatatgtgccatggtggtttgctgcacctatcaatctgccatccaggttttaagccccgcacccacaatatatttctttgacatattttgaaatggatctgcacagttgtcttttgtggggaaaatctacattctacagagaatcgccatccttttccaggtcattttcctgatccaggagagacttaactaagagtttggcacctttttaagtctgataagagacatttacaatctgttctctctgaagcctgctacgcagaggcttcatctgcataataagaatcttggtctccaaaacccgttatcttaacccagacacttcctcctatcgattccagctctttagataaactatgttaatcaagtgccaatcagaaaatctttgaatccacctaggacctggaagcacagttccctgccccctttgagstgtcctgcctttctagacctaaccaacgtgtaccwcaaatgtatcgattaatgtcgtatgtctccctaaaacatgtagattcaaactgtggcccaaccaccttgagcgcatgttctcaggatctcctggggctgtgtcttcatgggccatggtcatgcatatttggctcagaataactctctccaaatattttacagagtttgactcttttcatagacagtagctttcagaaaactacaattactcaacctgactttaaaatattaacatattaagaatttggtttgtgtgtaaaacattcattcctttccttgtaaggtagttacagagaargacaaaggccttggagcctcatggtgagtgtttggatcttggttctaccacttctcagatgatcaaccttggatgagttatttgaattccctgtgcttcccttcctttgtctatagatgggaataatcacaataccataccttataagcttgttgtggaaattgaacaagtaatatatttaaagtgattagaacagttactgacacagtaaacactgggtaagcctctacagagactaaatattacacccctaaccaccaaacacaccctacaaaattctagtcataaagagcattagtatgaacaatggattactcatgtcagccaagcgctctccaaaatgattttcctgaaatcaatatagaaacaactaaaaagaaatgagatgtcgtaagttctatataatgatgctatagaataaaggaggaaaggaattgaaaaagaaaagtaagaacatctttgtcaggtgcaagtaacagaatacctaaacagacttytaaaaaatcaaacatttataatctcatttggcacaaatcctgagaatggaggactggcattggttcagcagctcatgcatgccatcaaacagtttcctaaattctttccaccctacttccttgatgtgtcagtattatttgcaattttggctcctgacgtagcaaagattattccttcccagcaatatctcaatctgaatgaaaagagtgagcaggaaaaaattttcttctcctacatctctcttttcttttcttttctcttctctccttctttctccttctcctcctcctccaccttctctctttcccttttcctgccccccacctcttttacaaactattgcagatgctatattaggaaattttcctgtatagctccttatccacgcctggtttatatctctcattgctaggccaaagtagtgaacgctgtggtgtaccctctagataatccccttcatggcagaggcacttatgaccctagctgctaggaatgttggtggctgttggctgtcagatgaattcacctctgagaacctccctcagcatcagagaaacatttcacccaggttcctcttcctttctaggggcagctcagtgcacaataatgggtactatgtgtgtataaatgcacagctctgttgccttaaattaggacaactctgaacaatcaccccaaccccacagctccccacgggatatactgataactttattgtgactgccttgtagtacagctcctttttctgtacaatcctgcttccttcatcctctacaggtgttgatctttagaattctctccaataaaccctcttcccacaaatcttcatctcagagtctccgttttgtggaacctgatctgtggattccaatcactgtaagaggggactgtgataatatgattgacttaaaaaacaaaatcatgattcatctgagagcacttgaggcctgagcaaaatacacattctctaaacttacaaagaagaggaaaatctcatgtgtgagcaaccacaaacagagaaaagtggattgttcaagacactttgactattgcattgtgttggaaggatgggaaggagagaacagaaagttgtgagcaggataaaaatactaaaatgtcattctttggtacagtaaaaagaaaatgagagctcccaaagatcagtgaacagcaagaacaattatgatattaacatgggcagagtttcctaaaagaagaatccagagatggtctaagcagtgcttctcaaactttaatttgtacatacccaatctgaggatgatcttgttaacatgtggattctggttcagcatatgtgggtaggacctgacattctgcattcatttccaacagcctcccagcaatgcaagtactgctactcttctgaccacacttagagtagcaaggctctggagcctttgaaccccagttcaccattacctatggctggggaagcttggaataaccctgatgtccaagctatgcccttagatcaagggatttaaattgtggtcttggggctagtagtgccagtatcamttgggatcctcttaaaaatacaagttcttccatggtgtatatgtgtcacattttcttaatccagtctatcatttttggacaccgtggaatactatgcagccataaaaaatgatgagttcatgtcctttgtagggacacggatgaagatggaaaccatcattctcagcaaactatcacaaggacaaaaaaacaaacaccgcatgttctcactcataggtgggcattgaacaatgagaacacatggacacgggaaggggaacatcacacaccggggcctgttgtggggttgggggaggggggagggatagcattaggagatatacctaatgtaaatgacgagttaatgggtgcagcacaccaacatggcacacgtatacatatgtaacaaacctgcatgttgtgcacatgtaccctagaacttaaagtataatatatatatacaagttcttgtgcttcagccagacctattgagtcagaattccaggaatgagcctcagcaatctcaccatctgggtgattctgacacacagtagagtttgagaaccactgccttgcttcggcaatcctattaagttggtcgaagtgagacgtcacattaaaaacaaacaaacaaaaaaacctaggctcctagcatgttcaaggaaactccacccaagaaaaatgtgaccttctagtacacttgtgctagaggtttaaaagaacaaatccagcttattttggcatatgctgtcccttatgggatgaaagaaatgggtaactttttttctgcctaagtaagtaaatgatcaatttacagtcctcaatttccttgacacacttgcagcactggacactgttgactactcctttttccctgacagtttttgacctggcttccaggagaccacactgttttggtcttcctctgacttcactggtttctctcttacccagtctccttggctgatttcttcgcaatctgcttcctcccaacctccacatattcaagagcttcacagaaaaggcccaaattctcttccctattcagactcactgcctgagtaatctcttcccatcccacagtctatgtgctcacaattccacaatgtatatattttttttagctcagagctctctctttctctcaaactcctatactgattgtccagcctccaacctgatgtctccacttaagtatataaaatcaaaagctcaaagatgaattattaatcttctaccccaaacctatgtcagccatggcatagctcaggtaatggcaattctttccatagaattagctcaggccaacagcatgggaataatctctgatcactttttttttctcattccttgtatccagtccatcaggaaatcatactggttttactttcaaaatatacctagagtctattgcttcttaccagcttctcccctgctacaaccctggtccaagccacaatcaccttttgcctggattattttcacaacctccacgaggtctcctcacttctactcctgcactcctacagcctatactcaacacagcagctagctgattattttaaaacataatcagatcaggtcactgctctatccaaaaccctgcaaatcattcccagttttgctcagagtgaaatctaaagccctaacaatgacccttgatccccttcctggtttggtgccccaacatgtttcttatctctctacctactactgtatgcacctctttgctccgtctgctctagtgccatgctaacttaattgttgtttcttgaacacacaagacacactttaactttatgggccttgtttttttctagctgatctcactgccaggcctagattttccttagatgtctatgtggccaactccataacctccgtcaagactttgcccaaatgtcgttgcctcaatgatatcaatcctaagccttgtgtttagctttccagtcttctcacctcccagagtgttctatatcctcctgcccttctcttcattttatattttccatagcacttatagcctcttaatttcctagactttgcttacccattatgttcattattatgtttgcgyatttcgtttgattgtattatacgtattgtttgtctcccccattagaatgcaagcaccacaagggcagctgtttttactattttcatgcattgatatttcccaaacaccaggaagagtatttggcaactatcagcattcaagactggaggtctgaactaaagcagcatggcagtgctggataaaatcatgtaggtctatgagtcattcaggaggtagatcaacaattgtcaattatcaacactgagagaaaatgagatgagagagagaaggaggtaaatttgacccttaggtgatgggtgatgatattgtcacacacygaagmggggatctaagttggagaaactggtttggagtagattatggatcctattgaagtgcctgtgggacattcagttaaagaagcaccttaggcagtgggatatgtggaactgaagtgtgaatatagaggcatatatttgggatacacaaaaatacagacagtaactgaaatgcaggatatttaatgtgtatagtgagaagagaagagggtttgcaatagaatcataaaaaaattatttaatagtaagagaaagtgaggtcaaaatgaagatcattaaatatccagaaagtgagaaggaaaatgtgattattatgggaatataatccatctctctaggatatggatataatccatctttaggatatggattatatgtgatggtggaaggaaaagaaaacaataaacagaaagaggctgaggataaagaagagaaagacaataaaattgatggaatgagaaggtggcgaaacaggatgagatttctagaacatagcaaaggagatgttagtgttaagggtttcagctactcattaaatatatatatctacatttatatatacacacatacatatatacacatatatgtgtatatatatgggcatatgcatgtatacgtatgcacatacacacatacatatgtgtatacacatgtgcacctatctgtacacatacatatattcacatgtacatgtgtatacatgtgtatgtgtatgtatacttacatatactatatgtgtgtatgtgcatgtatacatacatatacacatatatacacccatgtatatatgtatatacatacacatattgtaggtatatatgtgtatacatgtatgtatgtatatacatatatatacacacaaagtttatttcaaattgcaaaaaagtatgtgattactgtataagaaaatgatagagacagttaattattattcccattgttcaaagtacttttgcatggagcaggaatggtggacataaaagtgccatgtgatgcttcaatagcacaaaccttctccaaatcagagctatacagcctccatgaaatattccgtggtagtctagtttactgaagacctcttcttaaacacacacactcacacatacacaatcacatgaatataatcacatcaaagcttggcactttccattcaacactcctgaattaaaatgttcattatttactataaaaatctggacacggaaaatgacttcagtactctgttcaaaaagaaactggggaaaggttttattgaaaagggcaagggccgggcayggtgactcacgcctgtaatcccagcactttgggaggccgaggcgggcggatcacaaggtcaggagatcgagaccatcctggctaatgtggtgaaaccccgtatctactaaaaaaatataaaaaattagctgggcatggtggcgggcacctgtagtcccagctactcgggaggctgagggcaggagaatggcatgaacccgggaggcagagcttgcagtgagccgagatcgcgccactgcactccagcctgggcgacagagcgagactctgtctcaaaaaaaaaaaagaaaaaaaaaaaagaaaagggcgagtaagagagctgtattgttcatctacccacatctattctttagatggtatttttctctcagttccttaataccttacatactcattgtgacactgagaattttccaccataaaccttaaatccaagactttttctttgcctttagttataccaaatagctgacttcattatgccttccttgcttgcttataatttgaggagcaattttattatgtaatcaggttaactactaaatacataagtaaaatggggactgaaaatttattatttacttagaaaaaaaaggtttcccataaaggggtgttatgtaccacaaagtacactcccttcattttccttgaacctttatcacaaattgtactagaagagtcactcacattttcctgaagtggagtctctgaaaatccacagggcctagggtactttaagaatatataagtcagtctgagtatggtggtttatgcctgtaatcccagcactttgggaagccaaggcaggggggttgtttgagtctaggagatagggccagctgggcaacacagtgagaccccgtctctacaaaaaatacaaaaatcagctgagtgtggtggtgaacacctgtagtcccagctactcaggaggctggggtgggaggattgcttgagcctgggaggcagaggttgcagtgagccgtgagtgtgccactgcattccagcctgggcaaaagtgcaagactctctctttctttctttctttctttctttctttctttctttctttctttctttctttctttctttctttctttcttcctctctctctctctctctctctctctctctctctctatatatatatatatatatatatagagagagagagagagagagagagagagagactgtcagtatatctagctggactgtcagtatatctatatatttgtcaataaaatttattctcttatcctataacaacacagcttccatcccagttcctggggattgggggataagcccaaatgacaggaacagcgtgtattatcagggttctccagaaggacagaactaataggattgatgtatatataaaggggagattattaaagagtattgactcacacaatcacaatgtgaaatgccacaataggctgtctgcaagctgaggagcaaggaagccaagtctgagtcctaaaacctcaaaagtagggaagccagcagtgcggccttcagtctgcagccgaaagcccaagagcccctggcaaaccactggtttaagtccaagagtccaaaagctgaaaaacttggagtctgatgtttgagggcaggaagcatccagcacaaaagatgaaggctggaagactcagcaagccagctccttccaccgtcttctgcctgctttttctagctggctggtagctggttggatggtgcccacccacattgtgggtaggtcttcctgagggtgggtcttcctctccctgtccactgactcaaatattaatctcttctggcaacacccagaaatgctcagatacacccagaaacaataattagcatccttcaatccaatcaagttgacacttaatattaaccatcgcagggcagaatttcagccagtgtggagcccatagagtgtgctgcaggagtgtctgtaatggagcatggccagggtcccccacactcctaggctttacttgctcccataggagactttagccttagggaaagtattagacccgaaccctgcggggcagtcttgaaaatgagatgaggtcagtccaacctgagcatccctttgtctgctggcctcttctggggcccagactggttgcacttgcttgcagtgcagcccccaagtacctccygggagccttcattatagctcctgagctggtggacttcacctgaccaatacagtgctccaacagagcagccctcatggacatgtactagcctgcccgttccctcccaagtgcagcctctcccataccattttgctgatatacactcacccatgatcacccctgactttgcyttgtttgcattcctcccccaccaatgtgcatgtgcacacgcaccctagcatgccactactgctggcatgagtgcacatcacgcccctcctccctgccacactgccactgtcattgaagtgtttgcaggcagagggcccaccagcccagctcctgctagtgccttgctcctgtgcccgtgccaacactgttgctgacgtaacactagccatggagaacagcagactcacccctgccctgagtggccactgccatccacatgaatgtgcagagggcacacatggtcctgcacccaccagtcccctatccccatgctaacatcacaatcggcatgaaagcatacagtcaccagcaggggccccctgtcccatagaattgtgctgccactactgctgctgggaacacctgcacagaggctggcacctcagcacctgctagtaccttgctgaagctgacaagcatgcaccccacctcactgctgctgctgcttctggtggcatgtgtgagctgctgctgctggtggcatgtgtgaatgaggaggaatcctgctgccactgcactgcagaatgctttggctggcaccacccatcagaatgctgtgaccagcagtctgggagcaccttggtccctccagcacatcaggttcctaaccttgaggagccagggaacaaagtcaggacctgagacctgtccctttgcactagtgcatgcagttcaggagtcctgagctgagccttggccttctaatatcttccagaaatgaagccagtaaatcaaacccaccttataccacaatcaaacccccaaagtcatcaaatagaataaaaggaacaaaatcccattcaaaggacaacaacttcaaagactgaaggaatatcagcctataaaaatgagaaagaaccagcatgagaactatgacaactcaaaaagccagaatgtcttctttcctccaratgactgcattagctttccagcaagagttcttaatcaggctgatatggctgaaatgacagaaatagaattcagaaatatggataggaatgaagatcactgagattcaggagaacgttgaaactgaacctaaggaagctaagaatcacaataaaaggatacaggaactgacagacaatatagccagtatagaaaaaaatgtaaccaaccgaatagacctgaaaatgctttaaaagaatctcataatgtaattgcaagtattaacaacagaatagaccaagctgaggaaagaactcagagcttggagactggctttctgaataagacagtcaagaagaataaggaaaagagaatgaaaagaaatgaacaaaacccctgagaaatatgggattatgtaaagagaccaaatctatgacttgtttgcattaatgaaaaggattaggagaatggaagcaacttagaaaacatatttcaggatatcattcatgagaacttccacaagctagctagagaggccaactttcaaaatcaggaaatgcacagacccctgaaaaatacttcacaagaagatcatccctaagacacatggtcgtcgactctccaaggtcaaaataatctgtacaatgcgtccttcactttcttcctttcctccccacccctcactgttcaacagataacctgagtgcattcagtttgtaaagcacagtgctggggccgtgaaagccagagaygaatcagacaacacacaaccactctcaaagagattcagggatcccaggagggaagaaaggaacatcagtaagcacaacrccccgcaagcctgggtttcacatctgtttagcagcagcatgaccttaaggaggtcactaacaggtcaacgcctcagcttcttccactgaaaaacaggaatggtcacttctgcgtcactgaattacctctcactgaattacctcgaaggtgaaaaggagctggtgatgtctggtgctcctgtcctggctgacacagctaggtcctcagcattggctattattgcctgcaagacggggagyagtgaggggcttcaggcactcaggaaacccagaactcccacaagtgggcagggcaaagtaggcraaatttcagggaggaggcggtctagagcagatcacctggagagggaagctccaggcttaggagacagacactctgcaagagaacgccacggaggacgaaacagcagagcaacagcaagcagcgcctctggctggagctgtgcctttcaaggagccgcagtaggaaccacgctcctcttggggtggcagagggatgggcaggaccatgcttgggctccctgttccaccgcctccaaagacgacatccccattccccatgagaatgtttcctatgaagccaggctggcccttgacctctgcagggctgccactgrccctggcccatcatcatgccagtccctagaggctgatggtgagaagggagcagaaagcgcccactcctgacccagattcgctgcttctcctcccctgcctctgtcatgaccccagggaagcaaaccctgaaccggggctctcgccttcacctttaccttctccattctgggataaaagaccacacattggatgtagtgtacactgctccccaaaaccattgaaataaaaaataaagaatgatctgctcattatgcaggccacttgggggccaccagatgccaatgagtagaaggagagagaaggacagatggaggaagtaaggacaaggggaaaggggaagggagaaagggagaagaaaggaaggggagtggggaaagaaggagaaagagagggaggaaaggaccaagagccttgcagagaaaattccccctttttctaaggaaaggtgctgggcagtggtgcagcttcttgggtgaagatgttgggcaggggctgacgggaaaaggcagataacagcatccaaacttccacacacgaagtctgtcccctcctcttccccgtgccgtctcaacaacccccatcccccgccctgccttgtcatctatatcttgggaagcaggtgacatatctggcccaatattttggggcctagcttctcccaggtgtggagggggcagatgcagggacaggaagaagcggctgggaggggctggagggtggggctgaagagagcctgggaggtgcttgtcattccctccagtctctgcaagctcccccactgcgacagagcaggaggagagagcatagccaggaatgctaatttgccaggagctcacctgcctgcgtcacaaggcacaggtgccaatgaggccagggtccagtctggggcatgagatggggtggtggggaggagagagacagtctctcctctacccacctgtctcttctgtgcaggtggtttccgagcaggtgaagcacatktaaagggggaggttctaaactggtcacagtcccattgaaaaagcccatgggaaatgaaaagcccacacactcgcccattccattgccacaggmagggggcaggtggaggaggagcggtgggtgctccccacaccactcccaattatcaccgactcctccctttccttcattctccttcccaatctgtcagtgtatcctgtggttggtccctttgaatgtctcacccagccctccttgcttgcaagtcccctgattgcagcctcatccccgccatgtcctgactacagcaacagcctctgggtgtctctgccatctgctctctctctcccttcttgtcccctttgtgacaggtgcttgatgaaccttccccaaactcttctgacccatccctgccctgctcaggacccaatcacagttccctcaccctcctgaatcaaacctgaagtcctgtcctgagtaccccatgggccttaactyactcatcccaacttcactcattgccttgccccacaccctgccagggagcctcccatggcaccgtggaggacgcagaggaaccaaggcaaagctcctgtggcaccatccagagagaccaggcccacaggcatgtggaaagtcagcctccaaccccctgctctgcagggaaggagctgagtgcaagggagaggcagcgctgtctgtgcttcccgtgcagaagtcccagccccagcccctgtgcaggccggcctccccggcagcctgtcatactccgagttcccagccactttcaggcttctctccaagcctgtggcctccatttctagaccccaccccgggacctgcacaccagcctcgctaccttagccccctcctccaggagcctgccctgtgtggagtaggcacatggttttcctctccagcacccattkcctccttactcaagcaatggccctgtttcctctggggaatccatctcarttcatgagcatcagatcagactgcccccagagctcctcagtctaagccaatcagtgtgtcatagtccccagcctcagtgatggattctgggacagacacgaggaccaagccaggtgggatgagtgagtgtggcttctggaggaagtggggacaaaggagagcattctttcctgccagacctaaccctgggtcatgagtccagccccactggttgtcacctcrccaccacgagagcaaggcctgtctgggaatgtagccagcccaaaagaagcaagctgacatggaaggaaagcaaaccaggcctggatgacgtcgtgtaagccctggaactccgaagcctgctctactgattagttactttttgctcaacctggtctggagagttccgactgacaggrtgccaccaatttttagtgatttctctcccctctagacccctggaagcctgtgygattcatgctatgcaatgaagaatcagcctcgccctgtgctctcccattccrgcctctaagctcctaaggacaccgtgttggccacatctttggtgtctctcagggtccagcacaatggggagcacacggtgggagayggatgtggtgacctggaactcaggtgtgagggagctgggacacaggcccaggattcctgagagacatcctcccctccctgggccrtgcgagccacttggagaacctgcacccactctcaacgaactcagcactcccttccccaggatatgccttcctgccttctcctcatcccatccctgggcaggggacatgcaactgtctacaggtgcctagtaccaggatgggaaaggaaagccaccaaaatctaaggctgccctcagagaagggcaagcatgcagtcctcatcttgatgaggaaasagtttctgagggaatagttttcccctccattccaagcgttggacatgaggcggccataatcaggggctgatggctcttaaagacttccgtcctcttgccgaggcatcccttgggcacatttagcataacaataagcacaaaggagygtccaacactttctgtaactgttggtagcaagttgatgaatggccaccattcaatgggcagtcaacgagtagagattatcaacaggcaagagctagcatttcctgaaggcttcctaggtgccaggcactgttccattcctttgcatgttttaatttatgtaatctttgcaacagttctatcaggaagatgccatgattaccacagtttcacagatgaggacattgaggcttagagggattgagtaagttgccaagggaacagagcaagcaaacagggaagccagatttgagccaaggcatcagctccaaggcaacctctcagccagttcagtgcaaagcctcttgtttacagggactttctagacaggcttgaagcaggccagtgagtcagtgggcaggggagaggcagaatagttaagaggatctggaggcaatgactatgcttcatcccccattttttagtttgggagggcttccaggaagaggtgggcttccagttcatgacagaagaggaggctgcacagtgaaggagcagggactccaggtctggtgacaatcaggtgtgggccagggtgagggtggcttgcatcaggagagggatctgagtcaggcagtcacatacttcgtgctggggtccctcaagaggcacagcctgaggtcccgggaagaagaccaagcctcatttcaggttgcttgcggccaaagacaggacctgtgtacccaacaacccctgggacctttgcaggaaacagcaaacactattcactcactcgagttagataaacactgagtgaaaagtcactggagccaaaggactgtgcggggtcagcgctgccgatacaagaactgcagccctccagctcggcttcctcaacggcctctctgcgctgcagccacactggcctcctttcaggtcctccacctcagggctgtaggtcatgtgcttccttctttctggaatgttctccctgacctacccactcaccctcaggttttaccacaaatgctatttcctcacatccaccttccctgacccagccagrccccccatsatgagcctcgcagawcctcatctcccctccacagaggtgatcataacccacagaacccagggccacgatccctggctttgaaccctggctctgccactcagctaagtctctgtctttctgtgcctcggtttcctcatctataaaatggagataacagcagtgcctgctcataaaatgtggtgagggttaaatgagttaaggcactcagatcaatggtggagcatggttaatgctatatgcatattagtgaatattataaataggctttatcacaactgtaactaaacaactgctcatgcattggttatttaggtctgtctctcctgccagaatatgcactccagttggacagggacgctgccttattcatcactggatctatagagatttgctcagtgcctcgctcacagtcactgttgggtaaatattttctggctgcaggaaagagtgaaggactagccccctcgccgtgggaggaagagggtgagttgggagagcagagccaccacaggaaaccagggggcaaagtggggtggaaggcagtgagctctcaggctctcaggagcaaaagcttccaagctgggctctcaccttggcccctcccacccagggaagacagctgggtcttccaggaccaggaatccccaaaggggctgctcccagagggtgtattgctgggactggagagaggactgcccagaaccaccccctctgatcaggtgggggtgggtggcagctcccacctactgaagatgtctctggagaccttctgcaggcactgccaggcatctgccacctgccggacggtctcctctcactgcaggtctggtgggatgacgggcaaggcataggtctgacctgccagggaatgctgggtcctcgcaggagtcgtggtgcctgtgggtagcatcagagccacccacgcccaccggcacccactcaccacaggtagcatggtgttgagacagcacagccctcatcccaactgtgtgcacagcttcggggaggtggggagggggatgggagacaaagcatttggtgggaggccaggagctcataggagatgggattctgctgatgcctgctgagtgaatgagggagggagggggcaggacaagggactggggatttggtagggacaatggaggagctcggagaagaggcaacatttcttcaayccttataaggtgctgggtacctgccaggaaccctgtccatacacgatctcagttcagctcctcaccttgggtacacaagaaaggatcccyggctgaagagggaaatagaggctggaaacaggggtacatgggcagggtggtggtggtgagagaattgcccgaatcagctgccaaatggtgcccaggttggaaacgcaaatgtgcacacatgggttcttcccactctaaccctgaggaattcgaggcctgcttctgacacagactgggcagtggctagtgactctaggtatagagtgtccagaccctgctcacccaggctagagcttagggagccagaaggaaggaggtgcatgtgggggtgcgggacaggagggaaaaacactccttaaattgcaaagtgagggcagaatctatttacattgggttgaattaactcctccccttgatgccactaaagcaggaatcacactgcagatggcactgatttgattggcaagagacatgccaggaagaatattaagggaccaggcccctataattaggcctaatcgtagcctgttgtttgaaaagggtatgaaggacattcatcaggcttggcackgtgccctagacctgctctcctggktagtggggccctccattgcaacagaggtgtgggtgggcctgggagagtgtggcaagaaatgcttaggaggctctacttggccttaaagggctgtgtgaccttgggtaaattgccttctttgaatctctggtcctttccatttcccattctccaggctaagarctgcactctgatacacggttattcccaataataataaccatccaccccgtgcagtggtcataaaccagagagagaaatgtccacatgaaactakgtgctgcatgctggccatcactcatggatcattaatgaaaactracttggaatcactattttaaggacaggatggyggggaggcatgcttgtaaacagagcccttggcgactcaattcatctgcaactcatttttcatatatgttaaatgtatcccttcaagatcattgcaaagaaaaactaagttaacataagaaacagtgcctggtggctagtgaacattctacaggtgttggatgctgttgtcatcattgtyatcattatcagaatggacaagacagaaccccacagtcattcatttcagctctctttttggtgaagaaatgtgttgagcatttagctggaaacctggcacttaggcacaaggttggtgtagaaggcacctgcagacctgacccaggcgcaaggctaggcacccttgtccagttctctgctgacttacaggcagttctccctcactgctcctcacctccagaataaggagactccttcagctttgaagatgtgggaagagcaggggtgagggcaaggaagaggrtgtctgagcrttgaaaaggcyragaaaagaggctggagccctgaaggcaatcagcacctgttcccaagaatgcaaggctgggccttctcccctctcagacacatccatcatctgtcaagatcagccactcagagccctcaaccttgccccctcctccttcagaccccatggtacactcacaccaaggagggtgtcacagtgcaggggtttcatccccagggcagctcattgctgggaaggccacagcacccagctccctctgctgccagattccaggccctgtggacagcatgtgtcacacagcaggtgcacactkactgtcatctcccttccttagtcctggaggtggtctctgctgtggctctgcatgccaccaatgctctctgaccatctctaacggcagcctttgatctcaaaaatgccccagcctctaagtaacccatggcagtatgaagccaacaatgaggaatttcttccgagctctcycctggagatggggtggcrggagggcatgcctgcgactgagataactcccaaagcacagcrgggaaggaagaggagaacaatgaggaagaaagggagctgagaagggaggggaagcagacaggagatgaggcggtgcatggaagagagcctggtgccacccccataggctaccctatcacctcagtccctcccagcatccaaggcccttcctcagggctgctgtgcctatcacggccactaacctggctgctccctgagcctggcagccaacaatcacacagaagaagtccaagagcccagctctgcacaccttcagcactcctgtcacagcagcgggaaagggttctggtgtcatggacctggtgccttgagccaacctgggatgggcaatgtctgtggccactaagaagctgacctcagcatggtccggctgggactagaatgggagcagagacggggcttctcgagtctatctgtgcggtgggaaggtcttcctgtgtgtgtggctgcaggtggatctaggaaagggggataaaggccctgccttcagggcaccccaactctactggggagactcactctgacacatgaagcacaccagacatccaagaggcacatgaaatggtgagacatgacgggtgaatacaaaaagccaggaactccattctggaaaaacaggactgatggcattggatcaagtctgcaaaatcacaaaggacaataaagagaactgacacagacctgaaacaggaccccaggcatcccttgaagctcaaaagaatgatctaaggacaaataaacggcagttgagttttacacaacgggcaaaggcaaggagttccttaccgtggggatgacacaggataaaacatggctgagaccaggagaactcagataaactcgtgggagaaccacaatgtgctgtggaggggagcaggcatgcgggtacactcctgacctccacagacggcccctaccaccargcctgatggagctgcctacctagcatgggtaggcctcattccttcagagaaatggaagaaattttaatttctttaaaataaaatcctttaattttaagagacttaaaatgaaaacctttaagccagccctgcccttgtgtgtgctgagttccagaaccaggcactgccagtgagcagcagagggaatgcacctgcctaggctggaggggagcagggcctgggggtgtgggtggtgtttgctattcttcccaggatcactgagcacctaggtgagctgagctaccggagtccttggaaagacccagtgcccttcttcttagggtcaagaaggaaggcacaaagagggagagaggctcagcagaagaggyccctaagctcccaaggcaggctgctggatgctgagagatgaggccaggtcaactgccctaggaggggaaggggaggggagagccctggcaaggaagcccccaaggctactgactccacaggaatcatctcctgagcctggctggggtggtgtgagcctagtgaaccacacgcgctcctttctytgctactccagcaggaactggccgctgtgaaccctcttcccacattagccggctctcacactgtgactaaagagaccagccaccacatggtcccrgttacaggggcrgctggggccttgccatctggcaggacctgctgccactggcgctcgctgtctgtgagcacagggtctggtgggcaggaggtgactggagggcatgtcttcccaaaggagagctcgccaggccactcctcagaggccccagcccacaccaccagctgcctctgctcctcccaactgtgcacctcgtgccatcgagggagggctgggacccagctccagggctgcggctggcagagaaggacctggcctcctgcccactgggacagagaggtagcgggtgggaattctaccttcctcacctcccgagatgtccacaggctttggggaaatggttgaggggctttggaagttcagggaaagaaaaggaggcccaggaagaggatgaggccagcctggacttgttcatccacagggaccagggtccatgtggctgacagtctcttggggaggggacgggactctgggtcaagaagcctaagtcatagacatagtcatctccctgcctctgcgcagactgctggggtcaaaaacagcatcacgtaagcaccctccaccttggagtgcactgtttggggcaaggtgcccccagacaggccctgttgctaacacttacacccagcagttccgatggacaagctgtaaggacagcctcgccccaggtgccaggcaccagagaacttacaactgacagccaaggccagctggtaagcccttggttcccagcgagagagcctgtgagcacagtggagcctcaggacagcacgatcagagctggcttctcaaaggcggtgcccttgagctcagtcacytctcgcccctytgccgcccattgctggcacctggcttgggctctccgtctgcccaacagctcayttcagaggaaacaggaaaccaacggggmcttcgctgccctcctcagccaaacccatgcaaggccagcccatggaaagggagccagggagggtgagagtggaggggcagaggcctggctgcttctcctgctgtgatctgggcacacactaagctgcttagmcaacagctctatctcctgggctcagggctcagccatgtgaggaggaagggatcagtrcagccctgaggaagagtgaggrcctcaagtcagccagagctggtgccccacaaactgctgtggaacgcgagcaacttacttaactactctgagcccccttatgtgcaaaataggaacaacaaacaggagctcccacctcctggggttgtatcggaaattcagtgaggtggtaaagcaccccgctccacgcctggcctatgagagatgctccacaaacggtggctgtgatggcagtggggtcaccaccacatgatggctgagcccagcagacaataagacatggaaatcaaccactgygcagccactcgcaacaaggaagaaggtggaaaagctcatgagaaacaaacatccttatgacaggcttgcagggacgcctctgtattcagttatttttttctgctttggtttttgtgtttgtttgtttgtttgtttgatttcctgagatggagttttgctcttgttgtccaggctggagtgcagtggcacaatctcggctcaccacaacctccgcctcccaggttcaagcgattatcctgcctcagcctcccaagtagctgggattacaggatrcchggctaattttgtatttttagtagatatggggtttctccatgttggtcaggctggtctcgaactcccracctcaggttatccacccgcctcagcctcccaaagtgctgggattacaggtgtgagccaccatgcccggcctctgctttggtttttaagactcaacaatgatagcctccttcattcccccaaatataccacccacaccccagctttctcaggctgattcagaggctgtgctacgaggcctctggggacccagttctccacagaactcctggctgaataccctgcctcagagtccctctaggacaggcccacacttcacttctgcgcaattgggaatgtgcgtgaggtacgggtgcggccgccatagaaggaaaggccccgggcctgggtcaagcccagcgactactggagccccttgttcgtctgttacatcctctgctggcaggcaaaggggaaagaaaactcctggccatcggggcacccagattctactctgggctctttccagaactggccatgggagcttgggcaggctgtgtcgcatgtctaggctgttgctccttatctgcagaatgggagccgtgctcactggtggatggaggaggggacaggggacagactgggtggcatcccagggctccaggcattggacagaaggcatgtccagggcctgggccatgcccaaaacaacctagagcagggcaagtggcagagcccctcccaggctgctggcaagggccccctggccctaaagcagcccatcctcatcccaccccggctagtgactttgaaagagcagcttctagatgctcagccaactacacacaaaggcttctccctactgggaacaaagtaagaataacgccaccctcacgggaccaaggaagctctgagaggggatccatgaagccagcctcgggaaccagaggaggcaggggggcggcgagagggctgggcagcagaatgttggctcgcctgattagctgaccccacccagaagaagacggaggattctagttctttaagggaactggcagacttcttctctaggagccctctacctcctgggccccaactctgaagcagctgcctggcagagacagtgaggagggtgcagggagaggactttgycctccactgctctccagccaggacacggccccrgctggcagcctttcattctatactgagccaagagacacacaccagagccccaggctggccatgccccaccgcctctccagccccactgggcacactggtaagkctggggcctctgcccacagtcagggcctatcgtggcctggagcccacacctacyacmctgactacagcrggactgagggcactcatggtatctcatggaaaacaaactgaggcccaggaggaaaatgtttgtttaaaattttgcacgccatttctccagggccactaagccaggtccacttactttgattactctttagtgctctccttccagccatatgaggaaaacatatatgttttcaaaacttaggaaaatactgtattctatttttcctcacttgaaattacatggacacacctgcaactgtatgtgttttttaaaactccaagaactgtacaccaaaaagagcaaacttaaagctgrgagttgtggctcacgcctataatcccagcactttgggaggctgaggtgggtgagtcgcttaagcccaggagtctgagacaagtctggacaacatggcgaaacctgtctctacaaaaaccacaaaaattagctaggcatgttggtgcgcacctgtaatcccagctactggggaggctgaggcttgagtccaggagattaaagctacagtgagctgagatggtgccactgcacctccagcccgggcaacagagccagaccctgtctcaaaaaataaattaataaataaataaaaagagaaaactttaaggcatgtatgttggtaatacaatacataattatacatatatacatagtatgtaaacttcacagtgcattgagaacattttccctgtgtcatttaatagtttcccaaacccactcatccatgcacataccatactttatttaaaatgttcccctaatgggccaggtgcaatggctcatgcctgtaatcccagcactttgggaggccaaggtgggtggatcacatggtcaggagttcaagactagcctggccaacatggtgaaaccccatgcctactaaaaatacaaaaattagctgggcatgctggcatgcacatgtaatcctagctactcaagaggctgaggcaggagaattgcttgaacctgggaggcagaggttgcagtgagctgagatcacacaattgcatgttaacctggcaacatagtgagactctgtcccaaaaaataaaaagtaaataaataaaatgttcccataatgtaagaaatttaaattgtttttgattttcctttattataaattgctctttaatgagcactctaacacataagatatttgatagcttttcttattattttcttaatatggagttttagaagtgcagttactggtccaaagatatgcctttagtrcccttagccttagttcttaaggcttgtagtaccctttgcaaagaggcttttctcaaaggttttgacacgctatactccaccagtgctggagtagagggctgcatcatgttagcagttatcagcttaaaaatctgtgcacatttggaaggcaagatggcatgcacctgtagtcccagctactagggaggctgaggcagaagaatcacttgaggccagaaatttgagcctgcagtagctatgattgcaccactgcactccagcctgagcaacaaggtgagatcctatctctataaaaaaaagaataataataaagaaaaaagaaaggcaaaaagtagtatactattgttgccataatttggatttctttgattactagtgatgttctgcattccttctcatgtttattgattgctaatatttcatgtacaaacctagttacagcamcaaccagcaagccayaactctcaaacatccttgccatcttagtgccattgctgtaatatataaaacacacattaaaccacagcagttaatattgtgctcgtggttaataccacagtgcagtagagacaggctggcatagcgtgagaagcagaggttccaagccagacagccctgggtttaaatgtctcctccctcatggaccagccatgtgaccttggcaaagtaactkaaccgctcttaccttgggtgtcatctgctgtggagctataaaatgaaacartcatcacttccttccagggccccatgagaatcaggtgaggatgacacaggggaggcaggtacacacggccacacacccgaggggactcagcagggggcagtaatgaccacaggggacactactaaagggctgagtatgcagagctcccatcccggagagaaggggggaagaggatgatgccagtgatactgggctgtattgttaggtcactaaagtccagtgtggcatccaaaagtgtgcctgtcagaccgagtcttcccgtcgagtacgctttacagagggcctcatcctctgagggctgaccgtgggaaggcagggaactggacccaaagatcctggcttttcctccccaggagaccagggataagctcagcatccccatacrctgaaggcagcaggaagctggctgtctaacacctctcttgctttgtaagagggtccttcctaatgcagagctggggaaaggagagacgctgggaggggctagcatgccgcaccagggaaaggctggtgctctcagcggtggctggctctgcctgcagctacgtgactgagagaagaaagtcattyagagaaatcccaagacacagagagcagcatcgtggcttagatccctcttgcctccctcctccgagggctggcagtggggagtgtatatacctccgaaaatgagagctggctaatagcaggaagcccagggcctctgcacctacttacctcccaccagaagaaagcaccattcctcagcaccacccccatcaactcaggcccaggaacaggtgaatccacccagccagacacaagcaggcggggaaagatgcagggagataccccacctgcgtatctccttaaatctgctttaaaatcttccaggaggctggcagatcactggagctcaggagttccagaccagtccggccaacatggtgaaacccatctctactaaaaatacaaaacttagtcaggtgcggtgtcacgcccataatcccagctacttgggaggctgagacacaagaatcaaacccaggaggtggaagttgcagtgagctgagatcgcactactgcactccaaactgggaaacagaatgagacctcagctcaaataaataaaatgctccaggagggaaaaaaaaaaggagtgagagtagatggaataaagtcacagtagaatgtggcatcaggtgagggtgacataggggttcactacattattcaccatatttttgtgcatgtttaaatattcccacaatatataaaagctaagaggaaaaaggcgagtaatagaaacagggggactacataaggtcatgatgcctgtccctctttgtcaaacttctctgtacctcttatcttggagatgccctccctgttcctgccctacagccagcattcttttgcctttattccatttcacaatttccacatccctggctgttttcctcacccccactcagctccttgcttatcgccttcttcttcaccctccttgtcacgaccctgtcagaagctctgataaccctccaagaagaccaagtccaagagagcagaccaggaaccaggactcctgggtttcagccccagcaacgccactgtctgcacctatgcaactaacccctacccagttcacatcacatgaaagcccagcagagcccccaaagagatgttcagaagtcactgctgctgctacttctacaaggcaaacaaaggagagcccccatccctcagaacctgtttgctgggatccacctcaggcagcagaacrgggacatggaccaggctgcctggcagggcaccacggagggctggggaaatgggaatatagatgccatgatgatcatattaatgagggtaaaaattaggaccaacaggggaygtcccctctgcacatgtgtacaagtgtgtgcctttcacagacaatagaggctgaagtcagggaggcagcatgcacaggcaggcctggctcagacaggggccacgtcccagtcagacagtctcctgccacgcgttcccagcaaggatgtgaaaacagccctgccactcgctttccacccacacccctccatgccttgcctttctccctctttttcatgagggaggagagtgtgctcgccctcttctctcccaggatgacagtcaggcctggaaaacagaaggcaggaccaagggacaaatcagggtgccctcaggtctaatgccagccatgtcctgccatactgggtgcctgcggaacccacatacccctctccaggctgagaagatggmcacctgacctcctttgggaggtcattcctttggggtggtcatgttttgggggaaaccagagagaacctgaagtgaggaaacagcttggggatgaaggtgctgtacagacaccrggccagtcccgccrgctactcatgtttactatgcacagccagcacacccatgggcgaaagaccttcggtgccccctgctcctaagagctaagcactaaatagtgcatccgctgctgctccctgctaactctcccaatggaccctcacgctgccccactagggactgggatttgaagaggtaacctttaactccattgttgagtgaggaaataagggcaagggattttaccctaaaatagggaatatagactagttggccttggkatctaaagccaggagtcccgactcccagccagggctctccccatgagacatgggagagttggccaagctttctggggaagagcaccatctggggttcggttttcctagctagccaaggagaaggagccggccctgacaaactcagtgacattcacacagggcatcgtgggaacaaataaaagccacaaaccacaattcaacacaaagcaggctggatcctggcagctgcagactgatcagcccaatatgtcccgggggtggggcaggagaggactctgagatgcccgggaaggacatttgtcatgccagccagaccaaggctgccccgcagagtgagagcaacaaaggatgcagatccaggaccaggatcacaggcttagctcagctgcttctaaccaggagccttggacagatcacttggcctctctgactctcagtttttctacctatagagtggggataatgcatcttccttacaggaacaatagaagtgctttgtaaaccataaacagcacaggaaaatgaaggaatatcctagtcctcttgaggattagagggggagggaagaggagggaaggaagagaaaaaggtaggaaaggatccamaatgaggctgagattttgaaacccaacctgctggctttatagccaagcttttcatcatcactggaaactcaaacctgcagcaattatatgctgaggtcataaacgtgattaaaaaggttgtttgcaaagctgattccagggaaatgagctgcagatggcggtggcatcaatgtccttttgcagcaggcagcagctggctgtgtggactcagggacagctggaaggagttgtgctaatgcccacccccagctttggaaggcgggggcaagctgactgccctctctgtgcctggggacaggggagacttgcagagagctgaaaccctaagccataaaaccgccatttgttccagagagaaaagccagtttttcaattccagcccaaccaggagggcgggccaagctcagagaaagaagagtggactgagagcacgagtccttccacggcagcctgcctcgggcgggacaggctgcagtggctctggctgtccactgggagtgtccttggtgagggaggaaagaaggcaaagccacatctgaagtctctcggccagaagaaccctctgttctgaggccaacaggtagccctggtataaggagaaggtggaaaatacaggcaccagaaccttctctgctgcttatggcttcatagaatgttttgcaggtgacatttcacataagtgggcaccagcctgtctgtctttgatggaaagacatcaggaggcaggacccaggtctctgtcagtggcttcctgtcagagtggccaacacgggatacttaaaaatgtgaagaaggagacgtcgatcaggataatacaatgagcccttggcccaaatttgggaagggccctctcttttgatgtatctcactacctcagctgccatccctctcctggtcacttctacccatgcttcagccacagccccacttactccaggaagccctccctgatgagtcacctgcagcaacctcctgtcctgcagatcctcaccccgtactgctcactgccttggctgctgctcccaatcactcatatgcgtgcccatgtctgtctgacaactgggcgctccctaatggcagaagcacatccatatgacatttctcaaatgttccctatagtacagggaacccagagcacgtccaatgacgttgggatgtgagcctgcagagcttttcacaaatttgcagaacaagctgtgtccttcagcatcattacctgccctccccctccgactgaacctggagaagagtcaacagcctgctaccaaaaatcccccacagcccggactcggatgattcgcctacaaaggctggggagcacagtcccaggcttactaatctcctctctaccccatccccattttttccagtccccagaaagtcccaatcaatctctcagcaaattccacaggatctgtcagattcagatccagtcaactgcaggccgagtgctcttcgcatctcatcttatctactgcaggaagcaacctgagggcagcaaagaggaagacagctggtatgaacgggctctgaaacctaccagctgtgcggcccagagaaagctacctaacctctctgagcttcagctgcttcagctgtaaaatggcaagtataccgcctttctcaggtttactgttgaaatcatgtttgtaaagtgtttataaagtgtttagcactcttagaaagtactcaataatggtaattaacatgaaattatcataccaatctcttcaggtaggtattattgtcttctgtctaccaatgagggtgaaggtcagagacgttaagcaactggttcagagccacacagtatctgctcaggaggcagagctgggggttcagacagagcagcagagcgtgccctcagccctggggaagtttgcaacctcaagtcacagggacagagtagctgtgggaacttgggtcaggtacctccacccctccccaggttcagcagctccccaggaatcctggaacatgaggcatggcctcagcaagtctccatttgagagaatcagctgggatctcccagattaagtgttgttgcaggcagctgggccaaaccgcctgccctggaccctagagctcatcagattggcacctgctcttcccacacaggcaaacacggatggtgccactggcygaaccccgccatcagccttcacacagttgagctcaccaggaaagcagaatctctaaaactccagctgcagtgcaagcccagcccccagggacaccgctgtccacatctgaaatagctggcgatcatcacrgggtgggagacaggatgcagtgggcaccttccacattgaaacccactcaattaaaaccccacgtgtgggggacagacacacacgtacccatcacacccagtcttacgtgtccactgagaccctggttacgttagacatggcctcaaaggaagtaggtactttcacaaacatcatctcctttgatcttctcaaccaccctgaggagtatgtacttttgccccactttacagaygaggaaactgagaagacatcaggcaatttttccaacatcacacaaaggataaggaaaatgttaggatgccaaccccatgtctccaggtttcyttccactacagcatgctgttcatttgtgatctcgttcattcatccatccttccttccactcattccttcattcactcacctatatttttycctaaacagctacaggtcaccactgtctgggttgtttgctactaccttctgctgctgcctgagaaaacctgggagactgtgatcacattttttttcctgtagagctgcccgaatacagctcttctcaaagccttgcagcagagatgatacagccatcagcagctgatcctggaatgagtgttgagagcagcacagaccactctacgtttctgctctgaccacaggtctggcctagaatttgcccctccactgcacaatgcagstaaaaacctttaaaaaaataaataaatggtctctgagcctcccagaaatacagcacttagaatgttgtttttggagggggcatgtgataaagaatgggaaagataataaagtagcctgtcacccagctcacaggcaggtgcatgtggctgcaggggatcgtttagtcaatttaatgacatatttgttgagtatctattactgtgcctggtacgggatggagtgggtcagggaataggggagggcacaaagggagtcaaaaagaatagaaagaaagccgtcaaagggctgayggtctggttgagggaaaaagacaggaaccatctgcttagacaacacagatataaagtgtacttgagaaattcagaggatggtaaggtgcctgcaagtggggacacaaaaatttcattcagaccatggaatttcagctagacagggaaggatggccagaatttaaacctgggatggtatagaagaaaattacccaggccaggcgcagtggctcacgcctgtaatcccagcactttggcaggccaaggcgggcggttcacctgaggtcaggagttcaagaccagccccgtctctactaaaaatacaaaaaattagctagccgtggtggcgcacacctatagtcccaactcctcgagaggctgaggcaggagaatcacttgaacccaggaggcagaggttgcagtgagccgagcacgcaccactgcactccagcctgggtaacaagagtgaaactctmtctcaaaaaaagaaaagaaattacccaaactgcctgctcaacaccattgctaatgaaaaagcctgccttggtctctccttccctgatcttagcttttctttctatctctgcaaagcctccgtatagaaatctggttttattgtgcctggtaagggtcctagttcagttctaaaacaattaacaaccatgaagggacaaaagtccgaagtgggcatctcgcttatggcacatcagcctctagtcatagtcaccctcagaccccayctagcggctgcccgaattatttcattcagggatctgtgtgtttggctgataaccaggcaccactggcccgtggggtgctatgactattgcagtgttaaaaacaaggcacttggctgggaagacgtctgccgttaagtggcaggctcatggacaacggcctcaaggtatttttccttcagacatttggtcccactttggcaagacatcttggcattgcttgggcaagatattacgctctgcttcttcagagcgttgggtgggagataccccatagacagctgaagggactgggaccttgggaaatcacatttaaaatttttggacttgtttaaaattgtttgacttggtttaaacacagttcaaagcccagctgaggcattaagggtttgtcacctaaggttgtcatctaaaatgggaaatgtgtgctctattcctccttgtggcccggtaggatgtattctgcagaattgggctgcttttagctttgagcttgtgaaaaagaaaaagttttttttattgcaatgcttcctggctataatattccctaggacctggggaatggtagccaggatttggatctttaacgtaaagccaagagctaaagaaaattttagttagttgttagtcatggtggacacatttattggacaggtgcaagcctttccctgccacactgagagggtttcaaaagccttactgaaagaaattttcctcagatttggggttccattccccatacacagtgataacgagagtgcctttattgccactttattgccacttttttttgagacagtgtcccactctgtcacccaggctggagtgcagtggtataatcacagctcacagcagcctcgaccttctgggctcacaggatcctcccacctcaacctcccaagtagctggggctacaggcacrcaccatgtctggctaattttttttttaataggaatgaagtctcactatgctgcctaggctggtctcaaactcctgggctcaagcaatgctccagcctcagccaccccaagcctgttgatttcaccataattaacccactgtctaatttctcattttctgactcaactacaaattactgcataacagaaaaatagcgccgggcgcagtggctcacgcctgtaatcccagcactttgggaggccaaggcaggcagatcacctgaggtccggagttcgagaccagactgaccaacatggagaaaccccatctctactaaaaatacaaaattagccgagcgtggtggcgcatgyctgtaatcccagctactcgggagcctgaggcagcagaatggcttgaacccgggaggcggaggttgctgtgagccgagatcgygccattgcactccagcctgggcaacaagagygaaactccatctcaaaaaaaaaaagagagagaaataccattacatgtcccttgcttctaggagctaccttgatcaagtttgccgaagaaggaatcatatgcctcccctttgtttagtttactatcagattgatgggaattctagatgcccttactcttattactgtsattccctaacagcctgttcaggaatgcctccaagctgtatcttggatcgagttaaattcagcaactccttactacaaagcaacactcggaaatagacctaccaggtccttggtttaatccaatccacgaagccctgctacaagattctaaacttaatctatacaatctttctgtgttcctctgtgcatcctcagaatatctatttgtttgtaggggataacaagaaaccctctggatgtatgaatgtattgacagctagcatataggaggaacttgcctgtaagratactcatttatcccagttttctgtacacaaaactgctgaaaccaagcactggaaaagctccctaaaattacttggtaaaactaaatggtccacaactcactttcgagatatacagattcatacttgcctggtaccaagaagacagagctgggtatttcttcagataaactttgttaccttggcggagaacggtgccccatgagcgcagaattagaaatctctccctttatgaattcttgtcaaggaaattgcaatcgcagcccagcagagaggaattaaygtattgggtcaggttgtcttagataataggatagccctagattacatcttagcggagcagggaggagtatgtatggttgcaaataccgcgtgctatatttacataaacgaatccgtggaggtagaaactcatctaggaaaagttagagagcaagccacttgggtacaacagcctcccagactgtctctgaggactggttttcttttytgttttcttggattcctcgtggaaaacagtctatgttttctgggtggctaaaactaggcatgtcagtcttgttaattgtgcttatgctttctattatgaccaaatgtgcattaaaatgttgtagtgaagctgtgactaaagcaactaatacaatgatagttcagcaccacggtgccatgcctgggactcgtgaatattgtgaactccatgctattatagaaactttctctcttcatatcctagtccccgatctttgccccrattcagcaggaagtagccagagtggtctgttcccctatacccctcaggattgtggagtgacaaggatggaactgagctgcaacaggggcccctttcttaggagcctgaagaccccaagcatgaaaataaagaaaaaccctaagttccttcaagagaaattccaggcacctcactatccccagaagtaaataagaaggtaatagtagcctaaaacaagagccaaggacgtttgagttccagagatgtttgctttccctgtaggaactaaagacaacagctgaacatacgtccttgagttgtctttcagaaacccccactgaggaaccacaccgaacagatccactggcatttagacctcagataagggggaaactgaagataaaacttcttcctgatggggcttagagaaagtcacaccccatcccagccagttaacatttttctgcagatcccaaatttttaaacaaagcttctcttctttaaccagttgcaaatccgaaaatcttcgaatctacctatgacctgtaagcccccctcaagatatcctccccttttaggcctaagtcaatgtgtaatctccatgtattgatttacgattttgcctgtagcttctgctttcctgaaatttactcctgcctttaaaaacccttgcctgcaaaccattgggaaggtcaggatttgagcatttaactgcttggtcctctttgcttggtgccctgcaaatgaacacttttctgtcactgcaaaacctcagggtagatgtctggttttactgcaccaggcaagcagaccccagttcactataacagaaggcggtgaggaagaacttaggtttttattccgagtttagcgggaagcagaggctattaagctgagttacgacatagtctcaccattttagtccaagtcttagtcctagcaaaacactttggctgctgtgtggaataacgcttataagaaaacaagcatgaagccgaaagggaagtaagggcctgggcgcggtggttcatgcctataatcccagcactttgagaagccaaggtgggaggattgcttgagctcaggagttcaagaccagcctaggcaacatggcgggaccccgtctctacaaaaaatttaaaagttagctacacatggtgctgcatgcctgtggtcccagatactcaggaggctgaggtgggaggattgcttgagcccagaaggttgaagttgcattaagccatattcacgccactgcgctcccgcctgggcaatagagcaaaagcttgtctcaaaaaaaaatttgtttaaagacaagtaagggaaatcttccagtattctaggtgagaggtgatactctagactaggttgaaagcactggtaataaagaatagtggatggaccggggatatattttgggagtagggccagaagaatttgctgaatgcctggatggggaaaacaagcaccagggagagctcatgagtgtctagctagagctacggaagaagatgggagaggggcaaggcaaagggtcgaaatcaagagttctctttggttcaggtaaatccaagatgaaattagatgtctggacaacatgccgaaaagaagaaaaaaaagaaaagagaaattagatattgaggtggaaatgccaagtgggcagatggatacacccatcctgagttctgaggagaagtctgccctagaggctatggacaaatctacgcaaagatgacacttagcatccaagaattgcagaagattagccacggagggagtgcaggtgggaaagacgacccaggcctgagcccagatggaggggcctggcagaagcagaggagcagttgccaccagggcagctctgcagaaccatctgaacttgacaaaaccccagaggcagcagtagggagccacagatatgactgggattaagcttcatacctgggctgaatgaaggcttagagtcagaaatgttccctgttacagaaaaattttaaacttgtacttcttggccaggtgtggtggctcaggcctatgattccaacattttgagaggccaaagtaggagaattgcctgagcccagaagttcaagaccagcctaggcaacatagggagaccctgactctacaaaaaatttaaaaattagctgggtgtggtggtgcacacctgtggtcccagctgctcaggaggctgaggtgggaggatcacctgagcccagaaggtcaaggctgcattaagatgtgatcattccactgcactcgagcctgggcaacagagcaaggccctgtttaaaaataataataaatttttaaaaaatatatgtgttttgagacagagtctcactctgtcgcccaagctggagtgcagtgacacgatctctgctcacggcaacctccacctcccaggttcaagcctttctcctgcctcagccccccaagtagctgggcccacaggcacctgccaccacacccagctgatttctgtatttttagtagagatggggtttcaccatgttggccaggctggtctcgaactcctgacctcaggtgatccacccgcctcagcttcccaaagtgctgggattacaggtgtaagccaccgcgcctggcctaaaataaaaactttaagttgtacttcttgcatacctgagtctgaggaatgagatttatatccactactcataaaaataattacataaaattttatatatacataattaactaggttatgtatatgtctttatatgagtgtcacaaaataatcagtgccctgaaggcaaagaaagaactaggaaggagaatgggaaggggctcagtcaagatacagccttcaggggaggcatctcttaagaagtcttcatagcatttctcctttccaatcagacctctgcggcaaacatcctccaccagatcctcggccaggccaagaagcttccaagcttgatcctcctcttaatatttattggagctggaggtcctggagcagcactgtatgtcttgcatctggcactgttcratcagatgttagtaggggcagaaagaataacccaaaaaccctgagacaaactgggtgccaatgatcagtacaagttcaactcggtgaatgtggattacagcaaactgaagcaagaaggcccagatttctaaatgaaatgtttcactctaaagctgcttagaatgaagctcttccaggagccatccgcacaatttcccacttaaccaggaaacatttctcctctaaaatacatgaaatcatcttgaygtattattttggagattacactaattaatacatatccgagactcgaaaaaaactaaaaaagaaggtttcataaacagaagacaattcaagggagttcctgtgatcctaaagggaggaaggatttttgccaaagggtgagagaacagagagatgaaagctatggaaaggacaacagcgcaatttaaagcttgagaaaccaaaggtaaatgagaatggcaaccacaacaaaaactaaacctgagattgaaggggaactgagtcttcagaggaaagaaagcaaaggaaacatcgtttgaaaggttaaggatataggtagcttgcaactattctcaactgggcttcctcatccgaacagggttccttattcctcatctgacccagagtacatgacataattcgagtgattatttcttaattcccataagaatggcaaattggccgggcacagtggctcacatttgtaatcccatcactttgggaggctgaggtgggcagatcgcttgaggccaggagtttgaaaccagcctggccaacatggcaaaaccctgtctctactaaaaatacaaaaattagccaggtgtggtggtaggcgcctgtaatcccagctacccgggaggctgaagcaagagaatcccttgaacccaggaggcggaggctgcagtgagatgagattgtgccgctgcactccaacctgggtgacagaacaagaccctgtctcaaaaaaaaaaaaaaaaaaaaaaaaggcaaatctagaatccagaaggatggcactgatctagatgcatggagggtgaagttgatcaattccatgcaatagatgacatcgggcactggggcttagaatccagattttaaaaggcctgctgttaagatgtctgtttgataaaaaatcataataccagaaaaccagaatcagcaactaaaatttaaaataaaaatagagatctcacccaggggacttttaagcttcactgaggcaatgtggtatgattctggagtggagtgaaagccttttctgacccagatatcctgtcattagtgttcacagccaacacggtctcagttgtgcctacctggcttgcagcattgggctctgccccccggcctctgttatttcgggaccctatcatccccattgctggcagcaagcccagcgctgtaacagcatctcctgccatcagcctgccctttggaatgctgggcggcaactccagggcttctctgtgatgctggtgccctcctcaccaggccatgacttagcacgccggtaaacggagtatgctctgggccctcctagggaacactgtggggggtggrttttctggcctctatagtctaaccagtttggcatgcccactgctctggacatcctgattccttccttcaccatttgctgtggcagttcttccaattctacctcacttaacgtgggtcaatacttttccaggcctctaagaggcaacctcttagaggttgtgatgtagtagtatgttggcgccatctcccggggtcctcgtcagggtgtaaattccgtaccgtaaaagaaagttctcccttttccaatttgtattttgtttcctttggttcagcaccctcaagatccagtcccgtacatattcccccagttcctgatggttcacattgaccaggcctacaactacttttttttcttagcaggtttgttttcttagcgggcccagcacttctgtggctgggttatgttctaacttgcccttagcttcgggtctgatggccaagagaggaggcagagctgaatcctgagcagagcacgagttttcttgcaagacacgatcctccacatgatcttcaaataagccggaggctctagcctctaacagagaggagtggatcacttctgcaggccctcttccccacttattaccggcagccttgcactcacaggaatgcctttcttcacaggcttccattccaaagatcttattatcgaaaccgcaaatatgtcgcataccaacgtctgagcccttttaattactgtcattgcctcctccctgacagctgtctacagcacccgaattattttctttgcactgttaggacaacctcacttcacggctgtaattgtcatcaacaaaaacaaccccttcctaatcaattcaatcaaatgcctaacaattggtagtayttttgctggatttttaatctccaacaatattattccaatatcagttccccaaatgactatgctccttcacctaaaactcacaaccctcagcgtaactattttaggcttctcactagcaatagaacttaaccttgtaactaacaacctcaaactcaagcacccatcacaaatatttaatttctccaatatattaggattttacccaatcacaatacaccacacaacaccacactcaaatttccatgcaagacaaaacctaacctctcttcnactagaactgatttgattagaaaaatcaacaccaaaaaatactgcccaggttcaaatgatagcctccaccattgtatctaaccagaaagatctaattatgctctactttttctccttccttatcccatctctcctaactctattcttaattatttaaccctattccctcacataatctcaatcacaataaagatactaacagagatcaaccagcaaccaccacccaccaacacccataactgcacaaggcagctacatccatagaatcctcacaaagtaattctatttccccaacctcaaaagtcacccagttttccatatttttaaaatcagttacaattcccacctcatcataatcaattaaccacataattatcaccaactctaacagcaaccctaatagtgaggcatcccaaataacaacactgaccctcaggtctcaggatactcctcagtagccattgccattgtataaccaaaaaccaccatcattccccctaaataaaattttaaaactattaaaccaggccaggcacrtggcccatgcctgtaatcccagcacttagggaggctgaggcgggcggatcatgaggtcaggagttcgagaccagcctgaccaacatggtgaaaccctgtctctaytaaaaatacaaaaattagccaggcatgatggcacgtgcctgtaatcccagttaykcgggagactgaggcaggaaaattgcttgaacccagagggtggaggttgcagtgagctgagatcgtgccactgcactccagcctgggcaacagagcaagactccatcacaaacaaaacaaaacaaaaaaactattaaacctacaaaagccccaccacaatttaacatagtackgcaacccacacctccactagtaattaatcccaagcctccataaataggagaaggctttgaagaaaatcccataaagcctataataagaataatacttaataagaatacagtgtatgtcataattcttacatgggatataaccataactaatgacatcaaaaatcattgttgtgcttcaactctaagaactctaatgactaacatccgaaaaacacattctctattattaaccactgtttattgagccacctgcacaatcaaacatctcggcatggtaaaatctcagcttgcttctaggtatctgcctggtccttcaaatcatcacagggttttcttarctatacactacatgtcagatactctgaccrccttctcttcagtcactcacttctgctgagatgtaaattattgctgaattataattatgctacatgctaatgaggcttcgatagtctgcatctgcctgtttttacatgtaggccgaggcttatactacgggtcatttactttcctagaaacttggaatattggcagtattcttctatttgcagttatagcaacagtattaataggctccgtactttcatgaagccaaatatcattctgagatgcaacagtaattacaaatctactgttagccatcccatatattggaactgaccttgtacagtgaatctgaggtggattctcattggataaagccactttcacataattcttcacttttcatttaatcttgcctttcattattacagccctagtagccattcacctgttattcctacatgaaaagggatctattaacccctcaggaatttcatcagattctgacaaaatcccttttcacccttattacacaattaaagatattctttattacacaattaaatatattacacaatttattacacaattaaagatattctttattacacaattaaatatattattcttattacacaattaaagatattaattctacttctcttgctcttatcaattctgctgacctcctaggagaccctcacaactacaccccagcaaaccccctcagcactccaccccacatcaaaccagagtggtactctttattcgcctacgcaattctacagtccatcccaaacaaactagggttttcttgcaagacaggatcctccatatgaccttcaaataagccagaggctctagcctttaccagagaggagtgggtcacttctgcaggcccacaggtccagcgggacctgatgattcaagattttttagtgcttggaccaagtgtccccatccaaagtctcagaatcttactgcttccaaatcagcaccctgacctacatatagcagaactggctggagttgagaattaagaattcaacaatttctggaactttgctattcatataagtccttagctgtacggcccttaggcaaccggagatgagattctatttatatacagccaagttctggcttcatacttcccctcacatggttaagtaaccaaccgaggcagtcattgtctttctccaatgcatgcatagcctccaacaacagtcatctaattccaaaattcttgtatttacttaatttcccctgaaactctcaacctcctatatgtgtcacttgccagcctatccccttctaccagtttcrtgtcccagtttgccacctgtaaacatgtgaacactggcactggcatggatgcctggggcaactagcgcttcacctatgatgggggctrgcgctctaccagtgatgggggccttattacagccagccaggtgcagcaacaacatcctattttagagtcagttcctaggaccacatccagtaccagctgtcacaggtggagttcactgggaaacacactckgagacaccgagatttctatacagaagttattggagagtaatcgcagaaatagcacctgtaagtgttgaaagacaaagaatttggcagatagaaaagtcgagctgagcctcagtgggtccatggagagctctggatctgggatggcccttctgagatattgcaaactgaggcatggtggacaagtcttggtacctcacaggaaccagtcattggatgtgcacggtccctagggagggagcttaatcttgggcagtgtctttctttggctaaaagcaacactgggaaagcagcacaggtgagaggtgccaggcagcggctccmccagcggctggagaatgagcagtgcctcagtcctggaggggaatccgggcagcacccacagcatccacaatgccctgcagcactgggagcagccctcacctttctgagactgtttcttgacctgcaaaataagggaacacagttggttcttgagcagtgtggcggctagggggcactcccaaaaaacctaagaacctattgttgaccagaagccttcccacagaaacagtcgattaacacatattttgtatgtggtgggtattatatcctgtatctttacaataaagtaagctagagaaaaggaaattataargaagaaaatatacatttacgctgggcacggtggctcacgtctgtaatcccagcactttgggaggccaaggcgggtggatcgcctgaggtcaggagttcgagaccagcctggccaacatggtgaaaccccatctctactaaacgtgcaaaaattagccaggtgtggtaagcgcctgtaatcccagctactcgtgaggctgaggcaggagaatcgcttgaacccgggaagcagaagttgcaatgagttgagatcayggcactgcactccagcctgggcaacagagactctgtctcaaaaaaaaaaaaaaaagaaaaaagaaaaaaatagaaaatatatatttaytattcattacatggaagtagatcatcataaaggtcttcatcttcatcatcttcacattgagtaggctgaggaggaggaagaggaagacgaggagttggtcttgctgtctcgaggtagtagaggtggaagaggtggaggaggtggaaggggaggcaggcgaggcaggcacactcggggtaacatttgttggaaaaartccgcacagcctaggcaacaatgcaaaacctctctataaacgatagaaaaattagctgggtgtggtggtgtgcacctgtagtcccagctactggagaggttgaggcaggaggatcacttcaacccggaaggtcaaggcttcagtaagccatgatcacgccactgcacaccagcgaaggtgacaaagggagatcctgtctcaaaaaaagaaaagagaaaaactccgtgtaaaagtagacccacacagttcaaactcatgttgttcaagagtcgactgaaatagctacctcaaagatgtccaaaaaagcaaatgcaaaaacaaatgcaagcaatttgtgaactgttaacaaggttattcttctcatcctaaagtctggagcaatctcatcaccatctttctattatgccccacacccacttctcgtctcaagaartcagtattttacttttctaccaggatttagctttactgtccactttactgcttctccaaaaagttgcagtgatgatgttgagaagtgactaattcattaggtatatctttatttttcaccataaattaatttctaaaataggctctataattaccaaaactcttctagtctataattgggggttctataaaacataaaattacaggatttatagttctttaaaatggaaaagtgctctcaaaaaatgttactagttcaaaggagattcataaatgaatcatgtaattttaarcaattctcactagatggagctagttacaaataaatactttttwaatatttttcttctttwtytttaattwtttatttttatttattttttattttttgaggaattaacagtctttattgggctcagatcaggaggccgtgggtcttgaggacctctgtgtatttgtcaattttcttctccacgttcttctcggcctgtttccgtagcctcatgagctgtttcttcttcccgtagtggatcttggctttctctttcctcttctcctccagggtggctgtccctgcctggtacttccagccaaactcgtgagccaggcgccccagataggcaaactttcttgtaggcttcagacgcacaaccttgagggcarcaggaaccaccatccgctttttcttgtcgtagggcggtgggatgccrtcaaacaccttgaggcggtccagagcggcctggcctcgcttggtcttgtgggkcagcatacctcgcacggtccgccagaagatgcggctgggggcccggaagtggtaggagcctcggtaagagttggtgttcatccgcttgcggaggaaagcgaggtacttcaacttgtttctgtagaaattgccagaaatgttgatgccttcrcagcgtacgaccaccaccttccggcccagcagtacctgtttaccacgatggccgccaggcggcccaggagatggcctcgaccatcaagcaccaggacctgcacctctgccgtcttcgccagccgcttgggaaaggcttttcttctctttaatacaggaatattttaattccttgtaaggaaaatttcctggataattccatgtattttaataatcacagagatagtcttattcttactcattcattaccaaaaataaagacttcagtaacaatttatactccatagagtatacgatctcatctattttgacatccaaaaaaaaaaaggcagaaagacaaaacgcaaattctgaggcagaaattaagaaaatataattcttattttttatttaatttattgtttgttccgctgtttgaatgtttatcttccaggagcctacagaagtgagggaaagtatctgcaggctaattttaaataacacgagacagagattaaacattaaatataaaaaaaaaaccttttagcttacttattaaactaggaagaattttccttaaacacatcactcaaattggtctgcaatgcatcaataaatggagaacatagatctcacctaggaaatattttatacattgtggacactacaaaaaagctcatcagaatataaaaattttcaagtcacaatcccctaagcagactaaaaacaagttagcgtttaacctgaaatcagaagtgcaaactctgtaaaaataaaaatattgccattgttctcagcaatctatgaataaatcctacaactccttaaagtcttttcaataaaatgaaccatgatctcttgacaaactccttgcttaaatggcaggtaacttttgaagctggacttctcaatctgtcaagagaagcaagctgcattggcagcattgctcgcttttgaaaatcaccttctgaacagaaggtccagcaaagaccttcaatgcaacactccctgtatatgtgcaagtctgcatgagacgtcctcccgcaggtgcaactcccagccaatgaaccagaaacagatgaaagacaaaaggggaaagtcgaggtcaaatgtttcagtttacccatgctatcccagataaaatgccaagggcttttggaataaaatggacaatatgcaaagatgaggtgaccagatgtcaataatgttgggaatttaaaatgcatgtaccacacatgaacacaattctttaaatgcagctgcaggaagttccgtttgggggtcatcctctttgaaactcccttctgggcagtactgcttgtcatttctatcatctgatacatctatacttccaaataatcctaactgatactcaaagtgatgccttgacaccctctgaggttctacaggmtcttccaaatcaaagagaggtcacatcatgcatagtattatttgggggttagcatacgttttrtaataattatgttaaaattggtaatccctttttgrgttcaatgatagctctattaattatattgtcttgttaactgaaatattccactctgtcaatgggattaatggttggagattatgatacaaccaaaaccaaagctgggcaatgggctcttggamtggaatyacccattatgaactatccatctgaccaactctttaactttcttcctaaacgtcagatcaccagggcgtttcagtgcagcctgcacaattcagagagtagggtccagattaaagaccttacatttttgtagaattcagaatcatttttcattcagcaagccctctatttgctcactctcttctacatgtaattgttcaactttggttgactgtcgagtcctcatggaagaattcccattctgccactgagcctctctgttagggacttgaaaatggaaggtagtgcagttctttctgaccatctgccaggcaaggagcccmgggcttctaggggtaagttcgtcccttttcccaagtctttcactttgcactcttcattcagagttaaatggcataaaactcggattttcaaagccagttgatttaatctgagacacataagactaggatcaaataagtgaagtaaatgattcaaatgcaatgacttctgttgttgcattctgttgttgcatagaagaatctaaaattcttctatggcctaattttcagaaactattttaggacaaaaaagaaccaaaaaaaagttctactaaaaaaaataaagagacagactagtaatttgcttggtcagagcttctttttaaaaaaataaaataatattaagtcaaagaggaaaacaaatataacatcaaactatttgcaaaataatgaaaattggctgggggcagtggcttactttgggaggctgaggcaggtgaatcacctgagacaagagttcaagaccggcctaggcaacatagtaggacctcatctctacaaaaaatacaaaaaattcatgggacatggtggtacacacctgtagtcccagctactaaagaggctgaggtggaaagaccacttgagcctgggaagttgaggctgcagtgagcaatgagtatgccactgcagtccagccatgtctcaaaaacatcacaataataatgaaaatgagaacaatgcatagaaaacttagtttaggggttgtacaagctacagcgtaactcataaccttaaatgtttttcttcttagaaaaaatctaactcttcaactcaaaaaattagaatagctaaaacgaatctaagaaaagagaaaaggaaaataaatttaaagaaaataaaaacagtaaaaatgataaacccaatagcagatgttttgggggggaatacaaatgaaataagcatctttctgtcaaattcattctacaatacacacacacacacacacacacacacacacacacacgaaaaaaaaaaccatacaacagtctggaaatttttaatgataaaataacaattattcgtatatgcagataaaacagaaatctcagtaaactagatgattaacataaagatataatggccaaaattgactcaacaagttgaaaacctaaaacttatggtgaaagaagaaartatttaagttatcaaagaaatatttgttagacatttcccaggctcagatagttttactgtttaattattttaaactttccatagctagacaaaaatacacaaaaatatgaagactaatttatgggccaaatattgtttatgcagcagaactcatctacatcacataattccctctttcttccatttattcttagaagtctgcctctaacctgcctctgatagaacacttgattggatttttcatttctttgcctcttagaatattaaaatgtttttttctggccagctccacaaaactctgattttgatgaaattttgccttctctcatattttttagtgacaggccacccaactcttaaacatttgattgcattctggaaagctctgtggctctgagagaccatgagatctccttccttacttcctccctccctcctttccttcttccctccctcccttctttccttccttccttctttctttctctctctctcctttctttcttctctttctttccttctttctttctttccttccttccttccttgcttctttctttctttctttctttctttctytctytctctctctctctctytctttctttctttctttctttctttttctttcctgacagagtctcatcctattgcccaggctggagtgcagtggcccaatcacagctcactgcagtctcaacctcctgggctgaaacaatcctccctcctcagcctcctgagtagctgggactacaggcatgcaccacaccctgctaattttttttgtattttttttagagatggggttttgcaatgttgcccaggctgaaagatcatatttcttaaagtcattctactaactagtccttccagttattacaaattataaatctgcaataattaaaatggagtcatattgacaagaatagctttcagtgaaatagaatagagagcacagaaagtcacaagattttaaaacaactcaacatataataattaccaatcaacaggaaagaakgaaattgttctatttattgcataaatagcattgtagaaattggcttgctatttggtgataaaataaataataagtcrrgtayggtggtgcacgcttgtattcccagctactcggtagctgaggcaggaggatcgcttgagcctaggaattcaaggctgtagtgcaccatgatcacacctgtgaatagtcgctgcagtcyagcctagacaatatagtaagactctgtctctaaagataaataaataaatcccagmygaattagagatccaaatataaaataaaaccaaaaactatatcatragcatttatcttctcttcaaatgaaagcacgttccaagcttaaacacaaaagaagataccataatccactgaactgcataaaaatttaaaacacctacatataatcatgacaccaaaaagcaacaaccaattggaaaacaatatttataacaaacatgacaaatgattaatgccttttatatataaacagcttatgcaaatcactaagaaaaacactaagaccccaatagaaagttgagcaaattatatgtaaagaggtttcccagaagaggaaatataaaaagaaacatgaaaaaaaaatwaacctcaataggaaacaaataaaagcaaaacttttaaatggcaaaatgccctactttttctatgaaattataaaggttacaaatataaatactcaatggtaaygaaggtacaatactataaacattctcacatactacttttttttctttctttctttctttttttgagacagggtcttgctgtgtcacccaggcacaatcacagctaactgcagccttgacctcccacctcagcctcccaagtagctaggactgtagatgtgtgccacyacgcctggctaatttttttattttttgtatagatgtggcctcactatgttgcccaggctggtcttgaactcctgggctctagcaatcctcttcccttggcttcgcaaagtgctgggattacaggcatgactataatagacatacttctataagagttaattagtataacatttctggaaagccttttaacactatcaagcatgtttaaatactctaccttttaacccagtttatctatgtattactaatatattgctacataataaagaaccctaatatttagcaatttaaatattttaaagaaccataacatttattatctcacatagtttctactagacaggaatctgggagcatcttggcctagacrgttctggctcagggtttttcatgaggtttcattccacctggtggccagggcttcggcggtctgaaggcttagccagggctggaagatctactcccaagkcagctcattcacatagtagttggcggaggcctcaggtcctcaccacatggacctctccagaggaatgctgaagtcttctgccagaacaagtgaaccagcacagagagatcaaggagaaagccacaatggcyggccgcagaaatcacacttcatcatttttgcaatatcatactggtatyacaaaaaasctccgttcagtgggaagtgggaataggggtgggctcaggtggtggtacttacacaacagcagtaataacagaaaaggggaccatattgttrgaggctggtcaacagaatctctttgtaggaatctaatttaaccaaataatctgaaatgcagataaaactttatgcattaagatattcattataataatatttgtaatagtaataatttgtaaacaatactcagtaatggagctggttaagtaaatcatggcacatctctccaatattcaattgtattctatattgcctcttatacaatcacatcaaaaatacatgtcattttcatatttccatatatacttatatgtgtagaaaaaggatgagaagaaaatggactaaatattaatgactactacctctgggtgatggaataattacttattatttacttttcatgcttttctccatttttaaacttttctaaaataggtgtatattacatagataattagaaataattctttcaaggaattataaataccgttgagacattgtgcctatagtctaatggtaagaagaaagaaaacaacagaaaaactcactgatcttgggagagtgttaccaaaattatttcatttttcagtccaacaaattgcaaagtcattktgaagaaggtgtaacctattaatctgtatgtattatgtacacgagttaaaaaacagaatgacagttgggcgcggtggctcatgcctgtaatcccagcgctttgggaggccaaggcaggtgggtcactcgaagttgggagttcgagaccagcctggccaacatggcaaaaccccgtttctaccaaaaaccacaaaaattaggtgggtatattggcacatgcctataggcccagctattcaagaagccgagcgtgagaatcacttgaacccaagaggcagaggttgcagtgagccgagattgacccactgcactgctgcctgggcgacagaacaagactctgtctcagaaaaaaaaaaaacagaatgacaacagatattttcagagtatcttgtagtttacaaagcacattcacatagttattygcttgataaatcagagtacttctgcaattaacactcttgccagctatttatgtcactcaagatgtttgaaaaatgccttttgtgaattgtaactgaatggagccaaattcttctggggcatatggctgtacaacattcactgggaaaggcaactaattgcatgtgtgtacacctcagggaagaatttgtttaagataactgaaatatgtttgagttgaatcttttcctactccagctaatggtcatcactttaactgtgttctttccaaagctttattaaacacgctatgaaaatactgagcttgagcctgctgatgggaagcaaataatctcccccttctttaaaggcgcattcattctttcaggtcagtagcatcacattgcaagatcctgaaaatcagtgcgcagttgagtcagaaagcttataattgaatttgcttagctaagtatcttagcaactcagttcacgtcagcggaactttgttgaagggtrtattttcatcatttcttgccagatttttaaagcatgacatgttgtgttactaaaactaagtaattcttccagggggaggaagcagtagtgtctattatataccttccactttacttatttargaaaacataaaaagccattaccgggagaatagaatgcattgttctgaatctaaatgacaaagcaatctttgtttgtttgtttgtttgtttgtttgttttgagacagagttttgctcttgttgcccaggctggagtgcaatggcacgatctgggctcactgcaacctcagcttcctgggttcaagcgattcgccgacctcagtacctgggattacaggcagcygccaccacgccccgctaatttttgtatttttagtagagacggggtttcaccaygttggccaggctggtcttgaactcctgacgtcaggtaatccgcccaccttggcctcccaaagtgctggatttataggcatgagccactgcgcccagcccaaagcaatcttttagaagttgtataatcaagaaaaagaagaaaatcgggggtttttttttagggattcggggtatgcttatgagcacaggaataaaggaaaaaggcagtaatctaagttgcatatataatgcctataaaacaaaaggcaccgtttgacaaggtrtctggctgatataatgggaaaaccaagaattcaggcttcaaaggaggttttttaatgcttaaatgatgtggtttgtctgatttaattatataatcagcagctttccccctttatgttaaaaagtgaccaggtaccacagtatggcctagaaagcactatccatatacatcagaatatgcccggcggggttccattggtgtgaccctctgaccagctgccaacctgctgtcatgtgcttcatatttctttcagaccattgcggtagatggcaaagaataaatggccacaaattatttgtagcaatttccaccaggatatgaactctacttccccaccccttgaacccagactggccttgtgacttgctttggataatgggacattagcaaacgagatgcaagcagaggcctgaaaaacatttatgcaatggggcttgtcctctcttgccccttttggaaatcagctgccacgyggggcagagatttttcttccacttcaataacccttgacttcaaccttccaggtaaaactattggkttaatttaagcttcttttttttttttttttttttttttttttttaagaaacagagtcttgctctgtcacccagttcagtggtgcaatcctggctcactgcagccagaactcctggtctcaagcaatcctcccgcccccacctatcccatgttgggattacaggtgtgagccactgcacctggccaaatgttgtttttgatagctatttggcagatatttatatttacttgacaaagaactaagcaaggagattgatgaaagtcatgaaaatgaatacatttctgtctatgtcttgcaggaaaataaagtcaaaaagaaggcataaccttatatataatagggtcctaacttataaataggttatattgtaacagttatctgtaagtcagttgtctggatcttagaacatgtatccacayatctataacrgtatctggcacatagctggtgctcaaaaaatagttcttgaataaatgaatgaacaaatggaaagtgcaaatggctgttatattccctgacaacgagaagaaactgaatatgctttgtgatggttagttttatatgtcagattggygaagtcatagtacccagtttattcaattaaacacaaakctaggtgaaggtattcyrtagatatggttaasagctacacttaattgactttaaataaaagagataatctttcataacttaggtgggcttcatccaaccaggtttaaattttttctcaaagtaaaaaatatttttaaaggagggtaaatggctgggcacagtggctcacacctgtaatcctagcactttgggaggccaaggcaggaggcttgcttgtgtccgggtgttcaagaccagcccaggcaacataatgagaccctgtctctataaaaaattaaaatatcagccaggtgtggtagcatgtgcctgtggtcccrgctacttgagaggctgaggcaggaggatcatttgagccttggagtttaagggtgaaacaagccagaatcgcaccattgcacaccagcctgggtgacacagcaagatcttgtctctaaaaaggttttttaaaagaaggagggtaaatggagtgaaagtgtttaaagccctcacattgtccagaaactggtgacaatacttayattacaattgtaattaagcaaggatttgtattataatctctggkgtaaccattaaaagagtagtaaaacaatgaataacaagctactggcagggacatgggggatagaataattttaaaaactactccaaataaaggcaagaaaagtgaggaaaagtgagcatacaaaacagatgggataaaatagaaacaaatagtaagatggcagacaaayccaaatatgtctgtttacactcaatgtaaacagattaatcaaatgagaatagttgtcagactggaattttaaatgattctattttgataccgatagtaagacattatttgccttcttcactcttgacaagtgcactcatggtggggaaagtaatggtgggataaactgctggcaccttagcccaagtcaaggtggtagcaccagatgtattaataaccattttacttgtcaacaccagagactcacacacacaaaaaaagtcaatttcacttaagacggtccttgatgggccgggcgcagtagctcacgcctgtaatcccagcactttaggaggctgaggcgggcagacgacttgaggccaggagtacgagaccagtttggccaacatagtgaaaccccacctctactaaagatacaaaaattagccgggtatagtggcacactcctgtgatcccagctactagggagactgaggcaggagaattgtttgaacccrggaggcgaaggttgcagtgagctgagatcgaatcactgcactccagcctgggcgaccgagaaagactgtgtctcaaaaaaaaaaaaaaaaagtccttgatgaagcattaaacattaattttatcaatctcaagtacagttatttttagtacataaagaatttcagcagtcttctcctactgccctgtcttcatatacaaattgcctcttgagaattctaataaatggtcaattcattttagcctgaatggtacaaggaacagggaaggtattcttacagtagagtttaacgtggggtcacctacccctactgtcctcttagtaccctgatcagcctctcggtacccccagagaacagatgcttacttccatgcaaggaaaatggtgtcacctttgaccatgttagttgttaaaggcaatttttcaacaacattctaatatcttagaaaatatttggctaacaaagcgggatatttcataaaagttataaatcagataatactaaagagttaggagttctggctgggcacagttgctcaggcctgtaatcccagcacattgggaggtcggggtgggaggtcgagagttcgagacgagcctgaccaacatggagaaaccccgtctctactaaaaatacaaaattagctgggcatggcggtgaatgcctgtaatctcagccactcaggaggctgaggcgggagaatcgcttgaactcgggaggcggaggttgcagtgagttgagatcacaccattgcactacagcctgggcaacaagagcaaaactccatctcaaaaaaaaaaaaaaaaaaaaaaaamcaaagagtcaggagctctccatgtttaagataatcaaatccacattttatggttgtatacattttatttaaccacacaatgagcacacaaaaattaataaactactatggctcactccacaatttacacatttacacatatacatatattttaacacactccctaaatttattttcagaaagtgtaatgtgtacctcaccaatgctaagaatggtgaaaaatgcaattagatttacaacaactgcccttgagaagcttagagagagtgttgtgcctttcccgtacactaagaacttttgctctgtgactaagaaggaaactgaataagaatatgcctcatcctctttgcttttctagccaagatgcctggtggcaaggaagaaccagcatgttatagaaaaagaggagccgggagtggtggctcactcctgtaatccaaagcactttggtaggccgaggcagtgggccccatgtctactaaaaatacaaaaattatctaggcggggtggcaggcacctactcgggaggctgaggcaggagaatcacctgaacccaagaggtggaggttgcagtgagccaggatcaccctagtgcactccagcctggatgacagagcaagaatccgtctcaagaaaaaaaaaaaaatagagccgagaataaaagggttgaccctctgtttagactgacatgatgtgaaaatgcctgccatgtttaatattagtcacaaagactcaaagagccaaaatattatccgatggtctctaaggtcatatttttgaagagaataatttctgacgaagttgcatttcttaaattccaactagttaccattaccagggatgttcagggtaaaaacctgctgaccagcttctctggtagatcttatgcaaacaaagtgtgttccaccatcaaaaagagacggattcaaatgcatacattgatatcaaacaagcagtttgcattgtttatattgtgtcggatttgccaaaaagcacaaggtttctaaagcctctgaaggctggtgtcatccatcggtatccagtaggtgctcccaatttggaaaatgatgggaatcatgtcacaggaggtattttttaaatgacttctataactagtcaataaacttgtcaatgacatagaaaaatctattcaatctacttaacatgttagaaaagtaaaaaggctgggaaagcccaagtttgaaaccttctgaggaataaaaagcatgcctactctagcagaaggagatggatttaagctaccaacccaagaattttaaaaatggaacttttaggctgggcgcggtggctcacgcctgtaatcccagcactttgggaggccaaagtggaatgatcacttgagctcaggagtttgagaccagcctgggcaacatagcaagacctcatctctagtaaaactaaaaaaaaaaaaaattagccaggcgtggtggtgcgggcctgtagtcccagctacttggagggctgaggcgagaggatggcttgagcctgggagatcgaggctgcagtgagccctgattgtgccactgcactccagccagggtgacagagccagaccttgtctcaaaaaaataaatactgacaaagaagaattcttatggaggggtgtgtgtgtgtgaatgagtggttaagaggatacgacatataacactgtttaaatactaaataaaattgtcctcacagaatgtactatcttcacatacactttctcttctcttcgttttcttgtttctaatttctttgccaaatgctagccaatatttgtttaaatttttccttcatagatatacatcaacaataaaacttttatttaaaatttttaatcagtatatacacagtcttacatttatatgccagtagaaaaggatggtggaagccaaatcaggaataaatgagaaaatagcagtgaccaaaaacaaaacctcattttataataaaaagccgatcagtcacataatgccagtgatagcagtcactgaagccttactgtgtgccaggcaccgtccagcattttcatgtgctgtcacacttgtggcttatgacacacctaagtgtgtcagttgggtcctctgaaagcagatggagctaggagtacaagaggttaaccgtgggacagcactggtgaaagataaaagtcagaaaaagcaaggctgggcagggaaattcttcagaccgtgctgcagatctgacacctattaaaggaaagcggggaagtgggtttgggcagggagagtctcagaccgcgctgcagacctgacaaagcctgggccaatctgatcagcaactctggacaagagctggccagtagaggaggctcatcttaggctgcagtgcccaagcccggaagccactgagctcagtcactagctgggggctaccttaggagatcaaggtctcacctccgaaggtgagacctcgttccaaaggtgctaatggctgaaggcatctgctgactgcgctccttaacggctgaacagcgagccctttcttgaagggaaatctgagtgccgctcctccatggctacctcagtaagggaggctttattatgattcccatttttcggaaagaaaaagggggcacaaaagttatgtaaatttcccaaagtcacacagctagtaaaaagctaataaatgtctcctatttgccttgcagctgatagtaaaagtaactttttttttcttttctttttttttaagatggagtttcactcttatttcccaggctggagagcagtggcacgatctcagctcgctgcaacctccgcctcctgggttcaagtgattctcctgcctcaacctcccgagtagctgggattacaggcgcccaccaccacgcccagttaatttttgtatatttagtagagacggagtttcaccctgttggccaggctggtctcaaactcctgatctcaggtgattcgcccacctcggcctcccaaagtgttgggattacaggcgtaagccaccgcgcccagcctccctaacacattagtgtatggacttccactcactcctctctagtgtattttggtttttttcaaaaaataggataattccttaaatattaccttagaactggtttttcttcacttgatatcataaacatcttttcacatcaataagttcatttctacaaatgtgtacatacaactctagcacaatttattcaagtaatacgctactgaacccttcagttttttctcttcctttttttctatatgagaaacaatttagtgaacatccttgtagctaaatctttgtttgcaatattctgagataaaatgcataaaacccaaaatttaacattttaaccacgttcaagtgtacagttcagtgttttgtgtatactcataaggttgtacaaacatcaccactaattccagaacgttgccatctccccataaagaaactccatacctattagcagtcgttcccaattcctccctacccccattgcctggcaaccactaatctagtttccgtctctatggatttgcctattccggacatttcatataaatgggatcatatyacatttgttcttttgtgtctggcttgtttcacttagtatatagtatttccaagatgcatccatgttgtagcatatatcagtgcttcattcctttttggctgaactattttttatgcctgaattagtattccactctttggatgtactaccacattttgtttatctattcatcagttgatggacattgggttgtttctaccttttggctgttgtgaatagtgatgctgtgaacatttttggaygagttttgatgtgggcatatgtcttcagttctcttgggtatacagctagaagtggaattgcaggttcaatctacgtttaacattttgaggaaccaccaaacttttccacagcagctgtgccattttccattcctaccagcaatgcattagggttctaatttccatctgtgccaatacttattttccttttccttattattattgccattcaattaggtgtggttctgatttgcatttcttcaataactaatgaaggtgagcatcttttcatgtgcttattggccatttatatatcttcattgaagaaatggctatttaaatcctctgcccaacttttttcttttcttttcttttttttgagatggagtctcgctctgttgcccaggctagagtgcaatggtgcaatctcagctcactacaacctctgcctcctaggttcaagcattctcctgcctcagcctcccaagtagctgggattataggcatgcacaaccatgctcggctaatttttgtatttttagtagagatggggtttcaccatgttggtcaggatggtctcgaactcctgacctcaagtgatctgcctgcctcagcctcccaaagtgctggattacaggcatgagccaccttgcctggcctttttttcttttttttgagatggagcctcactctgtcacccaggctgtagtgcagtggtgcaatcttggctccctgcaacctctctctcccagattcaagggattctcctgactcagcctcttgagaagctgggattacaggcatgcacaaccacatccagctaattttttttgtattttttttagtaggtacggggtttcaccatgttgaccagactagtctgaactcctgacctcaaatgatctgcccgctcagcctcccaaagtacagggattacaggcatgagccaccatgctcagccctttgcccaatttttaattggattgtttgtcttttcattgttgacatatgaaagttatttatatattctggatagtatgcccttatcacagaaacaatttacaaatattttctcccatcctataagttgtgttttcactttttctttttttctttttttttttttttttaccttttcttaaatagagttggggtcttactatgttacctaggctagtctcaaactctcaaactcctggactccagcaatcctcctaccttggcctcccaaaatgttgggatttcagctgtgagccaccaggcccggcccttcactttcttgatagtgtcctttatacacaaaagtttttaattttgatgaagcccaatttatctttttttcttttgttatttgtacttttggtgtcatatttaagaaactgttacctaatccaaggtcataaatatttatacctatgttcccttcaagagttttatgagctcttacatttaggtctttgatccattttgagtaaattttttttatatcatgtgatacttcaagtatctactttggatagattcctaaaaagtgggcatataatgcttcaggagtggttttgatttgggtttttttttttttaagagacaaagtctcaagtcttgctgcatctccaaggctggagtgcagtggcacgatcatagttcactgcagcctagaaatcctgaactcaagcaatcctcccacctcaacctcccaagtagctagaactacaggtgcatgccactatgttcaactacgtttttttattttttgtagagacagggtcttgctatgttgtccaggctggtctcaaactcctggcctcaagaaatcctcccactttagcctcccaaagtgctgggattacaggtgtgagccaccacaccaggcccagttttaaacacagaagctgaatttctaattccagtcacagttccatcatcaatgaggacaaaagaagtaagagtgcatgtatttaacaaaacattatatttttctttgtaagcaaatgactaaaattaacaagaaattactggataactgcctcactcatttgccatcactttttccaactgctgctcctactgtcttaattacttttgtctggtgctttgcagaactgtcactgcgaggattcattttggaccttaactgtcagatcactttagccaggtttcatctcctgctaaagattccacatgaagagatggcataaaggagctggtgggtacaaggctcttcacagacatgcaaacctggagaaaccatctgtggccagcattccttgttcatctaagaaaatacatgttcctttataatctagttttccaaacatggatcacctcctcttcccctaaattttctttccttgtagctacacaaatgaaaccactcaagttcccatctcttctccctgccagtgttgcatcgggctgataatgctggacgggagaaaacaaacctctttgactcttccgccatctactgacatggaaaactgcctatgcggcagtgaaacataaagaactaccggaaaagaggaggacctagatgctgagccctgatatggaagacaaaagaccaaggttgttactgaactgggggatggggatggagagctggatttacaagtgatgtctttttaaaaaaaaaaaatatcttaggctgggtgcagtagctcacacctgtaatcccagcactttgggaggctgaggtgggcagatcacttgaggtcttctagtacttggcaacatctattactgcactgctaagttatggaatcacatttgttttccctgaaataagttttcttggcttctccatccactgataatctctcccacaatattgtgacttgattctgttccaggtgaaccttttcctagtatttcttgtattctttattatctgtcatgttagggcagctgtggagcttcatttttacaactgctgaatctaaatttaactgctgattttctaccatccattttcaaccttctttaaaaagcctggtgagtaactttatctgtcatggcccatttcaatgccctcaatagtaaaaccggcgaatgtggagacccatccttaatgaagagaccagtttggtcattcttactattttccatggattttcaacatgattaagaaaaaataatttgaggctgagaattgtagttacccaactgaatggaaggcaaaggaagaaactagacgctcccaggtaactgcccagtttttgtatttgtttttcctttccaccaatgacaaggtatgctcaataactttactcccgaaggaggatatcccattctgaaaaacacaccactgtatgcgataaaggcagggggaggaaacattacactgtgggagagggaacaaacgtttgatcagcgtgtaacagaaaacagttctggcaactattatttcttcttctccctcaaatccaggaaaggtccataggccattttctgtaatatttcaccaaccaaaatgatctcttggacttgaaaataaacgcccccatttccaaccctccatcactctaaaattattagtgatcttcaggtacttgaaaaagtaaacttctggccaggcgcagtggctcatgcctgtgatcccaacattttggaaggccgaggcaggcggatcacttgaggtcaggagtttgagaccacccttgccaacatggtagaacgccatctctactaaaagtacaaaaattagccaagtgtggtggtgcacacctgtagtgccagctgcttgggaggctgaggcaggagaatcgcttgaacccgggaggcggaggttgtagtgagctgagatcgtaccactgcactgtgacagagcaggctccatctcaaaaaaaaaaagtaaactaaacttcttattgaaatgtaatgcacagagaagtatgcagctctctccaaaccttttttatctctttccaattatttttttaaaaaagtatatgtgccccagcatgcttccttgttatgaactgtgcacaggtaggactctgctaatattatgtaaattataaaacatatacaaacaggacaggagagaaaatgaggaaaaatcaacagaaataggagttctaatttttactttgcacacttcaatgggccagtcttacatataactttagaaatcacagctttaaagacagtggcaacacgctgcattcacaaccaggttgactggaggctttaggaaaggtttggtagcttctggcctcaatggtatgacatcaactcaatctccaaaaatacactggacagaaatccagctgtcctaaaagtttagaaatgtggccaccatgtctgtgatatccaagggttgcaaatcacattgcatgtctttatccgcaacggcagtcttctaggaaaatggcatttggggaaggaagaaggtggatacaaatataccttcttcctcctttgtgataatataaaattaattacagaaaaagtaagggttggctcttagctgttattaaagattaaaattatcttggtcaaagggaaatagaaattaggttctccaaacttttaaaacgtgtttctaaggtttacagttgaggtgaaataattgcttagctgactgtggatgaagcaatgaaataactccagttttaactcactgggtaaccattaggtaagcttctgcatctataaaaactgtgttaaactggatgtgcctacaacactgagtatgacgtgtaactagcaccacctagtggacattcatatggcaatacgcgataaaggaagctgcatggccaggatggaaaagttgctggtcacagtagcagcaaagggcttagctagttcttcctggcagcctcctcartaattcatagtttactgggaatcatatatcaaatagttttagctcttcagaagaaaatgaaatttataattaactgcattgcccgggtgcagtggctcacacctgtaatcccagcactttgggaggccgaggcaggtggatcacaaggtcaggagttcgagaccaccctgaccaacatggtgcaaccccgtcaaatacaaaaattagctgggcatggtggcacacgcctgtaatcccagctactcaggagaccgasgcaggagaatggcttgaacctgggaggtggaggttgcagtgagcygagatcgtgccattgcactccagcctgggtgagagactctgtctcaaaaaaaaaattaactgcattatgacagacttttttccttttagcaattgaaactggcatcccaaggatgctctagatacagtcataaagataatgcttactgcatctctcatcactggcttacttggaaaagaacaaaaaaaaaaaagttataaagaaaatctgcctggaccaggggtgatagctcacatctgtaatctccgcactttgggaggccaagacaggaggaaggcctgaggccaggagtttgaggccagcctggccaatatagcgagaccccagctctattagaaagaagaagaagaagaagaaaatctgcctgataaagagctaaagaagcagcctcaagctgctagagccacaagcgcccctggaactgtgcacttaaatagcattgtctttagcactagcataactgggcaaaaggagcaccatctctgtaacctataacttgaatggtgcttgcccccttggagttgttcaaggagtctagactggccaaagcaggcaaccggcctggcttcaataactatgcttggaactttgggccttgaggctaagaggtgtgttgtactatttcagcatgttttatgaattggttccacagagctgttacagcacagccaaattttactcttcaaaaaccatcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttgaggagattttgggctgagacaatggggttttctaggtatacaatcatgtcatctgccaacagggacaatttgacttcctcttttcctaattgaataccctttatttccttctcctgcctgattgccctggccagaacttccagcactatgttgaataggagtggtgagagagggcatccctgttttgcgcccgttttcaaagggaatgcttccagtttttgtgcattcagtatgatattggctgtgggtttgtcatagatagctcttattattttgagatacgtcccatcaatacctaatttattgagaatttttagcatgaagggttgctgaattttgtcaaaggccttttctgcatctattgagataatcatgtgatttttgtctttggttctgtttatatgctggattacatttgaagtcagtgtggcgattcctcagggatctagaactagaaataccatttgacccagccatcccattactgggtatatacccaaaggattataaatcatgctgctataaagacacatgcacatgtatgtttattgcggcactattcacagtagcaaagacttgaaaccaacctaaatgtccaacaacgatagactgcattcagaaaatgtggcacatatacaccatggaatactacgcagccataaaaactgatgagttcatgttctttgtagggacatggatgaaactggaaaccatcattctcagcaaactatcgcaaggacaaaaaaccaaacaccgcatgttctcactcataggtgggaattgaacgatgagaaaacatggacacaggaaggggaacatcacacactggggactgttgtggggtggggggaatggggagggatagcattaggagatatatctaatgctaaatgacgagttaatgggtgcagcacaccaacatggcacatgtatacatatgcaacaaacttgcacgttgtgcacacgtaccctaaaacttaaagtataataataataaaatttttaaaaaatcatccttgggtaggcctacccgaaacaaattaacacaggaacagaaaaccaaataccacatatactcattcataagtggaagctaaaccatgggtactcatggacataaaaagatggcaacaacagacagtggggactactggaagggggaaggtgacaagggttgaaaaactgttaggtactgtgcttactatctgagtgacattcacaccccaaacctcagcatcacgcaatagagcccagtaacaaacctgcacatgtactccctgaatctaatataatcattccttcaaaaaatcatcctgagagcctatcttggccaccctctggatttcaacatactttttgtgcagcttaattatatctggcatagcttcatgccctctctacaatttcccaatcctgggattcatgtgctgccaaagcataataatcttgtagtgaatacatattctcctttaagcactgaaacctaagaaagctttgagcttttttatgggggcagaggggtggttgttgatgtgaactgtttaagacctttcctgtgttcatcataactacagatcaaaaaagttttcattcttagcatatccaattagacttcattcctaaagattaaagaacaaatgagggaacaagtttatcattaggtgcttatcactgtgcacctattataggccaggccctctatgatcctcattttgctcttactacagctgtgtttggtattatttcctccacttacaaaggaaatgagctcagagaaaaattatcaaagatcataaagccagtaagtagcaaaaccaggatttaaattcaagtctcctgactctaattccattgtttattcatctatgccctggtgatattaactaataagctcacgtgccaaacataacccttacccccatccactacatacttatttctgaatagaaaataaaagtcacacacaattaaatgacaagaaaaaagccccacaatcttagtatgctacgattctcaaaaaggacttcacgattctagccacacgatttctcaagcatcaagggactacttagaacacttagtagggccttgtacgtaggtgctcaatgaaaggttgttttaaaagtctcacagtattaccccacagattattttgttcatttacaaaagaaaagatatatactttaaaatggaaaaagatctggcgatcttaacccagcgattaatcttagcatcaccaacagtgggacaacctgacattgtgtgcttcttgacatgatgcagtaacagaggcaccacacaatctatgctatatccttgccaaaagtaaaatccacatctactaagaaaacaaccaaacctggacaacatagtgagaccccatccctaccaaaaaagaagwtagccaggcatggtggcacaggcctgtagtcccagatactcaggaggctgaggcaagagaattgcttgagcccaggcattcagggttacagtaagctataatcatgccactgcactccagcctgggaaaagagggatattctgtctcaaaataaaaaataataataataaaacatagccagaaaaatccaggataggggatattttacaagacaattggcttagacacttcaaaatgttcattgccatgggcagaaaaagcagaggactattctagattaaaagaggaaagatataaccaaaagtatgcctgaaccttggactagaccccggatgaggagaaaatgttttaaaagacactttgggatgatagggacaatttattccatacagatctatcatattggatattgagttattcttaatcagctcagatatggcaatgacattatggctagggaggagaatattcttattcctagatgaatgtgtatttaggggtgaagtatcatggtgttacaatttactttcaaatgattcagcaaaagaaattagataaagcacatatggtaaaatgttgcatttgtggatctaggtgaaagttatactattatactattctttcaacttttctgtgtacttaaaatttcttcaaagtattttttaacattcttgaataaaattcaagacagttgggataaattcaactcttctaagaatatgatttctgaaaataccaggttgtaagcaatcaatcaatataaatatttattgtgaccctgctattaatatatcctaatcaacccctctgggagctgtagtggtgactaaacagtgcttcatgctctcttggaacccatgtagcatgttattttgtacgtgtgtgtgttggaagaaagaggaattattctggaatgcttccccaagtaatgcctcagcttaaacctgaaggataaataagtaggtgttgcctagttataggatggtagggaaacgggtcagagaaaacaaacaggtgtgaaggcactaatgatggagttggccaatctggagagtgagaatatttactcctactgcttcctccaggcccccactctttttagatagcctgttggtctcctggttccattaaccaactccctctattcaatcttcagacccaggagtagtagtaacaggactccaatgttactagtcccaagaactaaactcaccctgaggtttccctataccctacatacaactttgtaaaggtccttttattaaactttcctcaaattatccaatttcagtaagccatctatttcctgccagcaggactgataaaaatctctagagacagatatgggagatgtctgcatatttcatatggtatctgggaccatggaatggagataatctaggaagaaggctgaagatgaagcctgggccagtgagcatctgaggtccaaggaaaacctagaaagtgtgttttcaaccaagagtatttcaagaaagaaactgtcaatcgtattaagtactgtggagaggctgggtaaataagataaaggctttggaatgtctcatgaagaagccatcagtgacagatcaacattgaagagatttgtaaagttaattggaggccaagtatacacttacttgaggggaaaaaaaaaaaaaaaaacagtatggccaggcatggtgggtcacaccagtaatcccagcactttgggaggctgaggcgagcagatcacttgaggtcaggagttcgagaccagcctggcaaacatggcgaaaccctgtctctaccaaaaaatacaaaaattagccaggcatggtggcacatgcctgtaatcccagctactcgggaggctgaggkgggamaatcccttgaacccaggaggcagaggttgcrgtgagcygagattgagccactgctctctagcctgggctacacagtgagactctgtctcaaaaaaaaaaaaaaaaaaaagaaaaggaaaggaaaaaaaaaaaaagtataatttttcaggtttctattttaactctaccaggaacttactaaataatttgagattttttagttttaattattttgagatttaaatataaatgtaagcaaaaacaatccttctcttttatttgcaaaaagccaatactggctgggcgtggtggctcacgtctataatcccagcactttgggaggctgaggcaagtgggtcacctgaggttagaagttcaagaccagcctggccaacatggtgaaaccctatctctactaaaaatataaaattggctgggcgtggtggcaggcgcctgtaatcccagctactcgggaggctgaggcaggaggatcgcttgaacccaggaggcggaggttgcagtgagccgagatcacgccattgcactccagcctgggtaacaagagcaagactctgtctgaaaaaaaaaaaaaaaaaaaagccaatacctggagacacagttaagctaatataagccatagaagtttagagaataaatgctgtaaaacagaataaatcattttcccctttcagataaagagcaggctttcgcaaaaaaatcttttgtctctctctaaactgaatgactaagttctttcatgctaaagcttgcaactaagtttgtctaagaccccctagtcaacatacaataacaagcagtttctaaccagggtgtaaggtatttgatacctaaagcattctcatgactacaatgagtaaccaaactccacagcttgagaaattgttagacagaacccgcagatccctttctttgagaacatgagcctgtgaaattatctatctttgatctaatttggctttctcctcccttccgagttcactgaacatcacacaaaaatgattgcctggccactacaatgctaaatctggggcactaggaaactgttctagggacgctgaatagaagagctcccagggtaccttctattgttcactgcagagcagccaccttgatgaattgttttaagatatcgtttcactaaacctccagcagttttctccacaaaaagacagataataggtactttgaacattatcaaaattaaaaaacagaatttgatttaagttaaagatcaacgtatctgcaaaagttaaacttgcccctcatttcagccttcagaaagaagggaggcaagaagagacccagggaatagtttccaatgagggttaggacagcattactgcagcagacaggagacagtttagagaacaaaggctttcaaataagaaaagcagattctttcattcaagttacatgacctcctggcacctcctcttaccggtaaatagatttttttttactttgcagggttacttaaacaatgtttaaaagtgtctggcccaacagtaggtcttttcttttttttctttggaggtggagtcttactctgtcacccagactggagtgcagtggcccaactcagctcactgcaacctctacctcccaggttcaagcaattctcctgcctcaatctctcgagtggctgggaccacaggcgcatgccaccatgcctggctaatttttttatttttagtagagacggtgtttcaccatgttggcctggttggacttgaactcctgacctcaagggatccacccgcctgggcctcccaaagtgctgggattacaggtttatataagccacagtgcccagccagggtttttcatattgtgagagccatttttctttttacttgctacacaaagcatttgcattgtagggcgagacgaccaatttaaagagattcagttaaaaaaaaaaaaagctgtgacaaactctaggtgccttcccattagccccacccgcacctcttggtatccaatccttcgtatgagcctctccccttggatatgggcaggacctgaaaagacccctcttgctggcagcttggctctcgacacttgctggtagtgacagtaatcatgtcagtggtccagtcagcagccaggccatgcagggagcacccagctggcaaggaactaagcgggggcctccagctgacaaccagtgagaggtctggacactcagtcctgcagtggcaagaactgaattctgccagccgagtgaggctgaaatgagttcttcccaaatcaccaggtgagaatgcagatgagaccatgagctttctaaaggacctatctaaaccatgctcagacagaaactgagacgcatttgttttaagccactaaatctatggtaatttaggacatagcaatagataatactggtactatcaacttccttagttaccttgttaatttcatagtaactgtattaggtggcatccagactatcccaaatttaaatactaacagtagtataaaaagtctggccctttattacctttcccaggtaataaaacaactggtttctaaaagtttgatatggattacacctcttaggattcctcataatcctgtgaagtagatattcccattaattatttaactcaaatgactaacaaggggcagagctaggaacttgagaaccagcatccaacccctgatgccaccacccttccaacttttatagtttccctaaagtctcaatgatgcttcccactatgcccatagatagtaataaaaccacagacagtaaaaagtactgggaacattttgttcttccttttaaatccatcttatccactagattaataattgtgcacatcagttaaaatgtcttttattccaaagtctatgtctcagtgaagaggaatttattcccttcatggcttgttattaatactaagcacttaaactgagtatatgtgaaagccaaaaacattattcttactgaagacctgtcaaacaaagccacaaaacagctccttttattttctagtaagactagatttattcaataccctagtaaaagttttgattataagtatccaacagtataaaaagtacaaaacagatctgtagatttctaatatattaatacaaagtgcatgactacatacagtacatcctacaggcaaagagaggtggaaggggaaaaagaagactgtggttgaggtctagtaataaataaataaatacagaagtagagatgatccatattatagtatattctaccaccaatactgcagccaaaatgtacaaaaaaaatcatttcaaataactcaggaggatgataatggctggacttttgtaattcacctcaaagactgtgggagagccaactcaactcactgtatagtctgtgcatatggtggcttgtagcatgtaggttttttccaaaagaaggaaatataaaatgtttagattaagaactataaaactacagggtgcctataaaaggtggcttactccttattgttattatactatccaatttttaaaatgcagtttaaaaaataagcactgagtcttgttattacaaggcaggcaaatgtttctccctcattttgaaaagactgaactggcaatgcttttcctgaacatttagaaaagaggcagtaagagtactctggtttgggttcaagtgagaggcttttcatgaaaatcttaggattgaagagctctaagttcaggatatctcaatgttcagaaagcctgactaaaagaagccaaaccaaaaccatttaatgtgaacacaaacctcttttcttttagtaagttttacttttaatacagagtgaaagaaaataaaaatttaataggctaaaacaagtcaaacacccattctacacagataaaaaccttcacaaaggtcaactgaagtaatccagagctgaaactgaattgtgcagattttcaatgaagtcacagaagtcatgtaacacaaacaaaagtcgattatatttacacactcagcaagccctctaagaaatgtgccccaagaagcattaacctttgttttgtgccatcctgaagacttgcacattttatttttcagatagcttaacatttttaatcgagtgygttctctaccatgcggtaatgctttggtactattcatacagggtcttgcctatcctaaagacttgccatttccccaagaggagctttgattctgctttagaagttttacataaattaaaatctttatcaaatattaatatgaagggaggcacaggatgcaacatatatagtcaagttacctctctgtatatttagaaattactttctcctccaaggtatttgcaacagaaagctcagtctgtcctgcttaataatcagtagtacaggtgtgaatcatcagaagcttggcaagaccttaatatttcaaaattattaacaactacctctaggggcaagttcatgttactgagttatgacaaatttattatcatgagggaaaacaagagtagccagccatcttaaaaatgccccaaccactgcttctcaaaacagaaagactaaaaactacatacagtttatcatacaacaaatcccatctctgtcccctgaaattcccctagtttcattcattagaaggggattaaaaaaaaaaaagacttaaagagcactttacagcagcattcagctttcctatgaaatactcagcatcttaaatattatatacaactctttttttagtaagctagacactggcttcagagtttgtgggagtgggggaaatcaacccattcaaaactactctagaaattgtcttttggcagaatagcaggtatccaagttaaaaataagagggtcatttaagaccagcctggccaacgtggtgaaaccccgtctctactaaaactaaaaaattagccgggtctggtggcgggcacctataaacccagctacttgggaggctgaggcaggagaatcacttgaacccgggagacggaagttgcagtgagccaagatcacgccactgcactccagcctgggtaacaagagcaaaactccgtctcaaaaaaaaaagagggtcagtttgtagctttgtggtttttcaaaattcagatatttttttttttgttccccttctacataaaaacctcagtcaccactcctgagtggagatgggcagaggctctggcccctgctcctctggcttctcagcagctgctttcttattgctgcagcaaggcttgaagagatgtgtgtcaatgaggacttccccaaaacggcctttatagatgatcccacaacatatcttctgtctaaaagaaaaaatggagaacaagatacattaataaggaagaaaaataggaatacaaaagaaatctactcactattataactagtccaatataaccaaagagttgtgcttctacaatcttgcacattccaagtgaaagggctcctagagtaaccccaattagctagagaaggggaattacccagttgccttaaaggccacactggaatcttctcaaatattgaggaagacggcattttgaaagacagcagtcagtttcaaaggctgcccctgatgttgttaactatttcctccaaaatcaccaactcttgaaaaaaaaatcagccaccataaacaggctgatgcagctagcaattttttatatatatttaattttttttctttatcaactcctaagtgcttgagtggtaatttttaattaaatactgagtagataaaaatacatgtgtgggccgggtgtggtggcttacacctgtaatcccagcagtttgggaggctgaggtgggcagataacttgaggtcaggagttcgagatcagcctggccaacatggcgaaaccccatctctactaaaaatgcaaaaattagccaggcgtggtggcacgtgcctgtagtcccagctacttgggagactgaggcagtagaatcacttgaacccaggaagtggaggttgcagtgagccgaaatcacaccactgcactctagcctgggagacagagcaaaactctgtctcaaaaaaaaacaaaaaagggtgtgtgttagcaaaggcatcaaaaatgacaacacaatgagaatgcctacagaccacatactctaagggaaaaaagatcatttcctatgaagccccctgcaggcccctccacagtcccatcctacctcatctcatcctctccccacttaattttaggtttatcactcccttttctttatacttcatggtttcaccgtatgttggcatctctaatcatactgcacagttatccattacacacacacacacacacacacacacacacacacacagaatcacaatgtattctgcaatgttttagtcaacgttgagatccatacatattgttatagagctttatttcattttaacatgtataatattctaccctgtgaatatataacacagttttatttatctactcttattttaatgtataaatcagtggacacatcttaaaggtttttactagtttatattgctggcatataggaatgggaacgtcttcaactttactcaaaaacggccatttatctacatggttataactatttacacctataactgacagtgttctcatcattccataccttctccccaacatttggtaatagactttattttagttttttcaccaatctaatgagtataaaatggtatctcattgaaattttactttgtatttccttgattttcaaaaagtttgaacacattatcatttaatgagttatttcatgattcctttctaagtgtgtccatttttctgttggtttatctttttcttccattgtaggagttgtctgtatattccagatactaatcctttgtcagatatatgtgctggatatcatttcattttctttatggtattatttgatgaatttaagttcataattataatgtaattaaacctggaggtttttttaaatgcttaagtactctgtcataaaaaaatcctttcccactcaaaagtcataatctattttctactttaatgcatctgtaattggtgtttgtctatggtgtgaggtagggaacccaagcccaatttttccacatgaataaccatgttgttcttaatatcctagcaacacttattgaacagaccattttcgcccaccaatcacccccacatcatgtatcacataacaagtgctatatacatatgtggccttgtttccaggctctctatactattccattggtttatttttctattcctagtcccaaaacacattaattaccatggcttcataatatgtcttgatttctgttagggcaagtttatccacatctttctttttcttctgaagatgcctattttgggccctttgcttttctatataaattataaattagcttgtaaagttccataaatatgttgggattttgactgcaattaccctgaatctacaaagtgatcatctccctaacagtcagtttaataatatctatgaatgtgctatacctctcaatttatttaggtgtctttaaatgttattcaacggccgggcgcagtggttcatgcctgtaatcccagcactttgggaggccaaggcgagcagatcacctgaggtcaggagttcactatcagcctggccagcatggtgaaacccaatctctactaaaaatacaaaaattagcagggtgtggtggtgcatgcctgtaatcccagctactccggaggctgagacaggaaaatcgcttgaacccaggaggcggaggttgcagtgagccaagatcacaccactgcactccagcctaagtgacagagtgagtctctctctctcaacatagacatatatttatatatatacatacacacacacacacacacacacacacacacacacacacataaataaatgttattcgacaatattgtatgatttttacataactcctccaaagggcttttgatattttactacattattttatatttcctaacactatgataaaatgtatcattctaatgccaaactgcctagatttaaatcctgctctacttactatgtaaccttaaacaaagtacttcctctttgtacctgtgttttcacataatgcttcacagaattgtcataaagactaaataaggccaggtgcagtaactcacacctgtaatcccagcactttgggaggtcaaggcaggcagatcacttgaagctagaagttcaagaccagcctggccaatatggcgaaaccccatctctactaaaatacaaaaattagccaggcatggtggtgcgtgcctgtagacccagctatttgggcggctgaggtgggagaattgcctgagcccaggaggcggacattgcagtgagccaagataacaccmctgcactccagtctgggctacagagtgaaactctgtctcaaaaaaaaaaaaaaaaagattaaataaatgcaaacaaagtggtttaaagtactttaaagtacttacactatgcactaggcactgttctaaagtgtttactactacactactaccaatattgtattggttagaaccttctgtataatgctgaatagaaatggtgatagtcaacactcttgatttgttcctgatcatagagaaaatgctttcattttatcacaattatgtattatgtacttttgtcctttttgtaagatacctgttgtctaagtaaaaaagtttccttctattcctattttgctaaaacttttttttttttaaaccttaaaggaatgttcaaatttgtcaaactccttctttgcaccactaagaagacaacaccttcctttagaaactatcaatgtgggctgggcacggtggctcacgcctataatcccaacactttgggaggctgaggcaggtggatcacctaaggtcaggagttcgagaccagcctgaccaacatggtgaaaccccttttctactaaaaatacaaaaatttagccaggtgtggtggccatgcacctgtaatcccagctactcgggaggctaaggcaggagaatcactgaacccgggagrcagaggctgcagtgagcagagatcgagccattgcactatagcttggcaacaagagcaaaactccgtctcaaaaaaaaaaaaaaaaaagaaactgtcaatgtggtaaattatattagttgatcgtctcatgttcaaaccaatcttacatacctagaataaccctagtggctgatgatatatttgttttggtatcaaacttatatcagccttaaaaatgcttggggcctatgccctattttatccatagtctggaaaagccagtgcataggctccaatcatctgttcctggatgtttagtacaacttgcctattgtggtttgtttgtttgtttgtttgtttttttaaatagagtcttgctttatcaccaggctggagtgcaatggtgcaaaaatagcttactgcaaacctaacctcctaggctcaaacaatcccctcaccttggcctctcaaaatgctaggattacaggtgtgagccatcacacctggcctgaatcaatttattatgagattatctccgtttttcactttttcttgagacagctttagcaacatgtcttttttctagtactgtacctgcttcacctgtatgttcaaatttattggcatcaagttgtctataatatcctattattttttaaatgtctgctttatctatacctaagtctcttttctctttcctaaaattgcttatgtgtattatctccttttcctgatccactttatctctagtatatttttggtcacgtctttttgaaggaccaactcttagttttactgattctctccactgcatattgtctttctactccacttatctagcaataggcaatgtaggtaccttgatgtgatttttattttaaataaattttaataggaagaacatacaaaaatcccacttccctgctcaattcctgcttaatccactgcaatcgtgtgttaccaactgtttgccaaatgccatttaattgctaaggaagtagaaaaatactgcccataattaagatggtttgctggttagagagatactttgtttcttttaccttttccagtaagtgagatctaaaaaggaaaaaactggtgttctgttagaaccagaagccatctctgtatctgagccgtcatctgactggttactgtaacaaggagattgagctggggaggcacttgaggtggtactgtgagcatcagaatctgcaataaagattaagagaaaaaataaaattttcaatttcattacatgtaattgcaactaaacctcagcataagacactgtgaaagagttggtaaaaaagaaaaagtaaaaaataattcattttctatgcactactgatatttgaagatattcagactaacgtgttttttaaagaagtgaagaagatggaatagacatacttcctattcctcctgcttatacaactaaaatccctggatattatatataaaacaaacctgagactccaaaaggtgatgatcatctagggagctcaagacccaaggcaagccatggtggtaggttccttagtttttctggattttccttttgcctcataatccccagctttggaagtgaaacagcagccacccagaaatgccaatgtgtacagacaatcaaaacaacaacaacaaaacaaaaatccaaaaccccaattaaaacctgatctctctagcaaagaactaggaaaagggcagcctagccagacagaaaacatttctgaacactaaccttcctgttccagccaaacccacggaaaaaactgtggacacctttcctaaccccagcagaggctgaggtgaagagcctacatttccaccctcacaagacttaggaagcaccccaacacctataccagggtggtgtcagaggaagcctagcgaagtcaggattttcattatggcccactaagtacaaggccaccctcaccaggtggtagcctgaactctctcctgacatccagtagtaacaaggagcctccccctccccccaacctcagatgtcaatggaggttgagagagaaactggaattctaacacctggcggtaatagggtggtgaggcccctccctctttccctgccctgaggggtgtcaaaaaagccagttaaaatagaagggttaaataagacccagagtctcacaacataatctgaaaatgtccaggtttcaataaaaaattacatcagtccaagaatcaggaagatctcaaactaaatgaaaaggccaacactaagatgacaaagacattagaattatctgaccaagattttaaagcagccacgacaaaaatgcttcagtgagcaattatgaacatgtttgaaataaatgaaaacataggcttggcaaagaaataggaagcctcagtaaaaataagatagaaaactataaggaaaaaataaatggaaaatttgtaactgaaaaaaatacaataaagaaaataaaaaccacagtggatgggctgagcaacatggaggggagagagaaaacaaacagtgaactggaagaaagaacaacagaaattgccccatatgaacgacacagaaaacaaatgaacagagcaggagaaacctgtggagcttagtcaaacatacatctacattcatgtcattgcagtcctggagggagaggaaaaagagaatagaggtgaaaaagtactcaaatatagtggctgaaaacttgtgaaatttggcgagacataaacctaagactcaagaagctaaccaaagcccaacagaataaacccaaagaaatccatgccaaaacacgtcataattaagcctctataaactaaaccaagagaaaaatcttgaaagcagccaaagaataatgacattatacctataaagagaaaacaaaagatcctgatttaataaggaataaaggcagttcattagatgcagagctaaccctgatttaatactttgcctgtttatgtgaagatgtcagataaatgtacaagccagaaaataagtttcttagttaacagtcattgtgctataaggctgttgtactgccacgtcacagcaagagcagtatcataaacctcataaacacaggtggggcctaccatacaccttgcccatcccaggacacgttgacagagcaatccttccattcagataaccaatcaagtacttattaaatatttataaggcatcaaatcctatgttacatgctgcatggaaagaaacagactaaagaaaatttgggtttttttttttttttaattatttttatcttttggttttccttgagaccggatctcactctgtcacccaggctgaagtgcagtggcatgaccacagctcactgcagtctcaacctcctgagctcaagcaatcctcccgtctcagtctcctgagtagctgggaccacaggcacacaccaccacactcggctggttatttttttaatttttagcagagacaaggtctcgttatttgcccagactggtctggagctcctagcctcaagcgatcctcccacctcggcctcccaaagtgctgcaattacaggcatggtcacacctagccaagaaaatgtttttgtttttgtttgtttgtttgtttgtttgtttaaaacagagtctcactctgtcgcccaggctggagtgcagtggctggatctcagctcactgcagcctccaacctcttggattttcatgcctcagcctctcgagtagctacaactacaggtgtgcactaccacacccaactaatttttttatatttttagtagacaggatttcgccatgtttgccaggctggtcttgaactcctggcctcccaaagtgctgggattacaggtgtgagccaccacacccagtcaagaaaacgttttctgaatagagctcacaaatattttatatttacaaatatttacataaaacagcataaaattaggtatctaaaagaaagccccgttagtatttttaatatgttaacttagcaaacaaaatcctcaagagtagcaggttttaaaaaaatgagtctagtgggatgtttaagacttcctaaataattaacatcaacagacacctctatgctgctgaggaaaactcactctcctaggaagtgcttaatatctttaaactatttgaaatttcaattatctgaccatttttgttttgttttgtttttgttttcggagacggagttttgctcttgttgcccaggctggagtgcaatagcacaatctcggctcaccacaacctctgcctcccaggttcaagcaattttcttgcctctgcctcccaagtagctgggattacaggcatgcaccaccacgcccagctaatattgtatttttagtagacacggggtttctccatgttggtcaggctggtctcaaactcccaacctcaggtgatccacctgcctcggcctcccaaagtgctgggattagaggtgtaagcctccatgcccagcccaaactgcaattttaagtcttaaaaattacgtaggatttagaaggcaccaaggagtgattagatggcatcaagtcggtagggacaatgggcaaagtcaatgagcaaagctgtggaagccaaaaacactccaggaactgactcagctcaaacaaaaataggaccttcaaacactttctaggaattctcaaccatattttatagtaagcagaaatcactgcagattttgaaaaggatgacacaaaaagaatagctaacatttatagacgaatttattttgttttacaaagccattttttacttgattatccccagttctctgattagaaaattatggttaaacgtcaagtgactccagagttacacatttgctagtgacaagagctgatattcaaatccagatctgtaactctaggtccaatgccttttcagtacaccacaaaatgtcttgaaaagggaatacagggctgggcacggtggctcacgcctgaaatcccaggactttgggaggccaaggagggcagatcacctgaggtcaggagttcaagaccagcctggccaacatggcgaaactctgtctctactaaaaatacaaaaattagctgggtgtggtggcatgcacctgtaatcccrgctactcgggaggctgaggcaggagaatcgcttgaacccagtagggggaggttgcagtgagctgagatccgtgccactgcactgcactccagcctggttgacagagcaagtttgactccatctcagaaaaaaaaaaaaagaaagaaagaagagaatacaggcctggtatgtgcaggatacacagaagcaaacacataaccagaagcacagaccatttagtgggtgatatataaaaattcacatgtttcccaactgcttcaatgcacaaaggtgccagcaatttatactgtacctggtgaacaccctgtttcagtctgagcctccacaatctacacaccttattatcaaaggaatttattttcagtctctaactactacacagcacagtttcataataaaaatctaaaattacactgaatattcccttaagtaagacaaaagtgagatatcactttctctataattaagggaaagggctaagaatatacatatgaataatcagttcctcggccttcaagtgataaaagaaaattaatgtttcccaaatgttcattaaaacatctagtgaggactgggtgtgatggttcacacttgtaatcccagcacttttgggaagccgaggtgggtggattgcttgagctcagtttgagaccagcgtgggcaacatggcaaaacccaaactctactaaaaatacaaaaattagccaggcatggtggtgcatgtctgtagtcccagctactcaggaggctgaggcacaagaattgcttgtaccccagaggcagaggctgcagtgacccaagatcacaccactgtactccagcctgggtgacagagcgagaccctgtttcaaaaaaaaaaaagaaataaaagaaaatatctagtgagaatggaaggtagagttaaatctttagggagatggggggttgagagctggttaggaaaggtaagtgtataattaaaatacatatacaaatttatatttcctaaatattttacatctctaccacttattaagtggcccagatcaagtttaaatcacctctttgtgcctcctattctgagctctaagatggaaataactgagattacatatgtaaagtgcttagtataccaaaatgctcaaaaaatgttgagttctcctgcactcctcactttaccgtcactaaacttagatgtctttttccattattctaaaacaagcatgataaccatgtcttgattgataatgttctctctaacagggccctatagattttttaaaagtactgagagctccaatagagatccacaacccctagccgcaattctgagaaagctctggaaacagaaagtatattcctaacctatttggccacaaaatctggcatgacctaaactatgactataagcagacaaacctgactagcctatgtaccatctatttattccactaaatgtgaatactgctactttttgctgtaaaaatactaatgtgtttggttcaataatgctccttcaaaccccaagggtaatagagatatttattagacaataacattatatgcagtgtatttccttttcaaaatctaaaatctcaattccaaaatacagatgtgccattacagcaaccccccaaaacttccaataatagcatgtgacctgacattaattaattagacattcctttctcattctatcacacaacacacactgccccttaaacctgaaagcaagccctgaggttggctgaatttcaatatgtgcgttatgatttctaaagttactttccagaaaatctggactttggtctcagattgtcccctttacgtaccttcttgcacatctgcaggactcaatttccttatggataaaaatcaagtaaatgagctagaaatgcaccttctagaaaattaagatgtcaataaagacatcagggtggtctcagtacaatctgaagtggttagctagtagaaatactctcttgagacatcaaaatcagaaaaagtgccaacatttcacagaaataagataacatctctaccaagtcaacgttgccttccagtgctctttataaaaagcaataaaggaaaaaatgatccacacatgccatacaccacccccagccaaaaataacaaaacaattattaagtactaatgttgtaatatcaaacttactatgaygtttaaattccttctgcagtttactgatctggttgcttttyatcctgttcccagatagagttttcactttctttggtttcaatgtagtctttagactgggtccagcccttgcatctaccacctggaagaaaatactgaatatttaataatatttttaaaatgacaccagtgtatccctttggttcagatccgtgcctatttgagaaccacagttttatactgaaaagaggatgaagctccatgtgcacctttaatcatcacatgacataagggaataaataatatttatctactggggtttttaaagatattctttcctgtgaagtgggtaatagtgggagtctattggaaaaaaatttaaatagatttgtatatgggataatcattactggatgacccagctaggttaagaatcaaacctaaaaacaactccatttctacaggataatgttttgcagtttacgaaaagctttcatatactttttatatttagtacaaagcaaaaaatagagctacttttgttactccaattttagacagaaggaaaacaaggcaaagataaattatgcattttgccttatttcaccaagcgagtaaatgggtaagaggggtggagaggggagaagattggaatcaaggtcttcaggcctattctttatgcttttttcactttacaccttaatctctgaggtgagttacacgacagcaatagcatgttctcccacagtctagcccagccattgatctcgccccatatggtcctgtttcttaggtattcattcacatttattagctgcagatttctaccccatgtaaaaaggaaggttgttatcatcttcaaaatcatgacctattataataacataacactgtcatcaaaggacaatgtaaggctagtgtgaacgataactgtgttatactttctatacaccatctcatccagttctcacaatagctctgtaagagagctattatctttgcacttcatgaataaatataacctgcccaaaatccacaactagtaagtggtaaaggcaaaattcaaattcaagtctgatctacatgttcattagtaccaacctgagttcaaaggatcatgttatccaaagagatttaagaaaaagaattcatgtctaattaactctgggaattactgagttaagcctaaaaacaggtgaatgcttactgtgaatctccagaagggggatattggatacagccttaaggaaatgccacaccaggctattctgttctaaagatgccaaaatgttaggccattatatctgaacagcagctagtgtttttctttattcttttcagacttttctaccctagggatatattacttcctaaattagggggaaattaatgttactttaaatacagtagaggtataattgagaaaaaagaaagatggactaacatgattccagtttttttttgatcctgctggcaacttcttccatcttttcacaagcaggacacaggcattgcagatgtctcctgaacgagtctcatgcaatctgataagaaaacaatcaaacctttatcagtctcccttaccttaaagaattcatgcaagcacatttcttttggggaaaaaactgtatctatgtatggtttatagatacaatttaatcatcctggatgatcccattccattgtttctatagaatatttcagaaataaaattatcttctagattcaacaaaccaattctatgtacggcaatttggttattttgaaataagaaatgcttttaaaattaaataggccaggctgggtgcggtggctcacgcctgcaatcccagcactttgagagtctgagatgggtggatcacttgaggtcaggagtttgagaccagcctggccaacatgacaaaatcccgtgtctctactaaaaatacaaaaatcagcctggtgtggtggtgcacacctgtagtcccagctactcaagaggcttaagcaggagaatcgcttgagcccaggaagcagaggttgcagtgagccaagattgtaccactgcactccagcctgggcaacaagagcgagactccatctcaaaaaaaaaaaattaaataattaaataggctggtgtggtggctcacacctgtaatcccagcacatcggaagaccaaggtgggaagatcacttgagtgcaggagttcgagaccagcctgggcaacacaaggagaccccatctctactttaaaatttttttttttaatttaatttaaaaaaatgcttttaaaattaaagagtaaaactcaagacctaaaagagattctgattatcacggttttaaacattgctgtttaattaatctttcttgaaatgtgtaaatatatttcttttttggtgggggcgtgggggtgaacaggatctcactctgtcacgcaggctggagtacagtggtgggattatggctcactgcagcctcaacttcccaggttcaagtgatcctcccacctcagcctccctagtagctgggaccacaggcacgtgccaccacgcctggctaatttttgtattttttgtagagacagggttttgccatgttgcccaggctggtctccaacccctgggctcaactgatctgtccgccttggcctcccaaagtgctaggattacaggtgtgagccaccacacccggcctgtgtagatatttcataagtatcaaaatgctaacctttggcaagtaaaataatgtgccataatattccagtttcgcagcaaacaaaaccagagaggcactgtagttttaaaaaatgaaaatggccagatgaggtggcttatgcctgtaatcccagcactttaggaggctgaggcagccgggagttcgagaccagcctgggcaacatggcaaaatcctgtatctacaaaaaaatagaaaaattagcagggcatggtagtacatgcctgtagtcccagctactcaggagagagaggtgggaggctcacctgaggccagtgaggtcaaggctgcagtgagccatgacagtgacactgcagttctgcctgggtgacagagtgagactctgtctcaaacaaaccaacaaacaaacaaacgattatattgctgagtaaggtggtgcacacctgtagtcccagctactcgagaggctcagacgggaggatcacttgagcccaaaagttcaaggctgtggtgcacaatgatcacacctgtgaatagctactgcactccagcctaggcaacataggaagacattgtctctttaaaaaagaaaagaaaaaaagaatgatttcccatgttagaaattactttcaccactttttcttatcaaaacatttgttgatcatttattgttaatcctggactttttaactattctgaaggtgtcaaaaaggtctgtgccaaccatgcatgcctttttaaattttatttttattttagtatcttcatttcctcaacctcccaggctcaggtgatcctctcacttcagcctccgacgtagctwggactacaggcatgtaccgccacgtctggtgagttttttgtttgtattttttgtagagatgggtttccccatgttgcccaggctggtttcaagctcctgggctcaagtgacccacctgcctcagcctcccaaagtgctgggattactagcgtgagccactgcacccggtcaagcgtaattttttttttttttttttttttttgagacagagtctcattctgtcgccaggctggagtgcagtggcgtgatctcggctcactacaacctccgcctcctgggttcaagtgattctcctgcctcagcctctggagtaactgggactacaagtgtgcaccaccacgcccagcttatttttgtatttttagtagagatggggtttcaccatgttggccaggatggtctcgatctcttgacctcgtgatccgcccgcctcggcctcccaaaatgctctcagattactggtgtgagccactgcacccagtcaagggtaatttttttaaaagcctttttaaaaattaaccacaaaaggaagtcaacaacaaaagggtttgtctagctacaactttaaggggcttcacgattaatgtggtagctcctcataatctggaaaaaagtaggctgtcagcattgtttgattcatttaaaaagcaggagacttacacagcctaaattagaataagtgatttttattattagcacattgttccaatcaccttgcttacaaatatttctgtatgctgtggtattttttcactctaagaatagtacaaacatcaggtgatcttacccaaaacagctctggaagtccttttcatagcgtttactgtcagtgaatcgagaactggaggacttagctctgcaaatacagcagccctctatacttcggtacatctttggcttgtgaaaaccaaacatcttttcttctgggcratagtctgtaaagccaagggaattgacatatctttgttgagggctgtaacaaggaaccattaaagagttctctctgctccaccccacccccaagcaacttggtgttatatgaccaagacaggcaggcagctcaagggaagacctcctggatcgacctccattcttggcactatcaaggcaagcgtataaaacacaaagaaaagcctagttatttaaggaggactctactacctcctaactcgcctaacaaacatgcaatctaaaaatggggaagagaagcattttttaaaatcaggttttgaagtaagaaatgccacaaacaatcctgtaaaataatgaagctgtacacaaytaaggatgcatccttaaatttaagacacayctttttattttgcacatttgcattaacgtgattcccctctggggaagttttgagcatttaccatgaatactatttgatactaagcacacaactagctcactatgcatcagcccatactactttgcctaatgggaattcagaggggatttcttctgtgataaatgggaagttctaagcagtcaagtttgcccctgaattgaaactgctgaagggaagatgtaaaattcacaaaaatccaaggttagaatttaataataataattccttattatcattaagacaaaaaaagaacgagctcatgttgtctgaccgctgatctgccccttagttgttagaggtttgtggacctcttctacaaggctttgtgcctgagagtagtaacagtgggaggcaaatgtcccagagacgtagagtgaaataaattgcagtcctcctgttaaaaaaaaaaaaaatctcaacgtcaaggaaggaatgaaaacagctctggggctggatgcaaatatgtagctggcagtaaatctgtaccttaggaaaagtaatttggaatatccaaatcaagggccagctcaccaaaacaaccggactaagagaggtgatgaaaaggcaatgaatatagaaactaaactccaatggacaagtcagaggatgtgtgtatgtatgagggtctaactataaattatcacaaaattatcacataaagcaacaataaaagaaaaaaatttttttttttttggagacagagtctcactctttcacccaggctggagtgcggtggcgcgatctaggctcactgcaagctctgcctcccaggttcaagtgattctcctgcctcagcctccctagtagctgggactacaggtgcccgccaccacacccggctaactttttgtatttttagtagagacagggtttcagcatgttagccaggatggtctcgatctcctgaccttgtgatccacccgtctcggcctcccaaagtgctgggattacaggcgtgagccaccgtgcccggccaagaaaattattaatatcactttcgtgtccatagttttaggagttattaccacagaacactatctttttaaagttgttttagaaataaacttagatgagtaaacctaaagcttcagtacagtcatgtgttgcttaacaatggggacacattctgagaaatgcatcattgggcatccttgtgcagacatcagtgtcctcacataaaccaagatggcaatagcctacaacacccctaggctatatgggatagcctactgttccaaggcaacaaacttatacagcgtgtgacggtactgaatgccgtgggcaactgtaatacaatggtaagaatctgtgcatctaaatatagaaaaggtacaaaaaaatatggtatcataatcttttgggaccaccatcatatatgcagtctgtggttgaccgaaacgtccttgtgtgacatatggctgtatttgtctttggattatctcgtctgatcccattccattccaattctggttagtataatatagcaagtattaatgaaaatgattcagaaccaaatatccaggctttttatgtgtatttttttggtattgaggggttttgaaatatagacagaggttttacaacttttaaaagaaaatttttttaaaacttttattagcaaataattagctaaaaactgaagcttccctttcaaacaggctattgttaataaactgttcctctgccatgtttttgttggtgagagaggcaggcaaaagagtgggatgggggcaaggcagaaggccttcatgcatttcaataattaagtctaaacagttacctctaagaactgttttaaaaaaaacatttttagttgataataattttagttaaatgcttgggaatttgatgtctttgagaggaagaaaaatgaggaagtaccctctacacagtcataagaaaagatctagagaggcctgctcaaatgaggcagatttttttttctcaatccaacaacaaacccatatgataactgaaaagaaaatcctgaagaaaatggtcgcatgttgctttggaaaaaacaatgtcaaatgacagaagattgcagaaacaagaaagcagagtagcagttattgctttaatttgtgtattcctgttttaaggcaaaatgttaatacggccctcgtcctcacaccaccctgcgctcttctccaaactcgcccaacagcttgcattaccatcaagaaggtcagagaacagttcctctaatactctccaacttcatccataactcttggaaacttcagcctcccttctcagcaaggacaaaagaagcagagcaaaaaaggccagttcattccattaatacacagaccaaatcctattacgacagacagattcctatctctaccctcaccatctctttcccttcccccaaataaacaagtcctcaaagctatcagcattcagctcatctctaggatgtgaactaccttcactgaggttggatttgaccaagacgccatagtttgtgccagttaccacactgctaagctgttaaggatgttagggttataggtgaatattgaggctttctttttaatcagcagccattgtgaattaagtgttcctcttcaatgatttttttctgctggtggggacctccacaaaacttacccagcacccctagcaagacattccagtcataagctgaggaatattcttcttagacataggggagaataggctgatrtcttaggattcataatccattttcatatagttccgtgaccttacttttgtcctgacaaaattattctgcctgaacatctgagagggatctaaatcctagggcttaccctctcctaggcaatgctcagtgagaaatgcaatgaggtggcagacacctgtccttatgcaacacacaaggagcatgtgaaccttttaatggatgacaacttaataaacctattaagccttttctgagcttatcctcacacttaagaggcacctgggaatctgcagcaaatacacaggggtttcatttcgggctttgtttacaacaaccaagttaagcagtggttggtgtttaaccatttcaaggtttgggaagccctgagattaactgaaattatttccaaaaatctacaaacccatgaaatgtttaaaaaaacaacaaaaaaaaaacactacttaatccctagagcaaaaccaaggacataaaatggtctctgaaaccargttactttatatatttaacaaagtactgggtgggcgtggcataacttgattttaaactggagatttgttttttcaagcaatctggtggttctttagaatactgctttcctagtaccaaatttgtgcaatattaaatgattcctccagtacaatctatcttatttgttcaaatgacaccatcagctatgaaactatctgtgaattttgcctctattctcataggcatcatatcactcrgcactatgttttaaaggaagaaaggtaatactatctgctttctaattgattaatagttacagctgagaacagaccccatacaatctcatccttaaccatgtgtttggggaaagaagaggaaaattaagctgtgagataaagccaaaaatcaagaaaaacttaaaatactgattatgaactgtcattcgtcttctaaaattaaatagtggtatggttgcaaaattctgagtatactaaaagccactgaattgtacacattacaagagtgaatcttatggtatataaatgagtgaattttatggtacgtgaaagatctcagtaagcctgtttttgagatatttaaaaataaaaataactgagttaggaattcacttgtctttatcatctttgtaaactcatcatctcggatgccagtctcatactagctgtgtcaacccaaattgagagaccaagatgggaatctcaatcaaacaaagtttatcaggccgagcttgaggatgtgcgcccaggaagcacaggttccaayaggttataacctgtgtttcaaagcagattacacgaggcacggtattcatacatttttttaaacagggggatacctgcagtacagtgaagcaacaattacactcttgtcgatttgactggtattcagtgatgttacacataaggtaaagtaagtatgtggctgagcgggtaggagagaaggattaataattgtgtaggcatctcagggtctggcggaaggatgattgattccatcctgcctttgttctatatctgatacacaagtttacaaccagtacctgttagtaaaatatttaacaaactccagttacaaatgcacaaagggtcagccttagttaataggccatggttttattacccatatgtccaaactgcagccatcttggctcacttttctcttttcttctgacactatcatcaatcatctatctgtctatctacaatatgttttcttaaggtccctgaaatagaaaaaaaaaatcatttcaagatgtttttcaagatttgaggggttacagttaaaacatgcctatttatgggaggttctaacactgatctaactgacatagctgcctttgcacgtacacattcttcagccagaacaaatatttagaagaggctgtgtcaacccatttttccttgtatttccacattttcccccttttgatcaaaatttctctttagagaacacaaatgatcatacttcatgtccttttgtccttctgcattgggaaggctcattcccaggaagtcatgtcccacgttggagggaaagaggtgagatgaggttgatgtaggcctgaggtggacactccaggggtatgtagtagaatctgctgctacgcttacaggataattctatctacattgtgctaccataatgggcggggagggtgttaattttttttttttatcaagatagggtttcactgcattgcccacrctggtctcaaactcctagcctcaagcagtcttcccaccttggcctcccaagtgctaggattgagtgtgagccactgcacctgacctataattctggttttagcaatagacttacgtaagttggttataaataccatgagtaatttaagtgatagtaagagaagtaggatagagactatatcaaggtttgagatccttttgtcatttgtaagtgtgatgactgggcattcacacgtgtgagatgtgcctccctcaaaccttgttatgacgtcggcactttacccatgaaaaaggggttgaactgcagactggaagaaataggaagccaattaaatagatcattgagaagatcagtagtttgtgcctcttgtaaccatttagcttgcttggaaattctttctgtgcaagtctctacttcacccgaggtgtcgatgtaagtgcaacaggcactgtgagctactgcacagactccttgtcccagctactcgggaggctgaggtaggaggatcacctgagcccagggaggtcaaggctgtagtgagccatgatcacaccaccacactacaacctaggcgaaagagcaagactctccctcaaaaaaaaaaaaaaaaaaagcgcccttcaatttgccagctattttgccagctatttacactatgtgcccatccttgagttggtgggtgtggcccaatgccacataccaaaatgtatctcttaactattcattcataatagtttgaataggtaagttgtttaaaacatgagtgagccatggattggttttactgcaggccttacaaaggcctgcataagcatgatatataacaaatgagacgtgctggcacaatctgctttgctttttctcctttggacattcagttgccagttatgacagtaacggtgggaggccaggaatgtgcagggacctggaaaagatgaggaattaagtttgtgttctagataagttagagaatttgtccctaattggcttactgatagatagacctgggggcggtggggaagggtgagacttagggcttattactaagcacagaatgaaaatatggcctggctttagaagctgaatttgaatttggaaagtgacatttggagggaactgatgtaagtatatggtaacatttggagtgtcagaaaaatcaatctctggtgcaacaagtagcatgtaatgatcttgaatggcccttggaagctggtgacaaatccagcaatctgagagactgcctccatctgccacactttaggagagtttggctaatgaactatttttccatccccagcagagaccctgaaaagtcaagtgtatatacataggtggccatcatgtgtacagaaacattaaccaggttatatatcctataatctgagtcaaagcagacaaggccaatagtccccaaagtaaatataatactctaagaatgtttagacaggagatcatacaggcctggtctgaagtcttaggtcaattagctgtccactcagatgttgtcaacttctcgtcctggtttcagggttgaagctgtttggtgaatcagagacagggatctttggtgggagtcatggtccattcaggaagttgtgcctttttaaggtgagagatatggatccgtgagtctacaacctttaactctgctgtgcatggattagtcaacgatacctggtaagggcccctccaccaaggctggagggagtcctttatgagatgtcttttccaacagacaaaatttccaggttggaggtcatgaccagaatcttcatctcccaggagcgcactgtgggacgtgtcttgcactaaggtctggcttttcatgagctggtgaacaagtcccttacaacagtgcaagatgtccccattcagtaaatttgtatcagtcatcttgattcccatgtgcctgggtcttccagttacaatttcatgagaagagagctgataaagggatggatcaaaggttgagcaataccaaggggagtgccttcagcctagcagaggtgaaaagcctccataaatttagccagttgtgtttttattattccattggtccattctaccaatccggggacttagccaattgtgttattattccattgttccattctaccaatccagaggaactaagggtggtaggcacaatcaaaatacggaaatataggccaatttttttttttttttttttttgagactaagtctcgctctgtcacctaggctggagtgcagtggcatgattttggcttactgcaacctccgcctgccaggtttaagcgattctcctgcctcagcctcctgagtagctgggactacaggcgtgcgccacgatgcccggctaatttttgtattgttagtggagacaggatttcaccatgttagccaggctggtcttaaactcctgacctcaggtgatccgcccgcctcggcctcccaagtgctgggattacaggcatgagccactgcgcccagccccaaattttacaaatgctcaatgacctgggcagtaaaataagttcccctattgctgtgaagttcaaaaggggactccccataatggggtaatcccttaataagattttacccactaccattgcccatcagcaggatgggcaattgcattacccaatgcaaaaacatgcatatcattaccaatacatatttatatgcttaagatggtggcagctagataaaatcaagctgccacatctcaaaaggtctaggtagaaaaagaaaatgatcctgagccccataaaggggttttccaggattgtgttttgggtagatggtacactgtaaatcaatcttctgtgccatgatgacagtctccaataatattgtttataataggatatcattttatctgaattccaatgggtcaagctgtaaatgtgttccatgaggggtatctgataccccactaggataatgggtttatcattaggtccataccatagttcagtttgcgggaaaagtaccccccccttttgtttccaggtagatctttcttcgatgaaagctaagtcttgggtttcctttagcgtagatttaactgtttaagtctcacagtcattccaaggatcggactggtgtctcaaatgcagcactcttagctactgcatcagcaaagtgattaccttgactctgtgttgtgtttaattcagagcagcctggaacctttataattgccaaaagcgagatccaagactagtccatttttttacgggttgccctgagaaggttaaataccctctctctttccatagcattccaaagtcatgagcaccatcagatgcataggggcataatttttgctactttattctttgctagttaacaagtttgagtcagggcaatcagttcagccagttgggctgacttagcctgaagaagaccagcttcaatgaccatggcacatcctgctttaaccttaccaccttctcccctcaagtaagatacatctgtaaaccattctgtcttagcattatctagtggtgattcttgtaggtctgtccttggggtaaaaagttgggtgtgtcatcaggatgaagtaatgagaggtcttatcagaagactggccaggcctggtgcagtggctcatgcctataatcctagcactttgtggtctgctaaattcatatttcagtatttgggaaaagtaagtggggcactgtatatccctgtaacatcacagtccaagtataccgtcattctctccaggtagaggcaaacaaatactaactacctggatgtatagggatgcttaaaaaggcactagagatccacaagtgccactcaaggtgggcagaccgcttgagcccaggagtttgagaccagcctgggcaacatggtaagccctgtctctacaaaaaatataaaaattagccaggtgcagtggtgcaagcctgtagtcccagctactcgggaggctgaggcaggcagattaactgagcccaggaggtcaaggcagcagtgagctgtgaacacaccactgcagtccagcctgggtgacagagcaagaccctgtctaaaaaagagagagagagagagagtggcaaggttaggattactgcaacgagatggtaacattagaggataataaaattaagacctaataggaagttaatctattgaaagacaagtgttgagttatgatgggaattcagaagtagctcaactgaatacggaatgaaggcagtaagggagaggaccccatgactatctctccaacagttttatatagaagggctatagctgatattgccctcatacaagggggccatcctcgagtcattggatctaactgctgactataatagcctataggtctgagtcaacataccaaatgtgttccccccatcttcatgaacagaaagagagaaagttcatagtttgggtgtcttattgctggggcatttattaaccttttaaaaaaaaacaacaacaacagactcttgctctgtcacttaggctggaatgcagtcggctcactgcaacctctgcctcccaagttcaagcgattctcctgcctcagcctcccatgtaactgggactacaggcattttgccaccacatctggctaatttttgtatttttagtagagacacggtttcaccatgttgcccgtgctggtcttgaacgcctagccacaagtatctgcccacctcagcttctcaaagtgctgggattacaggcgtgaaccaccgcgcctggcctactaatctttctttaatttgttgcacagctggctgtccctcacgagtccacatgatgggatcaggctggtcattctttaaacaggtacaaaagggttgagtcacacaataaaaatttagtatccagcttccacaacagcaggccaactccaagaaccctctaagctattttttagtaggaagcatcaaaaaagctaagattcctttgattctatcaggattgatgctcaatcctttggctgacataacatgtgccacatgtttgacttgagaaagacaaaattaaagtttacccttaatgtaatggtcaattgttgaagtaagtacaagttttcttcttcagaggaagaaagtgtgtcagagcaaaggaggaggtatgcatacactggatgagggatgaggatcccctgagagaagtccgagtctgctaaattcatatttcagtatttgggaaaagtaagtggggcgctgtatatccctgtgacatcacagtccaagtataccgtcattctctccaggaaaaggcaaacaaatactgactacctagatgtatagggatgctttaaaaaggcactacagagatccgcaactgaaaaatatcgtcagggacaggcacagtggctcacacctataatcccagcactttgggaggctgaggcgggtggatcacttgaggtcaggagttcgagaccagcctggccaacatcatgaaaccccgtctctactaaaaatacaaaaataagccaggtgtggtggtacacatctgtaatcctagctacctggcaggctgaggcaggagaatcacttgatcccaggaggtggaggctgcagtgagctgagattgtgccactgtactccagcctaggtgacagagtgagattctgtctcaaaaaaaaaaaaaaaaaaaaaaagaacactatcatccttgatatttggtatggcagacaggtgtatgaaggttaagaagcactggatatctaggtattataatactgtctacagcccgtaagttttgtacaaatctccatccccttcccatttggttccttgacaaggaaaatgggggtgttgcagggactgatgcagggaataataaaacctctctcaagataatctcatgattggggcaactccatctatggcttcttgccatagtggctattattttacgttaagcaagggattcttagtgttaatctcaacctttattggagtagctgagagtatctttcctatgcctatgttagactgggaccacagcaggtaagaaatagtttcaagtaaaagcttagcttctggcattagtagaaaagttgaagtttaaaaggagccttatggtttccttccctttattatatttcattttgttttctcattttcccaatcacatgaaggtgtctttacaccactaacatcaacttgtgatttttttttttttttttttgagacggagtctcactctgtcgcccaggctggagtgcaatggtgtgatctcggctcaccgcaacctccgcctcccaggttcaagcaattctcctgcctaagcctccggagtagctgggatcacaggaatgcaccaccacgctcggctaattttgtattttcttagtagagatggggtttttccatgttggtcaggctggtctcaacctcccgagctcaggtgatccacctgcctcagcctaccaaagtgctgggattacaagcgtgagccaccgtgcccggccaacttgtgatatattatgagggcattttttggtttgctttccccaatcccatgatttcagttccagcaacatttcccactttaaggaaaaagagatgagcattatggatgtcgtggaaatttcaatccagaaggttaaacaggtacttctgggcatatcaggaaaacatgggattggctaagggtatcacattcacagcccttgggaggaagccaaacccaatgaaccactaaagcaaagatgtgaacttaaagcaagggatgggtttattaggtatacccaccatgttaactttttcattcctctgagaaatggggttttcaagtaaggtggaatttataactgatacaggagctcctgtgcctactattgtgttaatttctcccaaagagtgagttaaagcagcatattgggagaaatgaaaaccccctatttcctcagaggagtcctagttttccagtttatcatcctgtttccatttcaatgtcctgcaattccttttaaaatgcctagtttcttgtagtagtgacagacaaggggagaagagttcttaggaccaagacttcctagcctgggagttttaagaggttaagtgttaccattgttaagtgtacagccttttgattttcctttttcatcattgtgcaggacaactggtcagccagttgaccagtcattagttctggccatcacctagtcagtcatgtgacatttgacaagagtgggtagtgcatcacccaaattgtttgggaaattttaataatatgtcatttttattgttttcaaagttgtccattgacatctgcaatattgttttcatgttttatcaaagtgggtaaaaaaatctacaacaggcccatctggattctggcagcatcgctggattttaatctaatctacgatctttttttttttttttttcctgagagagtctcactctgtcgccaggctggagtgcagtggtacaatctcmgctcattgcaacctccgcctctgaggttcaagcaattctcctgcctcagcctcctgaggaactaagattacaggtgtgtgccaccacgactggctgatttttgtatttttagtagagatggggtttcaccagttggccaggctggcctcgaactcctgacctcatgatccacccgccttggcctcccaaagtgtccggccgtaatctatgatcttttgaaaaaaacaagggaatggcatttaacagagaagctgctcatacccacgcgtctttgagccatcttctgaaagctggggagttggctgtggcagaggtcatactggattttcaggaacaagatctgttaggggatccaaccacactgtgctttttctagctattccttagcttaagcagctgaaaccagcatgtagacaagccgataaatgtcagaatgacctgggtcatagattttaattgkgagttcaaattctttggtaaagcaaatccgatcttcataagggtcaggaaattccttaactatggcccataatttggccttcgactagggttgatagagaatcaggactccaggcaggccgggcacacacgctgctggtactggaagtgaaccactgggaccgagcatgagcaagccagtgagtgggtcccgcagccccctggacccagggccaagcatggcggctgccaaggtggctttaactgagagagcagatccaactgagcttataacaatatttttgaagtatgcaagcattgagaaaaatggtgaatttttcatgtctcccartgactttatcactccatacttgaacatttctggagaaagccagcctaacccaaagactgtggaacttttaagtggggtggtgggtcagaccaaagatgggaggaatgttgtcccagcgttgatgatgctaagtttgatcacttgatgaaggtggcatccaccagctatttccattttaatgactagtatcttttcaagaatgtgtggccttttgattggtcctgggtgcccctgatactttgtttatggtagcctttcagctagctgtttgacaaagctggcaaaggagaagtaacttttgatcagaaagaggatggtaccagcagtctacaggtgtcatcccagtcactgttccctggtcccaatggtaacaactgacatttatcaccatcaattggtttttcctgtttttaaacttaattggaactatacagaatgtactctttcagtctggcttcttttgttcaacatttgtgagatttatccatgctgtattttttatttttcttcactgtatagaattccgttgtgtgacagcatatccattctagggtcgatagacattttgggacattttcagttttggctactacaagtaatgtgttttcaacattgttttacgtattttgtgtgtgtgtgtgtgtgagtgtgtgtatttctaggaatagaactgctgggtcatagaaaatgtgtaaatttaccttcagtagatcttgctaaactgtttcctaaaatgatggtaccagttaacactcataccatcattgtatgaaggctccatttatttcagatatttgccaacacttggtatcagtcatttgttatttcagtggtatctcagtgtggttttgataagcatttccctgattccaaatgggtcctagaacttattggccatttaggtatcctcttcagtcatgtgcttatcttctggatacaagacctgtggtggttatatgtttcatagatgtctttactctgttcactgttactcatttaactgagtcttgaggaacttaagttcctaattttaatgtagtacaaattatcagcattttcttttgtagctagctctttttgcgtcctgattaagaaatctttgctttcctccaggtcgggaaaataatctccattattatcttccagaagtttgttttcctttcaaatttagattttaattgttctagaatttgtgatatttttacatggcattaaaggtaagggtcaaagattcttccctggccctcttccccatggatatgtagatcacccagcaccatttaatgaaaagatcactcttttctttttttttgagasgcagttttgctctcgttgcccaggctggagtgcaatggcacgatctcggctcactgcaacctccacctcctgggttcaggcgattctcctgcctcagcctcccaagtagctgagattacaggtacccgccaccacgcccagctattttttttttgtatttttagtagagacggtttcaccatattggccaggctggtctcgaactcctgacctcaggtgatccacctgcctcggcctcccgaagtgctgggattacaggtgtgagccaccccatgcagccaagatcactcttttctttattgcactgcagtggtactgctgtcataaattcaatatggggctgtatctgaatgctctattcttttcatataattgtatattatccactaatactatcttaattactacagctttataagtcatacctgataagtctttcaactttattctttaagattatcttggctattcttggccctattcattatcaaaacaatttcagaataagttgttaatttccacaaacatcctgctgggattctgaatgcactgaatatgtgtaatatctgkgtgtatatgtgtaattaaatgtttttttgtttgtttgtttgttttttctgagacggagtttcgctcttgttgcccaggctggagtgcaatggcacgatctcggctcactgcaacctccacctcctgggttcaagcgattctcctgcctcagcctcccaagtagctgggattacaggtgcccaccacctcgcccggctaattttttgtatttttagtagagatggggtttcaccataatgaccaggctaggctggtctcgaactcctgacctcagatgatccaccctcctcagcctcccaaagtgctgggattacaggcgtgagccaccacgcccggccaattaaatgttttaatcccttaaaaaaaagagaaagagaattaggaatcccccacctatcataggctgttcccagaatgaggcaaccacaggaagcattcctgtggagttcctgtccgtcacttctgaacaagaggttgctgccagggtaggtggaaggacaacaagagcaggggcctttggagccgtgtttcctgtcacagtctaacaagtggcagacaaggagaaagagatggcagaagaagaaaaatcagatccagcctggagagttagaaagatgaagatagagtggcagggcacagtggctcacgcctgtaatcccagcagtttaggaggcgaggcgggcggatcacgaggtcacaagattgagaccatcctgcctaacacggtgaaaccctgtctctactaaaaatacaaaaaaaaatagccgggcgtggtggcgggcgcctgtaatcccagccactctgaaggctgaggcagaagaatggcgcgaacccgggaggcggagtttgcagtgagccgagatcgcgccattgcactccagcctgggcaacagagcgagactccgtctcaaaaaaaaaagaaagatgaagatagagtgaaggtgtaggtggtgaaggaggcccaaagagaggtacttctgaagattttttttttttaataggagagtatatttgagagctatctgttaacacctctaagttgtttatcagcattctataaggaagaaagatcatcctacccacttttgctactttcaagataccactggaagtagtttccccattctggttgcttaatttttgcactagcaccttccatcctggtctgcatatatcaaaggatctgcatttaggccattgtgatgtggagtcattcttcagtcatcctggtccatttgtttaagtaattacacaatgaggcaccccaagtactgtatattaacccagctggggtttctaaaggtggaatcagatgttctgcagttgcaggggatttagtcgatttagaggatttgttctccataatttttaataccttctcattagattgactaagtcaggaggtgttctgaatctgaatgtgctgcttgcaaacacaaagcttgaggatgcgcacccaggaagcacaagttccagtagcttattacctgtgctctgaagtagactgcatgaggcacagtctttatatattttttaaacaggaaaatatgtgcggtatggtgaagcaatagttgagaatttggttcatattcagtgatgttatgcctaaagtcaagtaaatatgtggttgagtgggtagaagagaaaagttaataattgtgtaggcaccttagggtctggtggaaggatgattgattccatcctgcctttgttctgtatctgataaacaagtttacaaccagtatctgtcagtaaaatatttaacaaactccagttacaaacccaaggggtcagctttagtttgtaggcagtggtttaattatgcatatgtccaaactgcagccatcttggaccagttttatcttttcttctgacaccatctatcatcatctatctgtctacagtatgctgtctgaagtttcttcaaataggacaaacattttgagaagttcctcaggatttgaaaggttacagttaaaacatgcctatttatgggagtttgtaacgcttatctctgacatagctgtttttgcaatatacacacattcctgggccagaaagaaatttagaggaggactgtgttgatcagttttttcttttatttgctttcacaggtgtaataaatgtgttgcttaaattttaagttgtcatttgtatagcactttacattttataaagcactttcactggcattctttctttgactactattagccaaaaacccaaaaattgttttaatactgtaacagttaaaaacaatcaaccatggccgggcgtggtggctcaagcctataatcccagcactttgggatgccaaggtgggtggatcacctgaggtcaggagtttgagaccagcctgaccaacatgacgcaaccctgtctctactaaatataaaaaaatttgccaggcgtagtagtggcagacgcctgtaaatctcagctactcaggaggctgaggcagcagaattgcttgaacccgggaggcagagtatgcagtgagccgagattgtgccactgcactccagccttggggacaagagcaaaaattcatctcaaaaataaaaaataaaaaaaaaaccatgccataattatagctctgaccaaataaactgaatatcccaaagttaaaaaagattaaaggtaatagctaagtcagcaaaagcaatttaaaaagataactaattatatggacaatatatataaacaaaaaaataaagttttaaaacacaacaatcaattctaaacatctgttttggctgatttgtagggttttcttctactttaaagctgtgggtttcatataaatttaatgatcttaatgaatctaacttaatgaatctaaccttggtgctgatgagtcaagaaagggatgagataaccacaatatatcaaagacacaaaagggacaattctaatcccatctaatgaaattgggaagccaaagatcaagaataacgtctaattttacatctaattaaacacataagtttactgaatataataatatacataggaaagaaaaagagtttcacagcgatagtttatattaaagacgctatttaagaaaagttttctgataaataagattaaagattatctcttataaatctcagcaatactaaatacttgttcattttaagctccaaccaggaaacagaatgaaaaatactgaaatgcaaattttagagctttagtaccctttttaatatggaataggagacagagaaaaggtgatgaatttaattcaactattttcttgtctttttaaatctttataagggtgttaactcacatttaaggatatggagagggttcttattacgatgaatttaacatatgttaagttcaccttagttggcatgcatgctttraaggacatcattatttactctaacttccccaattccactttctagattccttcttctggcttttttatatattcagaagtaaagcgttttttaatattcaaaagtacctttcaaaactcagtaataccactgggtggactagatggaagaaaattgagagcaatagtcaaacgtggtaaataacagttaacttcacaactgtccaagtcatcttgggaactgaaattctgatatgcacaaattaggggaacaacctcccaaatgaaactatccttaagtttccaataaaccaaaaccctagcttctaattatcatttttttctttctaaaaatcaactggcctaagtctttaaaaacaaaaaaaaaacacaagatagttgaagtgacttaaatgtcaacgaattttcagactggttaaattatggttgaaacaccacagcacgctgtttcaacctttaaagcaagttgaacagtagtaatacagtataatctcacaggatgtttttaaaatgagactgtaactacacaaacttctttttaaattggttcttaaaaatagtaaatagtggttgcctctgaggagtacaagcataaaagaagcttactttcactttactacctcctgcttttttttttttaaccaagagcatcactctccaataaccttggttatcaagacacaccttaagagtaatctaaaaaagcacagagagcttaaataaacttcctcaaagacatacagatggagagatacaaattagaaaatacactccatgggagagactacgaaatagactggtaagatctaaatacacacagagcagaatgggaaggaaactgcagacaggagacaagcgaaagatttgtaaagtgggaaggaagcagcagtgaacaaagacaaaaagaactaagcaaccaaagacaactttgaagtgaaggagatgcatttctttagagccaaactagaaatcatgatgatgggaaaggaaaagaaataacacgaaaaaatactcgcgatcacaaactgtggggatacttgagttcctgtaattggtaatgccaccactgacaccattttagtcaatcatatgctatcattaatcacatttaagtacagcatccagtaaacactaacagtgtaactggagcaacacttttcacaaacggtcaacaggactaaatgctttgtattctcccgcggctaggctatttggctgcagtattccccaataatgagacatgtttcatctgcagttaaggaaacccatggagcagtaagacattatttcctcttacctgcttctagatagcagcctacatctcagcaaaattcctgaatttagctaactttaagggataaatgtaaatctgtctagaataaaactgagaaaggggtagcagaccccacttgtttgccaacagcctcttcaaacatgtgccctgtctctgagaaattatatggtaaagcatttataactgtggctgtctatggaatccacacttggcagaagagcctaaaactcatcctatataggaaagaggtcaaactcagaaataaacaagtcttcaactgaaatggcataggttaaaaataaaattacaaattcaagtctctgggctttagatagtgtaaaacaccaggcccctccaattttggtagagcgaaaaaaaaaaaaagagaaacaaaactaggtctcccaattctagattaagaggaattccagtacatgaaaaaaaaaactgaaagtgtcagaaagaatatttatttgcttttaatggatgattatgagttagaaaatataaccatacttgggtctgcaatgagtcaatttggagtatatttctgcttctgtctttacaactaaataggaagtcactcctaattttatttgcccttctgtaacattgggaaattctgtttatttccttgaatttataagagttgcacattacagaaaaataaatgctatctatcccaagatatatacaacaaatttaactgaaggtaaaattctgattactaaagattttcttttaagcccaggtctgtgggaaaagaggaacttagccttttcagggagactttaaggtcatgaaaagccccatatactcctctatgaagctgttctcccattttcaaacttgagaaaaatgttaagaaaatggatacatgatagtatacacacctgatttgacccaaacctcaggaaagttccttaacctcactaatcctgtttcctcatctataaaataatgacaggccgggcacagtggctcacgcctgtaatcccagcactatgggaggcagaggcaggtggatcacctggtcaggagttcgagaccagtctggctaacatggtgaaacaccgtttctactaaaaatacaaaaaattagcccagcctggtggcgtgcgcctgtaatcccagctactcaggaggctgaggcaggagaattgcctgaacccagaggcagaggttgcagtgagccaagatcgcaccactgaactccagtttaggcaacaagagcaaagctcagtctcaaaataataatgacaaatccaaatctcctgaatagtatctgtaaagcatcaacacaacatcaacacaaagatcggcacaaggtatgcactcagctctgacaattctttttactcaccaatctttcttctttctctctttttttcctcttacatttcaggtatcattttgctttctgtctttgggcaatccactcgcaggaagttactaaccaaccttattggtaatacctattattcattccctggtccaatctctccccttagctctaggataaatatggccaactgaccaccaatccattccaatctttaaataccctgagaattgattatataatcttccctccaaatctgctcttcctctatttacctatcttggttgtcatccacagtcacacaaaaacaacttggaagccaactgagctcttccttcaccctctgcatggccctccatcaaatttattgtgaagtccttagaaattctgtttcttccttcacttccatccccactgcctgtttgttcctcatcatggtgcatgaactcctgtcagaaccttgtaactgacttccctacatcctttaaacatgtgatatcttcctaaagttcaactactaatcttcccttccaaggtaccaacactggcttcatgatagtatctaaactccttggcaaggaattcaaagcttttcaggatctgctcctgcctaccagctgctcccaacttggaattctgatattctaggagtgtcaaacaaactttaataactagccaccctctactcaggctgttatttctgcctgagacggcttaccctctatccccttgacctgggaaattctcttaagaattacttattttacaaaacccttccatacctttattagaacacctaccacataagatttcacttcttgtttactgcattatctcctctactcaatagtaaaccgctgtagagcagaaactaagtcttgtattacaaccaggtgctggctgtacatagtacacagaaacgggtagaatttgctaactactcaaagagtggggcagccaagattaatataaacagtatatttaagggcatggaatgggaaatggtgtctacaataaagacgtgaattttaaaaactaatgttttgaaaggagtcattgtttgcactattgatcatagaaatatttttaatgtttttaaaaaggagtctttttttaacatttggtctatagacttttgcaggaaaaaaaacctgaggttttaaaagctataggaaaaaatgtttcttgcttatttcaagcaggagcagggggaaggaaattagactagtgtggggagaaatgagaaatgagagctacttcaactcagcacagttaacatttaccaaattaaaataacagtaagccaaaccaaacttataataggtggaaaacaactaaatacaaagctagaaataaattcttttagttcaactgtaactttcatacttgaatatgtaacagcggtgtacctgtgacattagtatttctgaggcaaagagaaaacctccctaccttgaaaacaaactccctttttggactagatgacatttccagattatttccataatacagaaaaatcctagttgcagattcaataaaaaactggagaaacaaaagacaacaaaaaagtctcaatttataacaccccaaaatcaaaacttaagtgtgggaaatacaagacaatcttgtggacaagagaaatcaggaagaaagaaaaatgacattttccaggtttccgcaggactttctgatgtaaaatggttgaatcagaattgaaaagacaaccaagagtcaagggcagtgtcttcccagaactgctttcttaaggtaagggaggggaccaaagacactcattctttccactaaaaatttacttaatgtttccccagaaacgataactgacacaggcctcagttttatcttctgtaaaatgtctacttcccagtgttgtgaggacaacacagctaatatttatcaatcatgtcactggcttaattacaacttatttaaaataggtattactaccattttacagatgaaaaaaactggatcacaaagtgactataagatgatgacagctttgaaacccaagcattactaacccagaaacctctgaacagcaaaacttcgtgcctcaatacatgtgttccttttctgctcaaccaattatattcctaccatctcttaagaaaaaacgaaaatgacatacttttaaagcaacctactatgtgcctggcatggtaaattgattaatttatcctcataagagccctgtatagttggtttagatttaaaagtttatgctttccccagtgaaaaacttttattttacatgtaaaatggttcttaaattgcttctctgacataaatatgtctgagtttgagccctatgagtcaggatttcccaggacttgataaccactctgggggaaaaaaaaaaaaattgaccattcaggttccagatatacagaattaagaatactgtgcaaggacagacagacttggggcctgctgtccaccagtgatctagaatattctaccaattgaacttcgtatctccaacctcccacaaaagcaatacaaagagaaggcagtagagaccttgtctgtgggtctttcccaccctgaattcattcacattgataatccaaatctctgttttacatcatctaattagtaaaacaaaaaccattaagctctgtatgtagtatatgaaatctgctaggaaatggaaattctagccataacttagctatgaaatactaattaagaaaaacaactcaaacaatctcagcgtatttgcaaagcacctcatatgcattttaaatacaggacccagagaaatagctgcgaaaggaaagccaaagttattaaatccaaagtttttcattttcttgacatgctctttctatttaatacagaaatgtactaatataggttgccttttggtattgtaatttggtcaaccaaaacttgggaaaaataggtccaaagtttttcattttcctracatgctctttctatttactacagaaatgtactaatataggttgccttttggtattgtaatttggtcaaccaaaacttgggaaaaataggtttattaataacaaaataatgaaaaaaaatggatttcaactagtatcgatttttaggtgtgtgggggcaggggcattcaagggtattatttcctagtaatgatcacttagattctaggccttacacatgattcaaatgcaggagaaatcaggaaagaagcaacagatatggtggtgggtatcggatgtctagactacaggcaaaccccaaataccaaagaagcatccatgtgtcaaaccagcataatttttgagctatgcctggggccacatacaaaaaaagaaaaggttagcttgaaaagaaaaatctaggagaggtaaccagaaggtcaaccacagttcacgggatctgggaagaagctagccgttaccctgtgtcatcttcctgagcagcttcctccccagccagctccccagcctccttacaatgtttccaaaaggcccaactccctaaacatttgcttcttcaaggtcatcctaaggcactgaataaccaccaaacactgagtcacgcatacctttcgcctaaaaaagatcccccttcccaaaatcattatataaatactttaaatgccatgagggttttctccgaaactccaccagaaacaaactcccagacttttagattgggcaactaaatgtgttcaattttgcgacataaaattttaaaaggcttttcaagtctggcaaattccagttcaaaaacaggtgctttcagcgtactctgaataacaaggtcaaattcatttttaaattattaaaagaaaaagaaaagcttttcttaaccctccttaggacaacttaagaagggggagaaagaattgctggggtaaaactgtctcggatagggtccctgtttaactcaagagtaaatcctaatcttccgagtgcctgaagtaatggaaggttacaggaagaaaataaaaacaaagaaactgactagggtcatagttaccagaacaaactgcaccgccctaccacctcaagaaaccaactccccctacaccaaaacaaaccttgcccttccccgctccccccaccccctagaaacacacaaagaaactggccgcacgcacaattcgcccacagtcctcacttcccttagtagggcaacagggagccccggaacttccccacggtggtttatcgggcgtcgtcggggctgggtcccctggacttgcgggccacagctcggctggggaggaggtgctcgccgccctcacccgtttctctgaaagcagtaaaatgcctccccgctcctcccagggccctcgggtccccaccttccgtaaatcgtgcttccccctcgggcactccggtgactgccgagagagacgccgagccagcaagtaagaatgctccctggtggatttgttggtaaataagacatctcgcgtcgggaggaaagttcctgcgggggccgctcgccggggcgagggcgagggcagcgggaggtgaaccgcgtcgctcgccgccacctccctcacctgcgccggaacaacgggccccgcgccagcccggcccggcgcctcccgcaggccgcgcctcccgcacgccgcgctgccggggcttgttcctcctcatggctttgccctgacgtaattcaaacatggcaacagttcgacttcaaaggcgaacccacagacctcccagacacaggctcccgggccacgagaaaccggccgagcagtccgggccaagctccccggaaccctcggccgtcgcaacccccgacgccagggctgaagcgccgggcactgccgcctccctcggtcgcccgcccgcacgcccggagcggggaagcacgccgcctccctacgcaccagcatggcacctcgcacaagtagcgccgccaaagtttccccacgagggggctgagggacaaaagcccctcccgaaactcgcccgaacttcgagggcctccgacctgcacggccctacgcccaggcggcggccccgagcgccgggggcccgcacgggcacatgcagccctttgttttctgtccagccgggcgctgcctacgtgcagcatcagggatgtcggagcgtttcgcaggggccggacactggacgatcaccctgggtaggggtccggaccccgcgccccgaagagtccggagcctggccccccgaccctcccctcgggagcaggcccatttaatcaaagttttgcagtgtccttgatgagaaacgcccggagtatccgccccgcacgggcggagagttggcgactttcactctgctttttaaactggcaagacgccatcatcagcaaaccacattgtcctgccggccggacctgcccgacggcggccgcatcccacggctcacgcggggctggacattcggacaaggaccagggtcgcagcccgaagcacgtggtctgtcacgtagagcacaaaaagcagtgccctgcrgagttcactgactcccgcggcgtasacaacgccgccgcctccatctccagccaagttggcttccctggccatcttacagcgcggacggccgcccataaacgggaagccctcgcggtgtcgcccacacctacgctacaggtgaacgcaccgggagcaaaacttcgggctccgaaagcaccccggacaccagaggctcttgggcgcggtccgaagagggcaggcgagtggaagacgggctgtttttaagcgaccgcgtgttgctctcattgtcgcatccgcatccctccggagttgagcaaacaacgccacgccgcgtgcgctccggcagagcccagcactgacccccaaaggccgatttaaagaccctcggccgccagctcggaagcggatggcaacttagtttccgagcgaatggcgtttattgtccaccctagtccgagggctgcagtcaactaaaccacgaggtttcacaacggcgcccgaccctgcccgcgcctcgcgcccacgcggacgcaccgaccccggccgctgcgcggtggccaacgagtcgctttcctctcgggcctttcggccgccgggctcctttccgcgagagaacactgcggcggagaaaagtcattgtcaccttcaacgtggatccctcaactccggcgactcctcaattatgcccaggctccactcacttccccgccccgagactttcggtttgcctcaaataccctccccaattaataaatacacactaaacacgagcgtaccaaagaacctggggtctgaagatcacgaaaacagcgctcccaacaatgccacctccaagacaaaacttcctgtgtgtatgtggaaggacggggggaggtgggtggaggtgaaaagagaaaaaaaaaaacactgaaatcaaagcctcgtgagacagttttgcactagaagcatggtgagagtcactcaccttccaaaagcagccgttccacgcgcaataatgtccccgaggtgcggagtgcacgccaggccagtccccctcaagcgctccctcctcctcaactgccttgtctagaaagatagtctcctgcagttctgcagttgctaccgctggccgggaaggtgtagattccgctttccctctgcgcacgcgcggctcccggcrcaaaattctcttgaatcgaacttatttgcatacgggcgcgcgcacgttgcgggctgggagggggagaagtcccggcgaccgcgcgcgctcccgaggcctctattgtccttttaaggggagaagctccgcggcgcgggaaacgcggcggccagagggaaacgggggcggggactgcttactacggcggacgtcacataaacaaacgcccccccccccggctgcaggccgcggcggagagggagaggcgaggtgggaaagggaaaggttagcaactgaggggagggctgcgctgcttggcgtgttttccgcccccgaagttgttaggggcaccattgagcgctgaaaaattgttctgaaagctgcttttgcaaaattctcacacctgtccccactgtcggtgacagaggaggtggtcttgtaagcacccagactgaatttatactaatcccacgtttcctaaattttgtttgaagttaggtttttgaagcttgtaaaaaaaaaatcctctggggccagcaaaggtttagtttttgtgcagttgtaatgagtcgtttaataaagtcccattttaacaccctagccattcgctaactcccgcttgcccttctcaaatagtaacccaacccataacaatccagttttttcctccacttcggccttaagatttcaagtctctccgaattgaatgattgttaatttccgtgggaacagtgccgctttctttaaaagactaggcattggaaagccaataacctagggacaggcatacctcctctagcagcttgtaaagggtgttccactcacccagaaataattccagtaactggtggtcttgggaatggaaaaaataacgagtgacgtacagacttttcaatgcagaatatgtaataattcaacaatctaagcgctttctagactccggaagaaaaaaactgaagtaactcttctcagattgataagaggaaaatgaaaaccgaatgattgattcgcctttgtcccaaggacacacttaacaccaacaggcagaaacccggggttaatgatagagggtggggagagaggaaggatgtttttcccagaaacttgatattggtcccaagttacaaaagtgtgaaaatcaaccataaaacttaatcatctgctgacacgtttcgctgctttcactgcagtgtcaacaatacagatttaaatagttacttctgaaatgttaatttaattcaacaggcaattcctagtacatacagtataaacccacttctgaactcctcaactaatacttctttatttttctttaggttctgtaacatactattcctgtaactgtatatgaaaactatattataaatacctgaaaagatagcctggcgtggtggtgggcacctgtaatcccagctattcgggagcctgaggcaggagaatcgcttgaacctgggaggcggaggttgcagtgagcagagattgcgccactgcaccccagcctgggcgacagagcaagactgtctcaaaacaaaaacaaaaacaaaaacaaaaaacagaaagaaaaaggacacctctcattaaaatatgagctccttaaagacaaggattttatgcctttcttacccatctttgtattccagtgcctgacacagtgcacatcagataatatatactgacatcttgcatgcattagttggctaggaaaatttttttttaatgtaataaacggctgggcacagcgcctcacacctgtaatcctagcactttgggaggccaaggcaggcagatcacatgaggtcaggagttcgagaccagcctggccaacatggtgaaaacctgcctctgctaaaaatataaaaattagccgggcatggtggctcacccctgtaatcccagcactttgggaagccaaggcaagtggatcacctgaggtcaggagttcaagaccagcctggccaacatagtgaaaccctgtctctactaaaaatacaaaaattagtggggcatggtggcactcacctgtaatccctgcaactcgagaggctgagatgtggtggcacatgcctgtaatcctagctactcaggaggctgaggcaggagaattgcctgaacccgagaggcggaggttgcagtgagccaagatcacgccactgcactccagcctggacaatagagcaagactctgtctcaaaaaaaaaaaaawwatatatatatatatatataataaatatataaattagctgggcattttcgcacagacctgtaattccagctacttgggaggctaaggcacaagaatcacttcaatctgggaggctgaggttgcagtgagccgaaatcgcactactgcactccagcctgggtgacggagtgaaactcttgtctcaaaaaataataataatggccaggcgaagtgcctcacgcctgtaatcacagcactttgggaggccaatgtgggtgaattacctgaggtagggagtttgagagcagcctgaccaacatggagaaaccccgtctctaccaaaaatgcaaaattagccgggcgtggtggcacatgcctataatcctagctacttgggaggctgaggcaggagaatcccttgaatcyaggagacagaggttgtggtgagccgagagatcaagccattgcactccagcctgggcaacaagagctaaactctgtctcaaaataataataataataataaatatataaatataattttaaaaaattaatggacattttcaaggttcttacaggtttatcgctaatcagaactttagtttacaatttttgcatttgacctaaaatgagtttggaagttatagtggtcacattggttgatatgccagccctgtccttatgacaataaaaatgaataagcttaatagctgtttctgtgttccactggtggcaaattggaccctaatcataaatttctgccttctttctaaagagaattttaacaattgtcctgggttgtctcaaatatttatttggcttatgacagatcttccaaaaataatttcaaattattatatgcctctgaaggtatgaaaactgcaaatactggccaggcgcggtggcttatgcctgtaatcccagcactttgggaggatgaagcgggtggatcacaaggtcaggagtttgagaccagtctggacagcatggtgaaaccccgtctctactaaaaatacaaaaaattagccgggcatggtggtgcacgcctgtagtcctagctacttgggaggctgaggcaggagaatcgattgaacccaggaggcagaggttgcagtgagctgaaatcacaccactgcactccaacctgggtgacagagcgagactccatctcaaaaaaaaaagaaaagaaaagaaagaaaattgtaaataccataataatattttttaaactccaattatggtttacaggagtatatatatacatatatgtaagtgtgtacacacacacacacgtaccttgaatgctttttctcttgaaagtttatgtaaagaatatttattgtggccggacgcggtggctcctgcctgtaatcccagcattttgggaggtcgaggtgggtggatcacaaggtcaggagtttgagaccagcctggccaatatggtgaaacctcgtctctactaaaaatacaaaaaaattasccgggcatggtggcacgtgcctgtaatcccagctacttgggaggctgaggcaggagaattgcttgaatccgggaggcagaggttgcagtgagccgagatcacgccactgcactccagcctgggtaacagggcaagattccatctcaaaaaaaaaaaaaattttattgtaatacagggatggaataataaacgcaaatgtgcaagcaatgcaggaattacagtacttaggatacaccgttcaggtaaaaaagtacctagaagttgcagagctactgagttaatgtagccagacttcctctgctctcaaagtataggtcaagaagtaatctgggtaagttttttaggaagggtagctacaaaattcttttttaaaattttttattactttttaatttttctttgataatcctattgcaataaacaaaattctcaaagaaaaatcggaattccatagtctttttttttaaagcaaccacctgctatttttgaacaaccaagtgcattccgaaggttcttttgtccagtttgttgcttgaacatgtcattatggatggccctacccaggcccaatagctcatgtatgggttacttttaactactactacctaaattgcccaagtgaatttttcaacgtgaaaaaggaaagaaggaaatacaagaagtaatttataatatatcaatttgtattacaagagattgaattacatcatgctaggaaaatatctgcggattttgttttgttttgtttttgtttgttttttttgagaaggagttttgctcttgttgcccaggctagagtgcaatggcacgatcttggctcaccacaacctccacctcccgggttcaagcgattctcctgcctcagccttccgagtagctgggattacaggcatgagcctgcatgccyggctaattttgtatttttagtagagatggggtttctccatagttggtyaggctggtctcaaactcccgacytcaggtaattcacccaccttggcctcccaaagtgctrggattacaggcgtgagccaccacaccctgccctgagtattttttaatgactacaatgctatgttgaactcataagtagttttcaaacattttgaagttgaaagctaactactttcttataatgtatgtctcgctgtagaattatccctaacgcttgaatttttattcctttagcaaacatttaatgatcatcactatgtgccagatagtgaaatcatttcagaacttgaggggctcaagcctctctaattcatttctatataattctattttatttgctcctttttcttccgtagaatgtgttgccttcttttgagatttattgtcagccactttagaattyaatattcttggaatggaggataaattatatataaaggattgtagaagaggacaaatcttgcttgattatgaaggacattgctagcaatttagtcatgtttgtaatgacaaactaatgattgtttttaaaataaaggcagataccctcatcagcggctggtaccaaccacatgaaaacatgtttgccaaacccaggaaagagctgatgattattattaagcatagggtttggttcctctttttctcacaacaaaacaagtacagtgttttaataatttgtttaaatctctttgaagttcaaatagcaagccgtcagagcaaggcagataagtttacactcgaaggtatagcctggattatgccatctaagttaccccaatcctccaacaagtgtcgacagctgccagaaaaagttatttattacttaatcaaaattaacttttcaaatttctggacataamagcttaaagaattatcaaaaacttattcttagagtatcctgaacttatagaaatcttgttttataatagtatcttatgacatttgaacagcatgattttatttatttatttatatttatatatttatttatttttgagacagagttttgctcttgttgcccaggctggagtgcaatggcatgatcttggctcactgtaagctctgcctcccaggtccaagcgattctcctgcctcagcctcycgagtagctgggactacaggcgcgcacccctaatttttgcgccctgctaatttttgtgtttttaatagagacagggtttcaccgtgttggccaggctggtctcaaactcctgacctctggtgattcgcccgcctcggcctcccaaagtgctgggattacaggcatgagccactgcacccggccagcatgcttttaaaaaataaaattaccagtaacaaaaataatttttcgttaagaagaatattgaaaaactagaatgagttcacagtagggtaaatcaggacaatgaggaaggatggaaaccatagcataaaagcaataatagaaggaaggctgtgtttcgattgagtaagagggcaatctttgactatctgaaggattgtccttagtagagggatggacttgttttatcctttggaacaaaattagtcttgaaaatcaaaagaatgatgctaaacatgataaaatttcccagacatacaaatagtccaaggatggttcaggatacttccaaaggcagctcctcatcactaaacaaacagataaaatcaagataatgcttttaaaaattcattcaatgaattgcattacttacaatatgaagctagctaacctctctgaactcctgttgaattttatgaatctttgattgcacggaatagactagtgataccatcaataatgtctcaaggtcatgaggtgtttacatcactgtggccacagaataaagtgtgagaaataaaagaaaaaaaaagtaagtaccagggacttaaccatgtatggcaaggggatcagatctaatctggaggtaagagaaggcttctttgaggaagtgacattgagatattagtaggattcgatggagaagtgggagagagggaaagagtgttgaaccagtggcaacttcaggaacaacgggtgttagaaaaagacaagactaagagaaaaaaatgtgtctttgactaaataaaagtcagaataaaagattgcaaatgagtcctgtttgagggaaaagatggtatcaggtgttggagacagagatttaagccctgtgaatttggaagttacatcggagttggacgtaattgcatgccaaaagcatacctcagagatgaacccctataattaggttacaaatggtttaatcaatgtatgtttcttctaccaaaatttagttttctaaatgtcaataagaagttgatccccaccgctatccccaggccaggtgcaatgtctcaggcttgtaatctcaacactttgggaggccaaggaagagaatcgcttgagaccaggggtttgaggttgcagtgacctatgatagcaccaccacacttcagcctgggtgacagagcaagactctgtttcaaaaaaaaaaaaaaaaaagaaaaaaaaaagaagaagaagaagtggaagaagaagaaggagaaggagaagaagaagaaagaaaaaaagaagctgatcccccagacatagagttcacttcctggaaaacccactgttctaactattcaaggcatcactaaaggcaagcatgctacatcatcaacagatgatgaacaagtgaatgagtggacacataatagtcaaagagacatgctgcattgccatttctaaaagctttggtgataaaatattgaggaatctggaagaacttacttattgatttaattttttttagtgacaacatctcaccctgtcacccaggctggactgcagtggcacaatcatagctcactgcagcctctaattcctcggctcaagtggtccttctgacttagcctccagaatagctgggactaaaggcatgcaccaccacacccagctaattattattatatttttttgtagagatgggatcttgctatgttgcccaggctggtttccaactcctggcctcaagcaaccctcccacctcagcctcccaaagtcttcggattacaagtgtgagccaccatgcctggccaggagaacttaatatattgctgacagttaatttaaaaactttcagccaggcatggtggctcacacytgtaatcccagcactttgggaggccaaggcaggcagatcactagagttcaggtgttcaagaccagcctgggcaacatgacaaaatgccatctctacaaaaaatccaaaaattatctgggtgtggtggcacatgcctgtagtcccagctactcaggaggctgaggtgagaggatggtttgagcccacgagtgcaaggccagcttgggcaacatggcgacaccctgtctcaaaaattaaatatttatatcaaataatgtttttagcatggagtgagggaactcaaaggacttgaaagattaataaatttaactacataaaaatataaaatttgtaaaataggagaaaataccatataaagaccaaaaagtcaaactattaaaaaaaaaaaacaaaaacactgcaagataaggggataatttctttgttgttgttgttgtttgagacagagtcttgctctgtcgcccaggctggagtacagtggtgtgacctcggctcactgcagcctctgcctcccagcctcaagtgacccttccacctcagcctctggagtagctgggactacaggtgtgtcccaccatgccaggctaatttttgtatattttgtagaaacaggttttcccatgctgactaggctggtcctgaaatcctggggctcaagcaatcctcctgcctcggcctcccaaatgctgggattacagttgtgagccaccacaccagacccaatactttcttaatatcagtaaagtagaagtgataaagtatcagtgaaattagtttacccaaaagaatgtaaatggaaataaacatgtaagaagatctggactttattcataatagttttggccaggcgcagtggctcacacctgtaatcccagcactttcggaggctgaggcaggcagatcacgaggtcaagagatcgagactatcctggccaacatggtgaaaccccgtctccactaaaaatacaaaaattagctgggcgtggtggtacacgcctgtagtcccagctacttgggaggctgaggcaggagaattgcttgaacccaggaggcagaggttgtagtgagctgagattacaccactgcactccagcctggagacagagtaagactctgtctcaaaaaaaaaaaaaaaaagaagatgctgaactttattcataatagttttagaataataaaattgtttctaaactttgtaacttaatgcattattattgttattattgggtttttttgagatggagtcttgctctgtctcccaggctggagtgcagtggcaccatctcggctcactgcaagctccccctcccgggttcctcagcctcccaagtagccaggactacaggtgcccaccaccacgcctggctaatttttgtattttgtttaatagagacgggtttcaccatgttagccaggatggtctcaatctcctgacctcatgatccacccaccttggcctcccaaagtgccgggattataggtgtgagccaccgcacctggccacttaatgcattattttaatgtaaattgaattgaccactttttaaatgatggaacacctaaatggaattctataccactgttacagagaataagtctgctttatatatgctgacatagaaagatagtcacaacatattaaatggataaaaagcaatttgcaggcagggcacggtggctcatacctgtaatcccagcactttgggaggccgaggtaggcagatcacctgaagtcgggagttcaagaccagcctgaccaacatggagaaaccccatctctactaaaaatacaaaattagccaggcatagtggcgcatgcctgtaatcccagctactcaggaggctgaggcaggagaaacacttgaacccaggaggcagaggttgcggtgagccgagatcacaccattgcactccagcctgggcagcaaaagcaaaactctgtctcaaaaaaaaaaaaaaaagcaatttgcaagctgggcgtggtagcttgtgcctgtaatcccagcactttggaaggccgaggtgagtggattgttcgagcccaggagtttgagaccagcctgggcaacatggtgaaaccccatttctacaaaaaaactttttaaaaaaaattagctgggagtggtggcgcaggcccatagtcccagctacttgggaggctgtagtgggaggatctcttgaatgtgggaggcggaggttgcagtgagccatgattgcaccactgcactccagcctgggggacagaatgagaccctgtctcaaaaaaaagcaaaacaaaacaaaaaagcaatttgcagaacagtaggtaaagtgtgatttcatttgaggggcaaaaaggaatatatgtaatatatacatacatgtaatatatgtacacatgcatatatatcatgtgtttgcacataaaaagtgattgcagagaggagacatatcagtgttaatcacagttgcttctgaggataaaagtaagaaagaaagtgggcaggagttacttttatttcatataattttacccacttcgggtttttgtttgtttgtttgtttgttttgagatggagtttccctcttgtctcgcaggctggaatgcagtggcagcaatctcggctcactgcaacctccgcctcccaggttcaagcggttctcctgcctcagcctctggagtaactaggattacaggcgcccgccatcacacccggttaatttttgtatttttagtagagacggggtttccatgttggccaggctggtttcaaactcctcacctcaggtgatccacccaccttggcctcccagagtgctgggattacaagcgtgaaccaccacccccggccccctctttgggattttatgagctttggtcattttggtaatataatttttttttcttttctgagatggagtttcacttttgttgcccaggctagagtgcagtggctcaatatcggctcactgcaacctccgcctcccaggttcaagtgattcacctgcctcagcctcccaagtagctagaattacaggcatctgccaccacacccagataatttttgtatttttagtagagatggagttttgccatgttggccaggctggtctcaaactcctgacgtcaggtgatctgcctgcctcggcctcccaaagtgctgggattacaggtgtgagccaccacacccggccagtaatataaaaatacttaaaggtagaaaaaaaccctattaaaatatgtaagctgggcgtgatggctcatgcctgtaatccctgcacttgaggagactgaggcaggaggattgcttgaggccataatttcaaagaccaccctggcccacatagtgagaccttgtctctattaattcaaacacacacacagagcacattaggaatacaagcaatggtagtttttttaaaacggtgtttgtattagtttaacaaatgaattactgaggtagtgttagcttcttgaacccaggattcacacctggtttggctttaaagcttccacagtatcttgtacactacctgctcatgtaaatagtacctacttacggccgggcatggtggctcacgcctgtaatcccagcactttgggaggccgaggtgggtggatcacaaagtcgggagttcaagaccagactggccaagatggtgaaaccccgtctctactaaaaatatgaaaattagctaggcgtggtggtgggcgcctgtaatcccagctactgggaggctgaggcaaagaattgcttgaacccaggaggcggaggttgcagtgagctgagattgcaccactgcgctccaacctggacgacagagcgaggctctccttctaaaaaaaaaaaaaaaaaaaaggtacctacttatataaataaatatacaaccaagaagtccataaaagctcttctttcctctacccagaactctcttccccctcatctttgatcgtttaaatcccatcatccttcgaggcctgactcgaatgccagctcacgtcagtaatggtcatggattgatttccagctctggatccagcatcgctctgcacacccacatattttatcttccttcacaataatcttcacaagaatcctgacatagatgctggtctttcctatttacataggaaaaaatgggcctttacagttatgaagcttattcagtgtcacatgtgtcataaattagtgatggagatgagataagaaacctcacctcctgacctggttcattcggaattcattctactttactccatggacttcgccctaatcgctcaaacaggaagcaatactttcttcctctcaactcttctaacacttggtgagtgcctctgaaagcacatattagtttctactttatgtttcatttatctgtgtacagcctcacatctctgtatgagaatgagagctgattctaatcatttcaatccatagatggcataaaaatcacctgtgatcttttaaaacacatttatgtcacagactgaaggaatcagaatttctacacttggtacctggctatctgcatatttttaaacctgcatagttgatgctgatgcacactaagggcttaggacagctagcttcatccaagcttgattcatctttgaatttccatagtgccttcaaatagcaaatgccaggtggggcatggtggctcacgtctgtaatcccaacactttaggaggccaaggcaggtggatcccttgagctcaggagttccaaaccagccygggcaaaatggtgaaacctcgtctctacaaaaagtacaaaaattagctgggcatggtggtgcacacctgtggtcccagctacttggggggctgaggcggaaggattgcttgagcccagggaatcgagactgcaatgagctgtgatggcattactgcactgcaatgtgggtgacagagcaattccctgtctcaaaaaaaaaaaaaagagccgggcgtgctggctcacacctgtaatcccagcactttgggaggccgaggcgggcggatcacgaggtcaggagatcaagaccatcctggctaacacagtgaaacccccgtctctacaacaaaatacaaaaaaaaattagctgggcrtggtggcgtgcacctgtagtcccaggtactcgagaggctgaggcaggagaattgcttgaacccgggaggcggaggttgcagtgagccgagatcgtgccactgcactccggcctgggtgagagtaagactctgtctcaaaaaataataataataaattaaaaagaaagaaaagaaaagagaaaaagcagataccttataagtatttgttgacttatccataatcattaattatttttataaatccaaatatggaatcagagctgcctttactggaagaaaagtctaagtgtttgggtaatagagacactatgaggatcaggtagtttaagcaatgtgggggtggctagtgggtgaactatgaggattaaaggtgccggctgggcactgtggctcacgcctgtaatcccagmactttgggagggtaaggcgggtggatcacctgaggtcaggagttcgagaccagcctggccaatgtggtgaaaccctgcctctactaaaaatacaaaaataagccaggcgtggtggcaagcgcctgtagtcccagctactcaggaggctgaagcaggagaatcgcttgaacccaggaggcagaggctgcagtgagccaagatccgccactgcgttccagcctgggtgacagagcaagactctgtctcaaaaaaaaaaaaaaaaaaaaaaaggtgccacaaaggtgtgctcagaaacagccgtaagaaatgaggagaccaggcttatcaggtcatcgcttaggctagcagctgccctttcaaaatagctctgtgctttcttttccttttttttttttttttttttttgagacagggtcgtgccttgtcatccaggctggagtgcagtggcacaatcacggctcactgcaacctccacctcccaggctcatgagatcctctgaccttagcctcccaagtagctgggactataagcaycatgcaccaccatgttcagctaatttttaaattttttttgtacagacggggtcttgctatattgcccagactggtctcgaactcctgggctcaagcgatcggcccacttcagtctcccaaagtgactggagtggagttacaggcatgagccaccacacccagcctggcctttctttttctttgaaggttactctaattttcttacttttattttcttctttattattattttttgtttctaataaacattgagacagccttcaaagttaccctaattttatccagattacatctgcttaaaaattgtacgatatatttgaaggataaagagtttgccttggctccctcaaattctctgaaacttgtaagatagtgaaacaggactagatcctactggcagtgctttgagaaagaatgaattgatatgtgaagaggaaggagacttaaggggaccacggctggaatgtggtcaaacaggacggaccacatatgcaccataaaggctgatattcctagtctgaggaattgcctattcaaggaatcatttttggtgatatatctgcctagtagccaaatactctgataagaacaaaaacccgtgtgtgtgtstaagattagctgatgcttcacttttctcaatgttttatattgcatattatcataagaagtctcactggatcaggccgggcgccatggctcacactggtaatcccagcactttgggaggccgaggtgggtggatcacctgaggttaggagtttgagaccagcctggcccacatgtcgaaaccctgtctctactaaaaatacgaaaattagccaggtgtggtggccggcacctgtaatcccagctactcaggagactgaggcagagaatcgcttgaacccaggaggcggaggttgcagtgagccaagactgtgccactgcagtccagcctgggcgaccaagagagactccatctcaaaaaataataataataaatagatcagttaatagggttgaaacaaacaaaaatggaaatatataaaaagaaacaaaaacgaaagaaaagaaatctcattggaaatctcactggagatttttgcataaatttgatccaaaatggactgctcttattacataaggattatagagctgacccatgattagtaaagtatatgcttgagttgtttttcgtaataatattatttcataatatcattaattaatatatttgtgcacatactctgctatatgataaggatatacaatattataaaatatacttcccagactgggtgtgttggctcacacctataatcccagcactttgggaggccacggcaggaggccgtgtttgagagcagcctgggcaacatagagagactgtgtctctacaaaaactttaaaaaattgtcagggcatgatggcatgggcttttagtcccagatactcaggaggctgagcggggaggacctccccgcttragcccacaatgcagaggttgtagtgagctgtgatagtgccactgcattccagcctgggtgacagagccagaccttgtctaaaaaacaatagagtaaaatatacttcctatccttaatgggcttccagccccaagagggagacataacagttatgtaaaaagtaaataccagctgggcacagtggctcacgcctgtaatcccagctctttgggaggctgaggcaggcagatcacgaggtcaggagttcaagaccagcctgaccaacacggtgaaacccatctctactaaaaatacaaaaattagccaggcatggtggtgaccacctgtaatcccagctactcaagaggctgaggcaggagaatcacttgaacccaggaggcagagttgcagtgagctgagatcgcgccattgcactctagcctggccagcagagcgagagtccatctcaattaaaaaaaaaaaagtatgcataagrtactaagggaggccggcatggtggctcacgcctctaatcccagcactttgggaggccaaggcgggcggatcacctgaggtcaggagttcgagaccagcctggccaacatggcaaaaccctgtctctactaaaaatacaaaattagccgagcgtggtggcgcatgcctgtaatccaagctactcaggaggatgaagctcgagaatcrcttgaacccaggaggcagaggttgcagtgagccgagatcacgccattacactctagcctgggcaacaagagtgaaactccgtatcaaaaaaaaaaaaagaaagaaagatactaagggagcacagagctggaatacttgggccagctagtattcagagaaggtttggagaaagtgctgcttgagtggatctggaaggatgaaaatgaagttgtcaggtgaacaaacatgggcagggttttctaggctgcaggaagagcaaaagcaaaagcccataagtggaaaaatgttaaaaagcatgccatgttcaagaaacatgcagatttattacagtgtcaagtgcatgattggatttttggaggatgagtctggccaggtcatgcagggcctgtaagccatgttaaagaacttggacttaagctgtaggcagagggagctgttaaaagcatttaagcagaggagtgacatgatttgtttcatgtgtgtaagtaattctagatgtagtacagaggacggataaaaaaataagactgcaggcaagcagattccttaaaattgyattcctatagttttgtcaaaatactattgagggccataactagataaggataaagaggacagatctaggaaaccaaggcagatttttaaggagggaaaaggaggacttggttattgactaaacatatatgaaggagagcaagagatctaatttccgtggttctaatttggtttttgtttgtttgttggctgagttttttatttgtttgtctttagacagcatcttgctctgtcactccaggctaatgtttttgttttgttttgttttttgacacaaaatctcactcttatsccccaggctggagtgcaatggcgtgatctcagctcactgcaacctccacctcccaggttcaagcgattctcctgcctccgcctcctgagtagctgggattactggtgcccaccaccacacctggctaatttttgtatttttagtagagacagggtttcaccatgttggccaggctggtctcgaactcctgacctcaggtgattctcccgcctcggcctcccaaagttctgggattatggcataagccaccatgccagaccctcgggctaatgttttttatgtagagacgaggtctcactacgttgcccaggccagtccctaactcctggcttcaagtgatcctcccacttcccatgtttctaatcttgatggtggtcacgtgaactaagtttgagaagctaggaaatgaacaggttttgggaggaggatgatcagatctgatttggggaagggaatgagagagaagagaagctagagaggaatgaaagatcaaggaaagttttttgttagtgtgtttgttacgttttattgtgtgaataacttgaacatgttcataggcttggacgtagggttgtattctattctgcatgrtaggaactcagtaaatattttttgaaaaaatgaaaagattgcgaagccgatgcaggtagatcatttgaggtcaggttttcaagaccagcctggccaacataatgaaaccccgtccctactaaaaatacaaaaattaggcggtagtggcacgcacctgtaatcccagctactcggtaggctgaggcaggagaatcacttgaactcggaaggcagaggttgtggtgagctgagatcacgccactgcactccagcctggatgacaaagtgagaccctgtctcaaaaaaataaaataaaataaaataaaaataaaaataaaaaatggaaagcgttgagaggaagaaactagagataaagagaatatgactgaaaaagcaaggtccccaggaaaaccatatgcggtcgtgtcttagtctgtttgggctgctataacataataccataaaatactgggtggcttataagcaacagaaatgtatggctcacagttttggaggctgggaagtccaagatctgagagccagctttgttgggttctggtgaatgctctcttctggattgtggacttcagacttcttgctgtgccctcacatagtagaagggactagctagctctcttgagcctcttttacaagggtcaggatttcaacacataaatttggggaggacatgaacattcaaaccaaagccagtagaattaggagcaaaggtggatgacttggtcttggtcttgagcgatagaaggatatttcaggyctggcgcagtggctcagccctggcgcagtggctcagcactttgggaggccgaggcgggcagatcacttgaggtcagaagttcgagaccaacctggccaacatattgaaacctcgtctctactaaaaatataaaaattagccaggtgtggtggtgtgcacctatagtcccagccacttgggaggctgaggcaggagaatcgcttgaacctgggaggcagaggttgcattgagcccagatcgcaccactgcactccagcctgggaaacagagagtaagactcaaaaaagcaaacaacaacaataaaaaaagagtagtgtggtctgggcgtggtggctcacgcctgtaatcccagcactttgggaggccaaggcgggtggatcacgaggtcaggagttcaagaccagcctgaccaacatggtgaaaccctgtctctactaaaaaaatacaaaaattagctgggcatggtggtgcacgcctgttattgcaactactctggaggctgagacagaagaattgcttgaacctgggaggcgcggaggttgcagtgagctgagatcgcaccactgcactccagcctgggcagtggagtgagactctgtctcaaaaaaaaaaaaaaaaaaaaagagtagtgcgatgtgtgtctttcagggttttccaaagaaacagaaccagtaggagtatatatacactcttattatatatctatatgatatatagagtaagcaattgtaggagcgaacaagtctaaaatttgtagggcaggccgacaggctgcaagctcagaacttgggcaggaggtgacactccagtcttgaggtctcgaggcagaatggaaacctcagtttttctcttaaagttttttttttttttgagacaaattctcactttattgcccaaggctgaagtgcaatggcacaatcagctcactgcaacctccgcctccctggttcaagagattctcctgcctcagcctcctgagtacctgggattacaggcatgtgccatcacgcccagctaatttttctgggttttgtttgtttgtttgtatgtttgtttgagacggagtcttgctctgtggcccaggctggagtacaatggcacgatctcggctcattgcaacttccgcctctcgagttcaagcgattctcctgccctcagcctcctaagtagctgggattataggcacccgccaccacgcccggctaatttttgtatttttagtagagacagtgttttaccatgctggccaggctggtctcaaactcctgatctcaagtgatctgcccacctcggcctcccaaagtgctgggattataggtgtgagccaccgcacccagctcattatcacaaactttcttatctcctgtttgttctcctgaaaacccatttatttttccaaaatggtcatttgttttctcacaagtgcctttctctccttccccttcaccaattaagatggcatataagccccaaattctagccacccctttgaattagtcatcacagaattctcccatctgtatacaccttgcacatgtgagtgtgaactcttttttatttttctcctgttaaggtatcttctgtgagtttaatatgcaggccctagctactgaatctaagaaactgagaagtggctgggttgggggctcatgcctgtaatcccagcactttgggaggccgaggcgggcggatcgcctgaggtcaggagtttgagaccagcctggccaacatggcgaaaccctgctcctactaaaaatacaaaaattggctgggtgtggtggtgcatgcctgtaatcccagctactgaggaggctgaggaaggagaatctcttgaacctgggaaatggaggttgcagtgagccgagatcatgccactgcactccagcctgagcaacgagagcgagactccatctcaaaaaaaaaaaaaaagaagaagaaaagagaagaaaaagaaaaaagagcaagaaatgatgtgagaaatttttctgaaacatgagaggattgccgtcttcctttgggcagggacacgctgactggttaaggcacttgcttcaatcaatcgaaatgtaagcaattaatgtaaccgcgagcacagatttacaagctttctccatttgacataagatttatttatctgggttggtgttttcctgagtttcatttctatttttaggtttgagtttctttctaagggacatgtggatacgacttgtaaattataagcttggcgttttggcaactgcaataacaaaaacctgaagcaagaagattaaaaaccccgcctggcctggacgcacttcacttactttgttagactggtaacttcttgccaacagaaacttaaagaagcactttctgcaattaatatggtaactaccattaatggctttgttttctccagacaagccaacagcactggcattagtctttagtctcgatgaactggttctgagaaatgaaaagcatgggagacagaatagcacccagcagcgaatctagctgcaaaatgctttttggtcctccaaggtgaattaaaaccttgaacttagaagccgatatgacagactttatttaatgtgtcagaaatgactggtgacacaagctttgtaacctccagtccaaatcttactaaacatgcagaccactctccatagcccctggggcaccaagcctcagggacgcccacagctccctggctctccagatccagattggtggcacttcatcctctcccaaaatacttcccttggattcttcatacctcaaggggtctctaacccactttcctacatgcagctgcagacctacagctaaggtgggactgagggagggagagaatgaatgttcgctattgggctctagtaccaagtacgttatctactttatctccttacctcacactatccctgtaaactaagcattattcttatcatcctcattttatcactgagcaaaatgagcttgagagaaatgaagtaacacactgccagtctcacagctagtaagtggtggaaatgggctcctactcaggaccttttgaattcaaacatggcaggcttcattaatctgcattgtaaaccaggattttacctacttagtttataccagataatttcctgagaaagagttgcctcttcccagtttgtctgtactaagtgtgtgtggaggagtccgacagcttaaccacgcagtgaacgtcccccaagacattttgtacttagtgccaacaagggaggatcaacctgggctttaatctccttggtgtgataagagagacatggaccatttaataagtgtagtgctgaagttagggggtgcaggtaggcacagcagccccggaggagatgaggtcctggctcacaggtcctgagttcccagatagcacaatgagctgccagttcccttccagcaccagaagtaacatatcacagggcaacgtggctttacccttctccaggagagtttcgtacccatggtctcacttaaacttcaaacactatactcagaaaataaagtggcaaggaaacattatttttctttctttctttcttttttcttttcttttctttctttttttttttttttttttgagacggagttttgctcttgttgcccaggctagagtgaaatggcacgatctcggctcactgcaatctccgcctcctgggttcaagtrattctcctgcctcagcctcccaagtagctaggattacaggcgtgcaccaccacacccagctaattttttgtatttttttttttagtagtcacagggtttcaccatgttggccaggctggccttgaactcctgagtttgggtgatccacctgcctcggcctcccaaagtgctgggattacaggcatgagtcaccgcacccagcctgagccaccatgcccagccttttttttttatgtttgagacagtctcactctgttgcccaggctggagtacaattgcatgatctcagctcactgcaacctctgcctcccgggttcaagcaattctcctgcctcagcctcccgagtagctgggattacaggtgcctgccaccatgcctggctaatttttttatttttagtagcgacagggttttaccatgttgtccaggctggtctcaaactcctgacctcaggtaaagcctcccaaagtgttgggattacaggggtgagcccagcctgaaacttttattctacccttcactctgtgtgctagaaccagaagagtcatcttatcagcctgttcctggctaattgcagttaataaatgcataatactagtctgagtgtccacaggaaccagactgtttcttagtctcccttgaacttgtgaggacatgagctgaataatttggagtgacaattgatctatgaaagattcccaaatgacaaattcaggaaactcacaagtgccatttggagatggtggtaccccctccactccactgaggaagctcttgaatggccatcagaagtacttctgttggccaaatccagtaaaaatttttctgtttatttattttgtttgtttgtttgttttttgtttttttttgagatggagtcttgctctgtcacctatgctggagtgcagtggtgcgatcatggctgatggcagcctcaacctcccaggttcaagccagctccccacctcagcctcctgagtagctgggaccgcagttgcaagtcaccacacttggctaattttttgtagccatggggtctcactctgttgaccaagctgacctcaagttcctgggctcaagtattcctcctatcttggcctcccaaagtactgggattacaggcacaagatatcatgcccagcccaataaacatttttctttcttttttttttttttttgagaaggatttttgctcttgttgcccaggctgaagcacaatggcgtgatctcggctcaccgcaacttctgcctcccaggttcaagcaattctcctgcctcagcctctcaagtagctggaattacaggtatgtgccaccacgcctggctaattttgtatttttagtagaaatggggtttctccatgttggtcaggctggtctccaactccagacctcaggtgatccgcccaccttggccttccaaagtgctgggattagaggtgtgagccaccgcgcccggcaacatttttcaatcttcatcgtactggaggttagcaattcacacatgtggccagtggctccttataacactctttttggtacctgtgacactatactctcttggattttctgccacctgtctggctgtaccttttccattttctttgttaacttgctggcttgtgcaacaattaaatgtagtgagttcctctgatgtcagtccctgggtcctcttcttttttcattgtatactttctgcttgggcagtctcaccccttcctattggttttttcagtgattcacacatttataccaccaacctagttttttcatatatcatgagatacatatatccaactagtgtttaatatctccacttggaagtcctacaggcatctgacacctaaaatgttaacactgaagccggtctttgatcttcattacccttctcgttgcaacatccttcattatttctcaactcagctaatggcaccaccaactcccagaagcacaagacagtaacctggaagccatccttgatagctctctctccgtcacctactgcatctacaccatgtctagtgtcatcggttctatctccaacatgtctcaaatccatacttctctgccatcacctgktccaaactagcatcttctctgccctaacctatcgcctataacctcctaactggtctctcttctcttttgtccttcttccattaattctcttttttaaaggtaattcagagcaagaattaacattcttcagtagctttccattgcactagggtagaatctagaatccttactcaggcctttgcctgtctctctaggatcttttcaagccgttctgttccttccctaactatgcttcagccacacttctccttcatttatagtcaagctctttctgaccacaggacctttgcatacactgtttcctttgcctggaattctcttccctcctcttgccttgctttgccattctccttccccatacactagttgcctggctaacttctacttgccttcaggcctccatattctcccctcagagaagcctttcttaactttccaatctaaaataggtccagctgggtatggtggctcatgcctgtaaacccagcactttgggaggctgtggtgggaggatcacttgagaccaggagttccagatcagcctgagttacataggaagaccccatctctataaaaaataaaatacatcccttcttgtccttctttctcatagcttttcattcataatgtttactacagtttgcaattataattgtacattcattgatatgttaatttgttcagtatcttttttccccatagactgaaagttccctgggagcacaaatcacatgtcttttgtgtactgcagtatgcccacycccacttaccaaagtgcctgagacatagtaggcctttaataattgttgaatgaataaattaatgtcctcctgataggcatacttgatggtgaaactagacatcagagcctgatgcaagtaaatatttaagtcagttatatagtttggctgtgtccccacccaaatctcatcttgaactgtggttcccataatccctacatgtcgtgggaaggacccagaaggaggtgattgaatcatgggggcagtgaccctcatgctgttctygtgatagtgagtggattattttcccgggctttgctcagcacttcttgctgccgccatgtgaagaaggacacctttgtttccccttctgtcatgattgtaagtttcctgaggcctcgccagccatactggaactgagttaattatacttctttcctttataaattacacagtcttgggtacgtctttattaccaacacgagaatggactaatatagtcagcttgtttagacccctctggctgggattctaggctcaccaaccagctttttgataatttgccttttcttttcttttcttttcttttttttttttttgagacagagtctcgctctgtcaccaggctggagtgcagtggcatgatctcagctcactgcaacctccgcctcccgggttcaagtgattctcctgcctcagcctccagagaaggtgggactacaggcrcgcaccaccatgcctagggaatttttgtatttttagtagagacggggtttcaccatgttggccagaacggtcttgatctcttgacctcataatctgtccaccttggcctcccaaagggctgggattacaggcatgagccaccacactggccgataatttgccttttcatttttaatttaaatagcctcaggtcccacagaggctgtaattgagctttaacacgcaaattcctgatatgttggctctcttagagagccacaggcctcagctcctgaaggatccccaactacttctcagggtccacttctccacccagccctctgctcctctggaaagatgtatgtctccagggtctctcctctggctttcccaaatgataaagccctcaaggatccacttaatgctctgtccctttcatcctcactatgctacaggtttgtcctaggaccgtttttgttccaaaaactcaattcaagctagttgaccacaaagaagacctggttaattctcataaccctggatgcgccagggccaaaccttaaggaaaactgtaatcgagaacctctaagctatccggctcctgccctctgtctctcgtctcagctgctctcctcctgttggcttcatcttctcttttttcagacaacttctctccatgttatatttggggatgtagctgctgcagttccaaggttttgtgcccaagtcccacatcccagacaggaaagagccttcctccacaggtctatttagaaaaatctgagggaaggtcattaattgatcagtcacatgcccagcttgggttacctctcagtcccgtgtggccaagggtgtggactcacaggtttggaaaggtgaggaagagtttcccgtaggaagggaggagggaggtgcagtaccagcagaagagaaaagatgtgaggcagtgttagcagatgcccactacactatcgttcatgcagaaataatgagattgcctttatgacttgaattgtgtcccccaaaaagatacgtttaggccatgtgtggtggcttacacctgtaatcccagcactttgggaggccaaggcaggaacatcacttgagcctaggagttcgagaccagcctaggcaacatggtgagacccccgtctctacaaaaaatttaaaaatgagctgggtgtggtggcaggagcccatggtcccagctactcaggaggctaaggagggaggatcacgcattcagaaggtcgagactgcagtgagccatgattttaccactacactgtagcckgggtaatagagtgagactctgtctcaaaaaaataataataataaaataaaacatatgttaactttgctgctaattagtttaagattctgaatttgcaaaggcaaagaccaaccttcctgggcctgtctggaggtgtctaacagaaagctggatgactagatgatagctgtctccatgatatcagcttgttcctttccatggataaaatggattcaggggccgggcgaggtggcttatgcctgtaatcccagctactcgggaggctaaggtatgagaatcgcttgaacccgggaggcagaggtttcagtgagctgagatggtaccactgcactccagcctgggagacggagcaaggcattgtctcaaaaataaaaaaataaaaaataaaacaggctgggcacggtggctcacacctgtaatcccagcactttgggaggctgaggcaggcagatcgtgaggtcaggagttcaagaccagcctggccaaaatggcgaaaccctgtctctactaaaaatacaaaaattagctgggcgtggtggcgggcgcccgtaatcccagctactcggcaggctgaggcaggagaattgcttgaacctgggagacagaggtttcggtaagccgagatcctgccactgcactccagcctggcaacagagcragactctgtctcaaaaaataaaataaaataaaataaaatggattcaggtgataacactctttcctgcctacggaccctgtccctctatcctaagaggtgtcctctgattgaggattaggactaaacatggctgtttcccacttcatccctcatggctgctgtaatttttattttatctttatttttatcctacagaaagtaaaatactcccaatagattaactctactattacgtagttgtttcttcaaatgcccaagaatacttgtccttgggtataatttttttgtacccctaagtagttatgagtgtctgtttgtgtgcatggatgctttgcttcaaatgagttgcttttacaatgtgataaccttgtgccatatgttgggcaactatcttggccataattcacaggcaactgacacattaatagattctctgcccgttctcattgtggagattctgtgttagtggcctttgtcttccatggaactgacagaggggcaggattagctcactgacgctcggaacacaagtgacgagggatttcatgaaaacaaagccaaacaaacgaggcagcttccacgggcacctggctgaataaattaaacttgattgaatcctctattgtaatgacgacagaaaaggaggtaaaatatgccttccctaatgagtttctttacagtcatttactatttaaaacttgctattccaggaaagcagcaatcgcgtaagactgctttgactgggtcttgaaggctctgtaaaatctgtgggctcacagaaggattttgcatacttcctgcaagcatagttactggacaatgttgcttcaaagccaagctagcaagggaaccctatactctcttcctcttggcctgccctaggttctgagtggtcacatgaagatggcctcaaagcagaagaaactaaatgtgccaagcagggaaaagtctgaatcgaagtaacagtctaaaaaaggctataaaaataggaacaatgtaggtgcagcttttacatgaaagaggaagaaacagcaccaagatttactaataagcttggcacagagaaacactgctggccaggtgtggtggttcacagctgtaatcacaacactttgggaggtcgaagcaggaggatcatttgaggccaggagttcragaccagcctgggcaatataatgagactggcccatcactacttaaaatgtaaacatttagctggggatggtggtgtgctcctctagtcccagctactggggaggctgaggcaggaggaccacttgaaccccagaagtcaaggctgcagtgagctaagatcatgctactgcactccatcctgggtgacagagcaagaaccctgtctctaaggaaaaaaatagaaactgctgtcattgaatttaacattatctatgggtctttagtttgycatgaattgtcatcagcagtcagcatgagatacccaaatacaaaagtacaaaggaaaaaatacttttcactttgtaaaactgaacgcacacagcattacaaaagtgccctttgagggccgggtgcagtggctcacgcctgtaatcccagcactttgggaggccgaggtgggcgaaccacgaagtcaggagttcgagaccagcctggcgagggtggtgaaacccctctctactaaaaatacaaaaattagccgggcgtggtggtgcgcacctgtagtcccagctactcgggaggctgaggcaggagaatcacttgaacctgggagacggaggttgctgtgagccgaaatcgcaccactgcactccagcatgggcaacagagcgagacatcacctcaacaacaaaaaaaagagtgccctttggaaaggtgaatgtctrcatagtgtgagtttaatggagtcacatttgtctaaatagaaattcctctcaacctgtcattgcactctcttgccactgtgaacgtccaccaatagtgtcccatttgaaatatacaaaggcagtaacgtaggccccagaaaaatagggttaaaatatactgggattaaaatgttgccgaggagtcaaatgggtaactgaggttagcgttgacccattagtacatgttaggcagagaattagctattcaccttggtgtagaattgatgtttgatttctttgtgggatcagagggcccacccctaacaggaagtgaccaagggtcatgtagagtagaataaacaaagcatgtgaaacagcatgagaggcacagagaggcagcgtgtgtggtgagaacacttactgaacacattacagaaaattattattactgccgcttcctaagctgtaaacttttccaataaattaactaagttttataagcctcagtgtcctcatctgtaaaactagggtcaccatagcactgtcttgagattgttgtggaagctaaatacaaaatatattactgagctattttgccattgaaagtaatggcaaaatccacacttttggaccaacctaaatatataaacatgagcatacaagacctggaatgcactttaaaatgtgtactgccaaagctgggcacagtggcacgtgtctgtagtcccatctgcttgaaaggctgaggtsggaggatcgcaggaacccaggagttctgggcagcagtgaacagtgactgcgattgtgagtagccttcactacggccgggcaacrtaacaggattctgcctctaaagaataataaacataaaattaacttcctacccactgtctttcagggcaagccataactgtgaagggaaacaagttaaggaggacaactgactgcctaaggaaggttctggagtgtggacaaaggtggagatggctacttccactgattaataaaagccttctaggccaggcgcggtggctcatgsctgtaatcccagcactttgggaggctgaggcaggcggatcacctgaggtcaggagttcaagaccagcctgaccaacatggagaaaccccgtctctactaaaaatacaaaattagccgggtatggtggcacatgcctgtaatcccagctactagagaggctgaggcaggagaatcactttaacctgggaggtggaggttgtggtgagctgagatcacgccattgcactccagcctgggcaacaagagcgaaactccgtctcaaaaaataaataaataaaataaaataaataaaataaaataaaagccttcttcatgtcactattataaacagtacaaaccctcagctgctacttttggcaaactttttttttttttttttcctgagatggagtctccctccgtcacccaggactgagactggcccaatcttgcctcactacaacctccatcttccaggttcaagtgattatcctacctcagcctcccgagtagctgggattacaggtgcacgccaccacacccagctaatttttgtatttttagtagagacagggttttgccatgttggccaagctggtcttgaactcctgatctcaggtgatctgcccacctcggcctcccaaagtgctgggattacaggcgtgaaccaccatgcccggccttggcaaacttttgtaaagggtcagatagtaaatattttaagctttgcagtaaatatttttactcactattgcaactactcatgccagacattgtagcaaaataaaaagcatttcataggcaatatataatatataatgcatgagcatggcagtgctccaaaaaaacttttttttttggagacagggtcttgctctgtctcccaggctggagtgcagttgtgagaccatggcccactgcagtcttgacctcctgggctcaagcaattctcctgcctcaggtcccagaatagctgggactacaggctgcgccagcacaccccactaaattttgtatttttagtagagacagggttcagccatgttgcccaggctggtctggagctcctgggttcaagcaacccacccatctcagcctctcaaagtgctgggattatagtcgtgaaccactacgcccggccattttttttttcttttcagataggatcttgctctgtttctcctgctggaatgcagtggcacaatcatggctcactgtagcctcgacatcccagactcaagtaattcacttcagcttccagagtaggtgggacaacaggcgtgcccactgagcctggctaattttatttttgtagagatggggtctcactatgttgccaaggcaggacttgaactcctgggctcaagtaattctcctgcctgggactcctgaagtgctgggattacaggtgtgagccactgcaccctgcctccaataaaacttaataaatactaacagttacttccccaagcattgaaaactcttctacaacatgagttttaatgatggcataacagtccatatagattttcatgatttatttaacaaagtctttaatgttggacatttagtttctctttatttgcttacctcaatcggtactcataattattttgtaacaatttctttttttagacggaatctcgctctgtcacccaggctggagtgcattggcgagatctcagctcactggaacctccgcctcccgggtacaagcgattctcctgcctcagcctcctgaacagctgggactacaggtgcccgccaccacgcccagctaatttttgtatttttagtagagatggggtttcmccatattggtcaggctggtcttgaactcctgaccttgtgatctgcccrcctcggccacccaaagtgctgggattacaggggtgagccaccatgcccagcctatagaaattatttttaaagtcgggatgagaaaaaaaaaaaaagaaaaaagaaagtggggataagaaaaagaaaaattgctcatagaccatttattcagagattataactgccctcctcattattatatatgcttttcaggcttatgattacctttattatttatttatttatttatattttttagacagagtcttgctctgtcatcacccatgctggagtgcagtggtgcgatctcagctcactgcaacctccacctcccaggttcaagtgattctcctgcctccgcctcccgagtagctcacattataggcacgtgccacaatacctagctaatttttggttttgtgtgtgtgtgtgtgtgtgtgtttgtttttgtttttttttttttttgacggagtctcgctctgtcgcccaggctgtagtgcagtggcatgatcttggctcactacaacctccacctctggggttcaagcaattctcctgcctcagcctcctgagtagctgggattataggcatgtgtcaccatgcatggctaatttttgtatttttagtagagatggggtttgaccatgttggtcaggctggtctcaaactcctgacctcgtgatcgcccacctcggcctcccaaagtgctgggattacaggcatgagccaccacgcccggcctaatttttgtatttttaatagagacaggctttgccatgttggccaggctgtattatcacctttaaataaagctggggttacactgtacatcctatattgtaacctgaattttcacttcaccacagtaatgaaggtcttctccccttctgaggtcctaaacttagaattgctggtctctgacttccattattctagttttacttctgtcttcccactgtctcacatctactcccataagggagaccacactgaccatctgctcctcttggcattatatttcttactataaaactacacattggcacctggcttgcacatctgtctcttaggagtttggttactgttagctctgtgagcctgagtgatcacctcaactatcctagcaaaataggagagttggggccctccaaagctgagaatttgggcattatgacctaaataaagcaacacaatactgtctgagcaactagtcaaacccaaccagcctccttctctgacaactttattttgctttctttaagtgccataccaattattataagtgatgactagtatttatcattttaaatggcaaacaaccctaaatggcttggtggagggcaagttcagacattgtcctggagactggctgagagtagaagcccctctgcagtgttctttgaagtgctgattttagttatataaaatgctaaattgcctctcccactgtcagaatagccttttatttatttatttatttatttatttatttttgagacggagactcgctctgtcccccaggctggagtgcagtggcaccatcttggctcacagcaagctccrcttcccaagttcacaccattctcctgcctcagcctcccaagtagctgggactacaggcgcccgtcaccacgcctggctaatttttttttttttttttgtatttttagtagagacagggtttcwccatgttagccaggatggtcttgatctcctgacctcgtgatccgcccgcctcagcctcccaaagtgctgggattacaggcgtgagccactgtgcccagcccaaaatagccttttatacctcttcctgtttatgttatcaagaagttagtatgtagacttcagaactcaattttgatctgctcttgattaaaccttggtttacagaactacggtagtttttcacattgtagagaaaaagttgaactattttaataatggattttctgtgtgtatagaaactcctacaattgatttaaattttttttttttttgagacagattcttgctttgtcrcccaggctggagtgatctcggctcactgcaacctccacctcctggattcaagcaattctcctgcctcagcctcccaagtagctggaattacaggcacccgccaccacactaatttttgtagtttttagtagagatggggtttcaccatgttgcccaaggctggtgtccaactcctgacctcaartgatctaccctcctcggcctcccaaagtgctgggattayaggygtgagccaccacgcccaaccttgagttaaatttctaaaaatctcaacataatgtgtttggctcctcttcttattatgcttagagttaggcactagcacatactagacctaaacttgactgatttgaaaagaccactgaaatccatgatttgctgcggatcctctgtgtctgctgtggccaatataaagaaacttggatgcacttaatttatgaagacaagctttgttgatctggaagttgaatgataaatgtgaatccaatgacgccatacccctgcggataatggcaggctggatgtagcatgttagccrtcatattctgtgtgctccctgygatgtgggcacttcccttccatcgtggtgaggccaaagcaaaggcacagagasctgaacacaaacatgaaaaacaccttaccacctgggagtcaggggcaggttcaggcacatccattcctctggcatttgagcagctgttttccacagcattaactcagcacggcagggtaagtcagattaaaaaccaataaaagagtagtatcctcataccaccctcaacgtcttcctgcttcaccaaaaaaccaataaaagactgaatgtggccctttatcagctagacctcaaaatcttctttgctttctatgcgtatttccaataaaaaagtacaaggrttgttaaaagtccttatttatttatttatttatttatttatttatttatttatttttagaaccagggtctcactctgttgcccaggctggagttcagtggtgcagtcatagctcagtgcagcctccaactcctgagctcaagtgatcctcccacttcagcctccagagaagttgggactacaggtgcatgctaccacgccaggctaatgcttttggttttttaagagttttgttgagtcagggtcttgctatgttgcccaggctggtctcaaattcctagcttcaagcagtcctcctccctcagcctcccaaagggttggtattacaggcatgaaccactgtgcctggccttaaagtccttttgaaacacaagacaagaaacatttggccgcgcacagtggctcatgcctgtaatcccagcactttgggaggccaaggcaggtagatcatgaggtcaggagttcaagaccagcctggccaagatggtgaaaccccatctctactaaaaatacaaaaaattagctgggcatggtggcacgtgactgtaatcccaactactcagaaggctgaggcagagaattgcttaaaacccaggaggtggaggttgcagtgagccaagatctcgccactgcactccagcctgggcaacagagcaagactctgtctcgaaaaaattaaaaataaaaatacaaaaattagctgggcatagtggcacgtgcctgtcatcccacctactcaggaggctggggcaggcgaatcgcttgaacccgggaggcggaggttgcggtgagccaagatcgcgccattgcacgccagcctgggcaacagagcgaaactcagtctcaaaaaaaaaaaaaarggaaacatttattgaacacctagtacattccatgcactgtagtgtgtgtggttttatttaatttcatctctgcccaaccctgggaaacggtctattagcagacgcagaggataaggcacaggacgatcaggtaacacacccagggccaaatatcataaatggcagaattcaaattaaagccaccttccaagccatgtccctcccatcgtcacaatactgcatgtctacagcacagttgatgggcataacccttcttagcaacagcaagcagctgagcagaaagtaattgcaggaggcagagccaagaggaaaacygctgagagtgctgacggtaggtggagagaacagaagcacacaccgtagggtgcaatcttagtgagctttgttttccttcaatagaggtgagttcagacccaggcatgtctctccaacattcatttcccctgcttcggcaccatagacttgaaggattggactcaggagttggggaggacacgggggaagttgctttcctggtgctgaggmccccggccaccgtggtagtgtacagcaagtacagggtaacagaagggccagcaggaggacacgsygcaatggtgtaccgagggacaggagagtgaatcagagccacaggacagagctccacctgtytccagggaagtgcatggggggctcccggaagccaaaggcagcgcccagaggcagtgtgaagaggccttcctcagacctcagggtttcggcagggatagtgggtgacctgtgtgctggctctccagaaactgaaagcagcaagagacacttgggctccttttttagtttttctggtttgttttgttttgtttttttgcaggcactcggtggttagctggaaataaaggtggaggaactgggcagttcaaaggcagagacggcttcccccacccccacctcacctcccctttcattcagaaaagccacaaaagcgtggccccagggtgtgtgtgaaaggagggaggagtgactccacctagctcctctggagtaaagagaggctgtgggcctggtgtcgtgcgtgcatgcctgcatgtgcctgtgtgtgtgcatgcttgcctggtgctcaagggtcaggggaagctggctgagaagactgaggagatggagggaggtggaggraagtgtaatagaaggaggtggaggaaggtggctgccatagagctttggctctggctggcctgagtctcttcctgaagttgcagctgcactttggggccaggcgctgttgacactgtgggtataaacatgtggccagcagcagaatagagactcagagtcttgagaaagaaagtggtgacttcccactcctccttccttctttcctgtacagagtctgccatctgggggcagagatatgggcaagccctcattataatactagcagtgaagggctgggcatgacaggtggaaacaccactgactctagaactcagagcatggaatttggtatggtggcaggcaggggtccagaggtagtatttgttatctattgctgtgtaacgaattagcttaaggtatagcagttcaagagaagaaatgtttattatctcacaatttctttgggtcagaaatacaggtgtggtttagctgaatgctttctggctgaaggtgtttcaggacgttacagtcatgccaccagctggggctgccaactcatctgaaggctcaacacagggggaccggagtccaagctccctcacatggtcaccagcaggattcagttcctcgaaggctgtcatttagaggcctccctccrtccctccttacaggtccttctcacagggcacttcgtgacatggcagctgactttctggrgaccatccaagtgagaaagagcccttagaaagaagtgacagtctttatataacctaatctcagaagtgacaactcatcccttctacaaggttctattattcaaaattgcatctgtaaatccagctcactcaagggaaagggattactaggagataggggtcactgggggccattctagaggctccctgtcacagcatccaagctgagacctacagaatgacaggagttcaccaggcagggaggcaggagggagttgggggacggcaggtgcagtgaaccatggttgtaactcagtatggctgcacagagagcactgcctgagggtgagcagtgctgtggagaggccagcagggcccagaacttgtaccatcttttaacccaggtttgtaagggtggactttatcctgcaagcatgaagatcctaaagcttgaggctaacggttaagatttggctttagaaagattacactgctggcccagctcagtggctcacgcctgtaatcccagcattttgggaggctgaggtgggcggatcacctgaggtcaggagttcgagaccagcctggccaacatggtgaaaccctggttctcctaaaaatacaaaaaaattagctgggcatggtggtgggtgcttgtaatcccagctatgcgggaggctgaggcaggagaatcgcctgaacccgggaggtggaggaggytgcagtgagccaagatggcaccgctgcactccagcctgggtgacagagtgagactgtatctgaaagaaaggaaagggaaaaaaaagaaagaaaaaaaaaagaaaagaaaagaaggaaggttatcactgctgtggggagaatggattgaagagagtaaaagagcagaggaaggccagctggcgggtgcggcaggtggggggattgaactgaggtgctggagaggctgaatggctggcagcagcgctgctgcagagctggcgtccctgggtgtaggaactgactgcttatgtccgtcttcctcctctggaacataagctcaatgaggacagggattcttgtttgtagtctctggtatccccagcgtttaggacagtggcactagatgaatgactaggacaccccaaggtttctggcttgagtaactgggtggagctattctctaagctgtgaggcacagagggcaaacatggacagaaacttaatatttgagaaatactgagtttgaggtgctttgtaggccatctgagaataaatgcctcgtaggcagttgacatgyggggatctggaaagcctcttaaagaaatggtgagagatggagacttgaaaatccaagcacctagacgcccgtgatgggagtagttaacatggccctgggaccctttcccagagtttctaggacaccttacgcagcaacagtgcttgctttgaaagatagtaaaggaagaaagtcttgccaattgtcattcacaaaagaaagtcaaaaatatgttgccagagaggacaggagaaagccaggaatcacgggaagccagaagagagcttcgagtactatgagaacagcacagtaggttaggtaaggactgaaaggaggccggtgagttgaagcccactgtgggtggggaggaaggagaaaaggaatgttttccagaaatgcaaagcattacttaatatttattttattttatttttttgagatggagtctggctctgttgcccaggctggagtgcagtggcacgatctctgctcactgcaacctctgcctcccgggttcaagtgattctcctgcctcagcctccagagtagctgggattacaggcgcccaccaacatggctggctaatttttgtatttttagtagagatggggtttcaccgtattagccaggctggtctcgaactcctgaccttgtgatccacctgcctcagcctcccaaagtgctgggattacaggcgtgagccaccatacccggcctattttatattatatttattttattttatattttttgctctgttgctcaggccgaagtgcagtggtacaatcatggctcactacagcctccacctcctgaktctcaagcaatcctcccaccccagcctcccagagtgctgagattacaggtgtgagccaccacacctggcctccattacttaaaaatgttttaaaggctggacacagtggctcacgcctctaatcccagcactttgggaggctgaggcaggaggatcacctgcagtcaggagtttgagagcagcctggccagcatggtgaaaccccgtctctactaaaaaatacaaaaattagctgggcgtggtggtgggtgcctgtaaacccagctacttgggaggctgagtctggagaattgtttgaacctgggaggcagaggttgcaatgagtggagatcatgccattgcactccagcctgggcaacagagtgaaactccgcctcaaaaaaaaaaaaaattaaaactgtcacttccaaacaccattaaaaaacaaagtgcctgattcggccgtacatgtactaaaattggaacactggaacggtaacagagaagattagcatggctcctgcacaaagatgacacrcaaattcatcaagcattccttttttttttttttttggagacagtgtttcactcctatcaccaaggctggactacagtggcgtgatctcagctcactgcaacctccacctcccgggctcaatggattcttctgcctcagcctctggagtagctgggactataggcatgcaccactgtgcccggctaatttttgtatttttggtagagacggggtttcactatgttacccaggctggtttcaaactactgagctcaagcgatccacccgcctcagtctcctaaagtgctgggattacaggcgcgagccactgtgcccagcctcatactttttatattcattttgaaaaaaaccaaacatacaaaatatagataagcatttagatcacaagttccccaaactggtctttgtagcagcaatttaggaatcacctgggtggtttttaaaaatacatattctgccrggcacggtggctcactttgggaggccgaggcgggcggatcatgaggtcaggagatcgagaccatcctggccaacacggtgaaaccccatctctactaaaaatacaaaaaaattagccgggcatggtggcgggcgcctgtaatcccagctactcgggagactgaggcaggagaatgtcatgaatccaggaggcagagcttgcagtgagcggagatcgagccactgcactccagcctgggcgacaagtgagactctgtctcaaaaaaacaaaacaaaacaaaaaaaaaccagattctgggtttgccccaattccataaaattaacctctcaagggtgaagcaggagaaactattttttaatgtgccaagtgactttgaagtgtgacaagctttttaaacattttatttggagttttctgcttttattatttttaattgacacataataattgtatatatttatgcggtaccatgtgagattttgatataggcatacaatgtgtaatgatctaatcagggtaattaacatatccatcacctcaaagagttttgacatcactcatttaaacctctaagaaatacttttcagctgggcgcagtagctcacgcctgtaaccccagcactttgggaggccgaggcgggtggatsacctgaggtcaggagttcgaaaccagcctgaccaacatggagaaaccccatctctactaaaaatacaaaattagccaggcatggtggcacatgcctgtaagcccagctactcgaaaggctgaggcaggagaatcacttgaacccgggaggcagaggttgcggtgagccgagattgcgccattgcactccagcctgggcaacaagagcaaaactccttggccgggtgcggtggctcacgcctgtaatcccagcactttgggagaccgaggcgggcggatcacctgaggtcaggagttcgagaccagcctgaccmacacggtgaaaccccatctctactaaaaatacaaaattagccggtcatggtggcacatgcctgtaatcccagctacttgggaggctgaggcaggaaaattgcttgaacccgggaggcggaggttgcagtgagctgagatcgcaccactgcactctagcctgggtgacagagcgagactccatctcaaaaacaaaacaaaacagaaaacaagagcaaaactccgtctcaaaaaaaaaaaaagaaatactcatttttctttgactttaagcccttttagaataaataaagcggtacaaaatattcatagattactaaactgttagaagccaattgttaaatttaagactttaatagggaacttaaagcaatcaagaaaataaactctccacaaagttttaaaaaacaactataaaatacatcctgtaggccgggtacagtggctcaatcccagcactttgggagaccgaggcaggcggatcacctgaggtcaggagttcgagaccagcttgaccaatatggagaaatcccttctctactaaaaatacaaaattagccaggtgtggtggygcatgcctgtaatcccagctactcgggaagctgaggcaggagaatcacttgaacccaggagatggaggttgcggtgagctgagattgtaccactgcattccagcctgggcaacaagagcgaaattctgtctcaaaaaaaaaaaaaaaaaatcctgtaggtttgttatcaagaaaatgctgatgactataattaggaytataaatttagttgagagtgagagctagattagtaaataaaattgtctataaacatttgtaaatcagtcatcctcctgggtacggtttgtaaaagaacccagtgcttaagtgaagagcagggacagctcctggctctggatgggggagaagtcttccttgtttcatagtcaaggaaagctcccagctgaccatcaccctcttctcttggaaaacgccacacctaccttcttgccattcctagagcgattttccagcctgagtggtatgactgcttccatttcctcgccactcttgtttgtccctggcagttcactttgattctcaaaagtccattaaaaccccttccaggtcctccgggatccctggccatgtaagctctgccaccaacagcagcctttctagtacaaagtctctagagctttccacagcctctggcttggtctctccctctccaggctggccacaggcccccagggacctatctgccatctcttggaaatatctttctaaattccccactccccctcctgcctttccacgactttgagttgcaatagtttgcccagttccccttttccttgtagtctttaaagataagtccacaggtttttcatttgtttataagatttactctccatcaggaaatgaaaataaacatagggaagctgataagtcacagctccccacccccagccgttgttccggggaagcctctctagcaaggctcagatgtttccatcttaaggttaaatcacaccaaacaatagaagccctttggtttcacctcagtgggcgggatgtgcctcctttcatggatctcctgccccacacaggatttctctggactccttagagtgtttcttcaaaactagttcaatctcgatctaattagtccccaaagagatgcaaaccaaacgagatgcgatttttgttctattaggagggcacamaaataaaaaataaaaattaagcctgataatagcctgtttgggccagcttgctgggaagcggactcatttttatactgctggaggggttcggaatcaagaatcttaaatatgtgcatccccttcaatccagtaatcccacttctaggaaaatatcctgaggagataatcaagatgtgcagtcaagaatttatgaacaaaagatactcactgcagagccataattgagaagaactggaaaggacttaacatgcctcccaggtggggcttggctctgcaaatcctcatctgactctatgatggaatgggatgcatccggtcatgcagtcatccgtgcgacaaatagttcttcagtacctactctgcgttaggtaaacaatgcagagtattgttaacttggctgggtaaacaggtaagttctcagcccccctggaaaatccatgatctcctaaagtaaagcaatttaaaattgttcacattatttgtgtgtgagtgtgagggggcgctttatcaccctccacctctcatycccccaccacaagcagttgccaaattcaaataatttttccttcaatgcctctcccgtgtgaccgctccttttctttcaaaagtaaatcctatgtctgggaggtaacccgatcaccgcggaaagaacgccgacatggaartcttaggattggtttctcgttccaggaagttgcgctactttgggcaaatcacgtcacctctgggactgtttctaatcagaataaagaaagggctggaccaatctttcagatcctttgaatccaatcatttttggccttatgacggaaccgtctgtagatgagggcatctgaatcctagttaaagggaagggacggtgaagcccttgaagatctggggcatatttcctgaacaccaaaacgggaaagggctgtctagagtgaaagtataagacagacaggccctgttccaggaagctccctgcactctgctcttctccycaagccgaccccaaactcacagccagctttagcaagcaggcccgtcatccttccaggtgctatgtaatattaagaagcagcagctarcaattattagtgctactaggggcaggagatttgcagttccctcgctttcacacaaaagtatgaggtctgttttattattcccactctaaaggcaaaatggaagctcacggagattacagaacttatgggaagtgacagggctatttgccacgtttatactggccagtcttcctctttttctcaaagggtggggtgggagagcagcctcccgtgttatcaccctctcctgcggcagaagacagaagcataggtcattttggtagtacgggtttgttgattaccaactgggagacagaggtgaggtaaatcacaagcatggatgttagcagggctgcagaagtttataaataaatgatcttagaatctccagcagccccrttctttcatttggtaaccggcctcctccctgccctcatccctgtagcgcccttcccccatgagggtgaagggtcagctctaaaaatgcagtcaggaaggaacaatgagagtcctctccccgcctgggagaaatgcaatttgcatctcagatgagctcagattggtgaagcctcgtttggactctgatccttgcagtaaggatctgctctgggaatctcctgtgacctgttgaggtttgctgctccaaaggaataaggagtctttgacattaatgtccatttaactcagggatctaaaaaggcaggttagtgttagarttctataggcaccccagaattgtacctaagagtgtgtgtgtgcgtgcatatgtgtgttttcctggggatggtgtagctttccttagattgtcaaaggaatttatagctgcccaaaggttaaaaacttgtgtgacaagtgagtgtgataaaggaggaacagtggtgcagatcctgtgggaggggagaatgacttaacaaacccagaggtgggggtgggagggaaagaattcaggtgagactgcactcagaggtaggattcytttttcttttttgtaggtaacattttttgttttcttactgtgtgccaggcattgttctaaactaaatatacaaggccaggcgcagtggctcactcctgtaatcccagcactttgggaagccgaggtgggtgggtcacttgaggtcaggagttcgagaccagtctggtcaacatagtgaaaccccggctctactaaaaatagaaaaattaaccaggtggctcgtgcctgtagtcccagctgctcgggaggctgagagaggagaatctcttgaaccccggaggaggatgttgcagtgagctgagattgcaccactgcactccagcctaggcaactgagaagactctgtctccaaaaaaaaaaaaaaaaaaaaaaaagacaaatacgtaaactaaaatctatgagaattaggtaattctctctttttttttttttttgccagagttttgctcttgtcgcccaggctggagtgcagtggtgtgatcttggcttaccgcaacctccgcctcccgggttcaagtgattctcctgcctcagcctcccaagtagctggaattacaggtgcgcaccactaggcccggctgatttttgtatttttttagtagagacggggttacaccatgttggccaggctggtcttgaactcctgaactcaggtgatccacctgccttggcctcccaaatttctgggatgacagaagtgagccaccgcgcccggcctaattttttttttttttttttaagagacggagacttgctctgttgccaggctggagtgcagtggcgccatcttggctcactgcaagctccacctcccaggttcaagtgattctcctgcctcagcctcccaagtagctggaattacaggtgcgcaccactaggtctggctgatttttgtatttttttagtagagacggggttacaccatgttggccagactggtcttgaactcctgacctcaggtgatccacctgccttggcctcccaaatttctgggatgacaggagtgagccaccgtgcccagcctaattttttttttttwagagatggagtctcactctgttgccaggctggagtgcagtggygcgatctcggctcactgcaagctccacctcctgggtttaagtgattctcctgcctcagcctcccaagtagctgggactactggctggcgccaccacgcccagctaatttgtatttttagtaaagatggggtttcaccatgttggccaggatggtctccatctcttgacgtcgtgatctgcccgcctcggcctcccaaagtgcttggattacaggtgtgagccactgagcctggcctaaattttaaactatttgtagagacagggtctcgctatgttgctcagaatgttctcaaactcctgagctcaagcaatcctcctgccttggcctcctgaagtgctgggattaaaggcatgacccactgtgtccagccttttgtgggctttttgacatccttttatgtttttctttggtgaagtgcctattcaaatcatttgcacgcttttttttttttttgagatggagtcttgctctgtcccccaggctggagtgcagtgatgcgatctcggctcactgcaagctccgcctcctgggttcacgccattctcctgcctcagcctcccgagtagctgggactacaggcgccggtcaccacgcccggctaatttttttttttgtatttttagtagagacagggtttcaccgtgttagccaggatggtcttgatctgctgacctcgtgatctgcccatctcggcctcccaaagtgctgggattacaggcatgagtgagccactgcgcccggccatttgccctttttttgttgttgggctgtttatcttattattgcattttgagggttcattatatactctggatacaagccctttgccagatatgtgtgttgctaatattctctaccagtctgtggcttatctttgcattctcctaaatttctttcagagagcatacattctggtagaagagtacttagtcctgggcctggcagatttatttctttcaggacccaaggcctctgctgcaaacatgttccrccagatctttggtcagaataagaagcatatgagcttgatcattgttatggtcacaacttttgtatcccctcaaaattcgtacattgaaacctaatctccaatgtgatagtattaagagttggggtcatttgagaggtgatgaatgggcytcacgcccttataagagggccaaaggagattgtttaccccttccaccatgtgagtgcacagctgtaaggcaccgtctgtgaggaataggctctcaccagatactagcaccttggctcttggacttcccagcctccacaattatgtctgttttttgttttgttttgttttgtttttgagacagagtttgctcttgttgcccaggctagagtgcagtggcacaatctcagctcacagcaacctcttcctcccaggttcaagcaattctccagtctcagcctccsgagtagctgggattacagccacccgtcaccaagcccaactaatttttgtatttttagtagagatggggtttcatcatattggtcaggctggtctcaaactcctgacttcatgtgatccgcccacctcwgcctcccaaagtgctgggattacaggcatgagccaccacacccgacctgttgtttattctttataagtcatcccgcatatggtatttttttcttttctttttttgagacagggtcttgctctgttacccaggctggagtacagtggcatgatcatggctcattgcagcttcaacctcctgagttcaaacaatgctcccacctcagctttccaagtatctgggacaacaggtgcatgacaccatgcctggccaattttttgatatttgtagaaatggggtctccctatgttgcccaggctggtattttcttatagaagcctgaatgaacaaagacactgtccatctttttcttttttcttttttttttttgagacagagtcttgctctgtcacccaggctggagtgcagtggtgcagtcttggctcactgcaacctccgcctcctgggttcaagcgattctcctgcctcagcgacccaagtagctgggattgcaggcaagcgccaccacacacggctaatttctgtatttttagtagagactggatttcgccatgttggccaggctggtcttgaactcctgacctcaggtgatccacctgccttggcctctcaaagtgctgggattacaggtgtgagccactgcgcctggcccatcttttttttttttcttttctttttgtagagagagagagasagacagagttttgccgtgttgctcaggctgatctcaaactcctggcctcaagtgatcctcccaccttggcctcccaaaggatataatcccatgcctggaattacaggcatgaaacaccatgcctggccattcttaattttatgacatcctcacacttgtaatctcagcacttttggaggccaaggcaggtggatcaactgaggtcaggagttcgagacctagccttgccaacacacggtgaaaccccatctctactaaaaatacaaaattagccggtcatggtggcacatgcctgtaatcccagctacttgggaggctgaggcaggaaaattgcttgaacccgggaggcggaggttgcagtgagctgagatcgcaccactgcactctagcctgggtgacagagcgagactccatctcaaaaacaaaacaaaacagaaaacaagagcaaaactccgtctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatgcctgtaatcccagctcctcaggaggctgaggcatgaggattgcttgaacccaggaggtagaggtgaggttgcagtgagccgagctcatgccactgtattccagcttgagtgacagagtgacactctgtcttttttgggggggtttttggtgccaattttaaatagttttatttaaaacattgcattttccacttacaatacagtgtttataaagtgcaatgttatttccttcccctgtgcatatgttccacattcaagtattgagaaaaatatggaatgcttcaccaatttgcttgccatcctcgtgcaggggccatgctaataatcttctctgtattgttccagttttttagtatatgtgctgccgaaacaagcatgactctgtctttaaaaaaaaaaaaaaaaacaacaacaacaacaacaaatgctggccaggcattatgctgaggtgggtggatcacctgaggtcaggagtttgaaaccagcctggccaacatggtgaaaccctgtctctgctaaaaatacaaagaaaattagctgggtgtggtggtgtatgcctgtaatcccagctacttgggatgctgaggcaggagaattgcttgaacctgggaggcagaggttgcagtgagctgagatcatgccactgcactctagcctgggcgacagggcgactccgtctcaaaaaaaaaaaaaaaaaaagaacacaggctatgggttaagcaaatgatagacctcaagcttatattattctagagaacagggagcatctggcccacgcaccagccctcatttgagtgacttatttttaggctttgcaacccacattaattgctctttttttttccttttttcaacatgttctaaaatcgtatatatttgaatcaaagtacagtacatgtcaggataaagaatcaaaagaattatcaaaaatattaggttgaatcctatggagttgttaacatttgcctttgacctttaaaagaggtaatttctaggccgggcgcggtggctcatgcctgtaatcccagcactttgggaggccgaggtgggcggatcacctgaggtcgggagtttgagaccagcctgaccaacatggagaaaccccgtctctactaaaaatacaaaattagccgggcgtggtggcrcatgccataatcccagctactaggggggctgagacaggagaatcgcttgaacctgggaggcagaggttgcgatgagccgagatcatgccattgcactccagcctgggcaacaagagcgaaactccatctttaaataaataaataaataaataaataaataaaagaggtaatttcttacaaaataaggatgtttgttcattatagtttttttggaatagagaaacattgggagctatttagatgtctttcttttctatttatttatttatttagtagagagacagggtcttagtatgttccccaggctggtcttgaactcctgggctccagtgatcctcctgcctcatcttcccaaagtgctgggattacgggttgagtcaccgtgcctgtaacgtttttcatcgtaacattgttcagaatagtgaaaaaaatgagagtaatctaaatgtcaaacaaatcatgccacatccatatcacaaaattaaaatcaatgttttagatttaataactcaatccctttgtgttctcatgaacacatgatttaatattggtttcatgacattaagttccatttatacatgctggaaactcccaaatttatatctaaagtccagctatagctccccaaatccagaccaagacattgaatttcctctgtggtgtcccagcaagttctggagtatggcacctcctcatggatgtgtccttggcacctgggggcagattccaaacaagtccacttattttaaatgtctcagtaaactcatttttatttttttgagactgggtctcactctattgcccagacaggagtgcagtggcacgatctcggctcactgcaaccttcacctctggggctcaagcaatcctctcacctcagccctgcaggtagctgggaacacaggcacgtgccaccacgccaggctaatattttgtatttttagtagagacggggttttgctatgttgcccaggctagtctcgaactcctaggctcaagcaatccgactgcctcagcctcccacagtgttgagattacaggtgtgagccgctgtgcccagcctcagtaaacttctttgccacccagagagaaggttgtaccctctgtcagggtctggttcaacctcaggcagagggggctcatttagatttgccttgactcaggcctatcggttttttttgttttttgtttttgtttttgttttggggggggacggagtctcactctgttgcccaggctggagtgtagtggtgtgatctctgctcacagcaacctctgcctcctgggttcaagcgattcccctgcctcagcctccagagtagctgggactacaggcatgcgccactatgcctggctaagttttttaatttttagtagagatggggtttcaccatgttagccatgatgatctcgatctcctgacctcgtgatccgcccgcctcagcctcccaaagtgctgggattacagatgtgagccacggcgcccagccaactcagccctatagttaatggctgttccctataaatgtttttcttatattaagagttttgttttcatcacctggcatcagatcctccattattccaatttcttgttattgtttgtgataggtaatcttagttcaacttaactgggccagggtgcccagaaacttggtcaaacattattctggatactactatgaaggtgtttttggatgagattaatggttttgttttttgtttttttttgtgatggagccttgctctgtcacccaggctggagtgctgtggcatgatctcggctcactgcaacctttgcctcctgggttcaagcgattctcctgcctcagcctcctgagtagctgggattacaggcgtgtgccatcatgcccatctaatttttgtatttttagtagaggcgacgtttcaccatgttggtgaggctggtctcgaactcctgaccctgtgatccacccacctcggcctcccaaagtgctgggattacagtgcctggcgagattaacattttaattggtggacttcgagtaaagcaaattactatccgtaatatgggtgggcctcatccagtttaaggagttaatataaaaaagactgacttcctcctgagcaagaagaaattctgccagcagactgccttttggcttgaactgtctcttccctgagtctccaacctgatggcccacaataaagatttagactccccaggcctccacaattgtgtragccaattccttaaaatgtttctctatctataacatatcctattagttctgtttctctggagaaccctaatacattatacttttttttttttttttgagacagtccctctctgttgcccaggctggagtgcagtggtgcgatctcggctcactgcaacctccgcctcccggcttcaagcaattctcctccctcagcctccaragtagctggggttacaggcacgcgccaccacgcctggctactttttgtatttttagtagagatagggtttcaccatgttgttcaggctggtctcaaactcctgacctcatgatctacccaccttggcctcccaaagtgctgggattacaggcgtgacccaccacgcccagcctacattattctttacattcaactaccccagttcaaattgctgtgtggtttctgtctcctgattggaccgtgatgaatacactattattctctcctgaactcccaatccatatgtgcagatgcttacccagcatctctatctggatgtctaaaaggtgtctcaaaagcatcgcaaatttgttatccccaaaagtagctcttgatgctcctcccacaaacttttcttttctttttttccttttttttttttgagatgaagtctcgctcttgtcccccagtctgaagtgcaatggtgcgatcttggcttactgcaacctccacctcccgggttcaagtgattctccagcctcagcctctcgagtagctgggattacaagtgtgtaccaccacgcccagctagttttttgtatttttagtagagacggggtttcaccatgttggccaggctrgtcctgaactcctgacttcaggtgatccgcctgccttggcctcccagagtgctgggattacaggcatgagccactgcgcccagccaaacttgttttcttttacagcttttccaatctcagttaaaggcaactccatttttcagtaaggccttccctagcaacccattaattgtagtcagcagccccaactatactttcaatccctcttctctgctgttattttattttttatttttatttttttgagcagattctcactctattgtccaggctggagtgcagttgcatgatctcggctcactgtagcctctgcctcccatgttcaagcaattcttctgcctcagtctccccagtagctggaattacaggcgcccaccactaaacctggctaatatttgtatttttagtagagatgaggtttcaccatgttggtcaggctggtcttgaactcctggcctcaagagatctgcctgcctcagcctcccaaactgttgggattacaggcatgagccaccacacccggccatttgctattattatttatttttttttgagacagtcttgctctgtcacccaggctggagtgcagtggcacaatcttggctcactgcaacctccgcctcccaggttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagagtgagactctgtctcaaaaaaaaaaaaaaaaaaaaaaaagaatttcatggtttttgttttgtttttttgagatgaagtctcactcctgtcccccacgctgtagtgcagtggcatgatctcagctactgcaacctccgcctcccgggttcaagcgattctcctgcctcagcctcccgagtagctgggattacaggcacctgtcaccacacccagctaatttttgtatttttaggagagacagggttttgccatgttggccaggctggtcttgaactcctgacctcaagtgatgcactcgccttggcctcccaaaatgctgggattacaggccttctcctttttaatgatatattttgatgaccagaaattcttaatttttatatagtcaatttttttatagcaaaacacctgtgaacatagtcaaatttatcacttatcctttataatttaaatgtcttaagaaaacttccctttcccaagttaataagtacattttgtattttctcctaaaaattatgtttcatctttcacatttaggttgctaagccaccaagaattgatttttctgtatggtgtgaggtagggttcaaattttcaccccttactcagaaggctctttttttctacataatggttttggtttgatctctctgctttctgaagtctcttatcctatgaaacactatcaagattctacaacaatgaagcaaaacaaagtatcaatcccacagttttatttgtaaagaacaaagcatgaaaagtcatatttaaatgtactcccaaacctgaaaaacccacgtcagtttgtctgatatgtatgttaaagtgcttaatatcacaatactctttcaaattttatattatgttcagatgagaaaaaaaatccagttctgatgcattttgctaacaatacaaagaaaaacaatataatttaaattcagaaaagctaattaaaaaaaagatacacaggttacatttatacatggttcaagtgtaacacagagcattctaaatgtttcacaccctcatttgattgacaacaggaactccttactatacttctctactgttgacaagatttggtgtttagaatcaagattggattcacacacaagtacattcaggtaaattagaacaaatatgattccctcctacataacccaaggataccctggatcccttcgaatgaggaaaaattttatttgaggttttttttttttcctctagcttgatgtgatrtatctctgaagtcaatctttatcttgtccttgagagggtgaacagctccaatcagattttggagakgaggttctccttagattcttttgatcacactacatcagcaacctcttcaaaaagcttagaattcagttgattcaagggatttataaatttattttaataggaataaaggacctagtagtttattatccttttctgtctcctatttatgctaaacagtaaagtaataaatacttatataagaaacagacttcaaaagacatggatgacttggaaataggattcactttataaaagtagagaagggctcaagactctcaatcagtgaaggtgtgttaatactgaaatataaatagctaaagttcagattgtcttttcaacatagtgaaaaggatacactagtttctgtaaacctcacagaaaatattcacagttccctaaatgaaaaattgtaatctttagcagaaagaagatatttcattatgaagagctacactcctaatgttgtgaaataaatatttccctggaaatttgaggtccttgtctgtcacctcatgtttcaaaataccttagggatgtcaacatatactacacataagctgttgtatagtcttgaacctctttttcacttacatttacatataacagtgctttattgccaaaaaaggaaatatgagcagttcagtatttcccccatatcattcatatagtgtgatagaagttcattaaaataattttttaaaaagccatgtgaaagtaaataccacaaggttacaaaaggtacaaaaatgtgtgaaacatttaaatttcagagggaaatccacacttctgcaaggttgaagtttctcatatcaamttctcattcccagtggaaaacaaggtggggagggttgggaggtttttgtcctcagtagcctgctttttcccacgtaggactccactttatactacttcacactgactcgcagtcatttttaaggcatatgactcccgaccagggcacagatctcacacatgcttccaacatcagtgtaatgccactgtgtcataaaggtcaagattaggggtttcatgacatatgaaaaacwttgggaaaataaatttttcaagaggtaatacttttggcaatttaattttaaaacaacttcttcaccagctattactatgcaaaaataatcattatggtcccagcatttaatttatttgcaggaaaaaaacaaattaaatattgatttttttatttactttgagatgtaatcctaaagcaatgtattaatttaaaaaattaccacagcagaaaagatgcctctatgtgggtatggtccttccaaaagtcagcttaaaagtcaagcatttattctaagcattctgctactactgttgtgctcaaacttttggtataacttagagacacttatgagccacataaaaactaagtcctttgttttgtttttttgagatggggtttccctatgttacccaggctggactcaaactcctgggttgaagtgatcctcctgccttggcttcccaagcagctgggactacaggtgtgtactgccatgcccaacatgtcttatttctttataactgcacttcttatgtgaccccaaactcagcttaagcatccttttcattgatcaaacttggatcctaaggactatttccaaatatttaaatttattcttaaaggccaagattgactgccattgggaatattcaaaagaatgggggtactggccattcaagcagctcacacaaggagggccccacatgtttatagcacaggctgtatcaacggaataagtacatgggctcacaaggtgactgaaggacccatcatccaagaggatgtgtcagttctgatgtgttttttttaaatcatcatttcaccattatagtaatattacacaaaggcatgaagatgaaacttcaggtgtaacttttttgggggtattactttttaaagtaatggttttattcataggccgcaaatccaactttgsctgcagtttttttctttttttttttttgagacggagtctcgctcttgtcacccaggttggagtgcagtggcacaatctcggctcactgcaacctccacctcctgygtttaaacgattctcctgcttcagcctcctgagtagctggaattacaggccctgccaccacccccccgctaatttttgtctattttttttttttagtagagacggggtttcaccatgttggcyagtctggtcttgaactccygactgacctcagatgaaccacccgcctcagactcccaaagtgtcaggattacaggcgttagccaccgtacctggcctgctcccagtttttacaagatgttaattcccaataatctgagagcaatgtgtkaatatgaatattaattcttctaaatgaatattcatccttatttcctacttgtataggtggatgaataaagatccaatagtataatagaaagactattagtaagaatgccggaaggtcagtctcatgcagcctggtgaaataaaacaaacaaacaaacatgaattctagagcttgtgttgtcagtaaccagctgtggggtaagtgtaagatttaatctctctattccttaagtgttcccatccacaaagtaagaaggctggatgaggtgtgtcaatcctagcacaytaacctaaktcatcccccaggttgcctagacctgtcaggagcatggccttatgaagatacaaacatgaaatcctgggttggacccctctatagtttctgatcaccaaacacagtaggagcccagtgtaaaacaggttctggatatctcccacgataaacttcccatgtccctggaagagctgtaccattgtagacacactttagcttcaggcaaacaaatttctggtgtacccagaaccattttcttaaaccatttccatgggtttttatttttatctatttattttttgagatggagtcttgctctgttgcccaggctggagggcagtggcgcgatctcagcttactgcaagctccgcctcgcgggttcacgccattctcctgcctcagcctcctgtacaggcacccgccaccacgcccggctaattttttgtatttttagtagagacggggtttcacggtgttagccaggagggtctcaatctcctgaccttgtgatccgcctgcctcggcctcccaaagtgctgggatcataggcgtgagccaccgcacccggctccatgggtttttaaatacagctgtcaactctccttttcctcaagtatgaagtcacatgttaaaagaggctgtccttggctgtgtttgataaagggagttaggcacttgtttcatctgtttcttcctccaggaaataaggttaacaacacaggtggtgaaagcccagcaacctccgattgcacaaggatactgatgccatggctttgcttttcrgccacaactgggaataaaactgggagctctgctgaggcaattttgctgctaaaaatgtacaaatgcctaattagagttacaggacctaccagaagatgaggacttacagtaactagccaatactacatttacttaacttctttataaactatcaaactggaaagttactcacaacttttgktctttcaaaattgttgccacctcttgctttgcttccattttgtcagcctgtgctgccagtggcttttagcttctctgggtcagttgttttacattattactccccttcctacaaaggaacgtaaagcttgccctgaaacacccagaaagggttcattctctctctccttctgttatttgcattatcatggtcaacaaatgctttcacaaaaacattccaagccacacacagccctcctcctccttagacattccttccatttcccgaggggggatgggccctggagaggtgggtgattagaccctaacaaagacagggctcatggttatccttaagaggtagaccactgcacagtttagatggccaaattaaaagtacagaatcaaattgctgtttgcagttcttatcactatgaatctaacactgaaattcacatcttcccaaagtacctcaaataacaagaataaaaatgccaagaatgaagttagtctaggctaatctttccgaagtgtaaagaagttataatcccacaattgaacacatttctcagagctttgtatgttctctttccagttcagccaagctcctggggtctagtgtttaaaatactccaattatatcatcttgtgcggactgaaatttttttccaaaagactggaaaagtgactagcgattcaaatatataaaacagtttgtaacttaaaagatagaagtgaagactaccagtacagtaggtaaagctgtgtgcatccacaatacaaaggatcagactccaagatggatggctactacataacaatgcattctgggtttctttgtgatacctggagaaaaaaaaaagcccgactgggttgcactatatttacatgtttactggcttcttcctggctagcaccactcttccccccaacccccaacatttttaagctacttattttaagtcacaggaatattcaatctaagaaaagcatcttattagagtaatataatttcttaaagaagatagcatatttacacacatctaacacatgaaaatactctattttatactaaattccaggttcaaatgaactacaatacaacattttgccttgtctgtagagtgaggattgttccaaatggggcatatgtttggctgcccctgcagtgactcactactgtcagacaagtccaaatcggtcccctagttggggaaggagcaaggtttggactgagagtttctagccagttgggttacacatccactcctttgatgagtgatccttctaggactatggtgaagtcctgaatggtctgcagaattcggataagggagttgacagtcatgcggtctcgcaggagagcgctctcttcatacattcgagtgatggcaggacactcagctaacaatggaatccactgtgggagcaggcgatccctacagacccaaacagaaacaattcctgagcattgctggcctcgctgcagaacaaggcacacagtggagtctgtatgaatgggaaggtgtgggacttgatggtacaaaatgtatccaagctaagaggtcaggagagaggaaatcaaagccaagaagttgaatattttctggtaaaaagacagtgatgagacagtgtaaagawagctaaagggaaaacccattattttaaacccaatttaatgtactttaagagtttaaagtacattagaaagtctatgcacattaaagacattctctattctgattttaccacctttagaaagaggcagaatgtcattttctatgtcttttttttttaataggagtgttactctgtggcaaggcatgccacagtatactgaccttttggaagaaagactacactaaactgtagggacttgcttttttttttttttttttttttaacttatataacataacagggtgaggaacaaaatcaaagcagaaaaacattaagtagattttataaaccagatgagagtttgcaatggtctaataaatcagaagagtatagagataaaaggagataaagatcatgctcaaaagaaactttaaaagcacagctaaaactgggctccttttatgaagaagaaatacagaacttagttctgtaaaccagctgtttcaggaagataaaacctcacatcttcaatgtttcctgatcaaacctgacattagtaacccattgctaagttcctaagacatccttattgagcatccccaatcaggccatcttcagtctcaagttggggctcttaaggttcaggaaaaaacaaatactacatgggtaacttaaaaaaagaaatctaaaggtctgtatgtttcatttcttacarttctgagatctgttttaaaagtaatggattgtatcgctcctatgtgccactttcaaaaaataaaggggtaggaaatagtcttaaagagaagatgatatttatatagcaagaatcccataatgttattaaatgtaaatatagtggtatatatacactatataaggtttacttagtaaatatgtacagtgtatgtgtctagttatctaacaacttccttattacctatctatctgtcgagccagtatacagtcatggtggagagcttgggctctgaagtgggacagggtgtgaacctggctctgtctcatttttctgtgtgatcttgggaaagtctgctaacttacgtgtgcctcatctattttctactttctcatctttaaaatgaaaaaatcggttgctacctcatgtagtggtggtggtgaattaaagaaacccaagggaggaggcagaggttgcagwgagccamgattatgccacggtactccagcctaggcgatggagtgagactctgtttcaaaagaaaaagtaaaaggaaagaaacccaaaggagagctctggaaggggtatgatctggtataaccttttctggactctagttcaacatgtgacaaagatagggaaaataaaaaactggttttgtaccttgttccaaggcaaactaaaatctggaatttgccatccttcccaatgttcctgggtgcagtattaatagcatttacgtagtggcagaaggttttgcaggatgatttctgaataaggacatcatcttcattatctagaatctggtcagttgtttcaaaataagcaaccactttctctgaggaaaaaagtcagaattatgtcacaatatgtgtcaacacttcatatatagaaagattcatcacttaatttattatggaaacactaacgatgctttgcatacagtcagtcctgaagccaatatcattactttatcattgattttaggggtcgatgtttcatggtagaacaataaatatgctcccaggaatttattttctaatttagactgcattccagaagactggaaagtttactccctttaaaataccttcaggaaacagaaactggcaaaaaagaaaacaaaaatagcatcttctgttaagactggaaccttctaggagtaaccagcaatgacacggtagccattgaaataataccccatgttctagttacagaatgacttgctaacactttgcaacaagatccttgaaatgtacctgaataagtacctgacaaagagagatatatgtatatacacatgagaagcagaagcaataagattctaggcattccagaagaaaaaaaaaaaatcactcctgggggcctatctctgacaactttcctttttttgtctattctaagttagatgaaataaactacttcatctaggccttatttagaaaacacaaaatgattaattgcccatttaaagaaactaggaattctagaagagctgcataccaaaagaaagatcacaaagcttagcaagctagaacagaaacactccaaaakagcttcctgtgatgatgaaaatgttctctatctacaaggtccaatttggtagccacaagtggctcctgagcacttgaaatgtggccagtgttattaagaaaatgaaatttacatttacatttgatttaaattaaatagatttggccaggcatggtggctcacgcctgtaatcccagcactttgggaggccaaggcgggcagatcacctgagttcgggagttcgagaccagcctagccagcatggtgaaaccccatctctactaaaaatacaaaaattagctgggcgtggtggcaggcacctgtaatcccagctactcaggctgaggcaggagaattgcttgaacccaggaggcagaggctgcggtgacccaagatcacaccaytgtactccagcctgggcaacagagcgagactccatctaaaacaaacaaaaaaaattaaatagatttaaattttaaatggctatatgtggctaatggttactatactggacaacacagagctagaggaatccttttacaaaaattggccaggcacagtggctcacacctgtaatcccagcaccttgggaggccaaggcaagtggatcacttgaggacggaatttgggaccagcgtggccaacatggcaaaaccccatctctactaaaaatacaaaaattaggggtgtggtggcaggtgtaatcccagctaatcagtggctggggcaggagaaccgcttgaacccaggaggcagaggttgcagtgagctgagatggggccactgcactccagcctgggcagtagagtgagtctctgtctcaaacaaacaaacaaaaacgttctatcatgtcactacttagctcaaaaccttccaacagcttccagtttcattcaggataaaggctgaaatcattccaatgacctagaaggccctacacaacctggcactggcactaaacaccccctcccccaatctcctactttctctctcttgctgtgctccagtcacactgggcttggagttccatggaaacacttccgccttggggcttagcactggcagtgctgtcaacctggagtccctcctcccagatatctacatggctcacttcctcacctacatgaagtctgtgctccaatgtaccttgacattcagcagaatctaaaaccaccccatttgaaagaccactccccactttatttccttttatactgctctatttctttccagatcaatggtcacatttctgacataccatatgaattacatatttgttatgtttttgtgtattgtttgtttcccacaccgacctgagtataagtttgtcaaccataggatttctgttttgtttactaatgtatatcttgagcaactcaaatactatttggaatattgtgcatattacaatttgttgagtaaatgaaaaacaaagacaatacttgatatttatttatcattattatatacactttttgagacacggtctcactctgtcgcccaggctggagtgcagtagcttgatcatggctgactgcagccttcacctcctaggctcctgggctcaagcgattctcttgcctcagcctcccaggtagctgggaccacaggtatgtgctaccacacccagctaatttaatatttattttaaaatatatatatccttgccgggcacgayggctcactcctgtaatcccagcactttgggaggctgaggcgggtggatcacaaggtcaggagttcaagaccagcctggccaatatggtgaaaccccttctctattaaaaatacaaaaattagttgggcatggtggtgcacacctgtagtcccagctgcttgggaggctgaggcaggagaatcatttgaacctgggaggcggaggttacagtgagccaagaccgcaccactgcactccagcttgggcaacagagtaagattccgtctcaaaaaaaaaaaaagaaaaaaaatatatatayccttatcactaacccttattcactcagattcctgggtctttgagttcctaagaaaggcttcagtgaccttaatgtaatacacatctactttatttacctatgaagtcccagatgaagacattcttgtgaaagatgcgggcagatttgaacccatggtggaaaacttgctcaagggctgcaaccaggccattttctccacacagcaacacggtgaggcttcctctctgtggggcataacacacagtgccaaagaaaaatctcctgcatctatgtctaaraaaaacactagagaagcaagtgctgaaggtagctatatgaagcatgtttttacagctaccagaaagcttacaaatgaaaattcaagcaccccatattgcctcgtgtatcacatataaaagcatctttaaaagtcccactatactaagttttatagcccataaatacctctttttcaggtttatgaaaatgtttcacaatattgttcacagcttctccaattccttcttgtatctgcccagcattgggttctgtaaaataataaacagtggctgcattctcatgggagagaaataaaccaargtactatgggacatcaactgtgtccacctaggcaggaaatacgtcatcagagcaggctggctttgccaggggctccatagaacttgcctctggcctgtttggccaagtgggaagcatcctggcaaaatggaaaataatccaagcgatccctagattcaaatcccagcattaccatctgcaatctataaccctagcctagtgtctaacttcctctgagctttcagtttcctcaactgaaaataggaaaaatacaygcctcactgggaaaactggtaagttataggagtaaataactagcatggcgcctgtcacaaaatgctagcaagcccccaaatatgagaagcaaggttgagaagtcccaacatcactcctcaaatgttcccttatgctacccacctacgagcctgttagtgaaatgttcccttatgctatctacctacgagcctgttagtggaatgttcccttatgctacctacctacaagcctgtcagtgggcatagattaaggcttcaggcgctctggatagttaacctggagtttgaagatttgctgttgtgtttaaaataaggggaagatgccaggtaccctgtggcatctgggcctgaagcccagaactccctcccttcctggctagtcaatctgtctcagcactgcttccttctgccagccagtacttgctcttctaggccactttcctgagggacaggttggtgggctgcttgaatgcgacctaaatcacttttgtccaccaaacccaaggaatggtttgtttttttaaaaaggtggtaaacatttcagaagtaggtaacaacagaaaaggtatatagttcagattttcttgtagttctaatttacttaacacactataaaggaaaacccatacatcctcatgtttaagaatctctgaattcatactgctcaaggatttcttgcatgaacatttcttttttcttttttgagatggagtctcgctctgtctcctaggctggagtgcagtggtgcaatgtcrgctcactgcaccctccgcctcccaggttcaagcaattctcctgcctcagcctcccgtgtagctgggactacaggtgccggccaccatgcatggctaattyttttgtatttttagtagaaatagggttttaccatattggtcacgctggtctcgaactcctgacctcaggtgatccgcccacctcagcctcccaaagtgctgggattacaggcrtaagccaccatgcccggctaacgtttctttcagtaaaattcaagtaggttttttctacactaatgcataaaaattgttaaaatgaaaacctcttataattgaagtactgataccatggcctcttgttcctagtggtttctttacccagtagtttttgtttgttttttttacctttacctttctctattttttcttttagacatgaagtctattttgaaaactgtcacccattccaaaagagctttgatcagtattattataaaactgattttaaaaattttcagttctctgaataccattttacatataacatactgtgagaaaatacygttatccatttctgagtcttgggtcatttagacttttctgyttatagcatgagaaaagaaagtacgattaaaaaaaaatgggggataaaagcctctcagataatacccccatgaaattggactgactcagatgttataataattaggatggattgagctgaaacctacttttaaattttaaatcagcataattaaaattcaccatgtaataaaagtcaccaattttgatgagctttgacaaatggatagtcatgtaaccaccaccacaatcatgatacagaacatttccatcatccccaaaagttaccctgtgmtctttttttttttttttttgagacggagtctcgctctgtcrcccaggctggagtgcagtggagcgatctcaggtcactgcaagttccgcctcccgggttcacgccattctcctgcctcagcctcccragtagctgggactattgacacctgccaccatgcccggctaattttttgtatttttagtagagacggggtttcaccatgttagccaggatggtctcgatctgctgaccttgtgatccgcccgtcttggcctcccaaagtgctgtattacaggcgtgagccaccgtgcccggcctatcctgtgctcttttcagttaccttccttagctcctaactcctggcaaccaatgatctactttctattattatattgcttttatagagatctgatatataaacagatatatatcactatctgtttatcctttcaccagttgatgtatattggggttgtttccatttttggctattatgaataaatctctcaaaayatctgggtacaagtctgtgtagatatatgtattcatttcttttgtgtacatatctaggagtaagattgctgggccaagcgtacggtaagtgtgcatgtatctttataaatgccaagatgttattttgtattcctactagcaatgcatgagctttctgttactccacatcctcaccaatatttgttgctataagtgctttaaattggttgggcacagtggctcacgcctgcaatcccagcactctgggaggtcaaggtgggaggatcacctgaggtcaggagttcaacaccagcctggccaacatggtgaaaccccgtctctacccaaaatacaaaattagcctcacgtggcagtgcatgcccgtaatcccagctatttgggaggctgaggcaggagaatcgcttgaacctgggaagcggaggttgcagtgagatgagaccgcaccactgcactccagcatggccaacaagagcgaaaactcagtcaaaacaaaacaaaacaaaacaaaaaaacaaaaaaactgcactcatagttaatacacaatcatgtgctagcaaatggatagagactaatagaagaatctagggaaactgctttgttaataaactaaggacctattaggtacctttgttattctacttgtggttataatctatagataaaaagccccttcactgataaacttctgtratttttccctaaataccgcctctatattcatgttctgtggctgccttctgtggctgctgtaatagactcacaaaacttggtggcttgagtgacagaaatacattttgttgcaggccagaagtcaaaatttagttatcactgggccaaaaaaaaaaaaaaaaaaaaagcaaggtgtcagcagggctgtattcccttgaaattctaggggaaaatcccttccttgcctcttttagcttctggtggctgttggcattccygttttttttttttttttttttttttgagacggagtctcactctgtygcccaggctgtagtgcatgtagtgcagtggcacgatattggcttactgcaacctccacctctcaggttcaagcaattctcctgyctcagcctcccaagtagctaggattacaggtgcacactaccatgcccagctaatttttgtatttttagtagagacggggtttcgccatgttggtcaggctggtcttgaactcctgacctcaggtgatccacccacctcagcataatgcctggccagcatttgttgttgttgttgttgytkttktttttttttttaaagacagagtcatgcttgtttyggcagcacatatactaaaaaactggaacaatacagagaagattattagcatggcccctgcacgaggatggcaagcaaattggtgaagcattccatatttttctcaatacttgaatgtggaacatatgcacaggggaaggaaataacattgcactttataaacactgtattgtaagtggaaaatgcaatgttttaaataaaactatttaaaattggcaccaaaaacccccccaaaaaagacagagtgtcactctgtcactcaagctggaatacagtggcatgagctcggctcactgcaacctcacctctacctcctgggttcaagcaatcctcatgcctcagcctcctgaggagctgggattacaggcatgcaccacatgcctggttaatttttgtttttttagtagagacggggttttgctatgttggccaggttggcctcaaactcctgatctcaagtgatctgcccacttcggcctcccaaagtgttgggaaagaatacatatgatkgcatttagggtccacgtagatgtgatccaggacaatctcctatttcaagatccctatcacatctgcaaaaatcctttttccaaataaggcaatatttacagattctagaggttagaattttatatttttgggagacaytatttagtctattaaagcctacattagtaatttagtctattaaagcctacattagtataaattagaagtttactatattactaaaaatgacacatgaacatagtataatattcataaaattcactcctttatagtattttgtttcatccttactataggaagaaagttgggacagaaggggtagaaggaaatttkaatctcttagaataagagacactggggcgggcgtggtggctcatgcctctaatcccagcactttcagaagctaaggcgggtggatctcaaggtcaagagattgagaccagcctggccaacatggggaaaccttgtctctaccaaaaatataaaaaattagccagatgtggtggcgggcacctgtaatcccagctacttgggaggctgaggcaggagaatcgtttgaacccgggaggcgggggttgcagtgagctgagatcgcaccactgcactccagcctgggtgacagagtgagattccatctcacaaaaaaaaaaaaaaaaaaaaaaaaaaaggctagatatggctatctgggagtactgtaatatataactattattatttctcttttaagtttcaggcaaggccaggtctggtggcacacrcctgtaatgccagcactttgggaggctgaggcaggcagatcgcttgagctcagaagttcaagaccagcctgggcaacatggcgaaaggcagtctataaaaaatacaaaaattagccaggtgtgatgttgtgtgcctgtagtcccagctacttggaaagctgaggtgggaggatcatttgaacccgggaagcagaggctgcagtgagctgagactgtgccactgcattctagcctgggtaacagagtgaaaccttgtctcaaaaaataaaagtttcaggtaaaatatttactcatatttccacagcttaataaaaacagagcatgcaagttttttaaaaaattagattttaacatctaaactcttccggcttttgaatatttatgaattttcctcaactttcttctttttaaaatctcctcactacattcattaacacaactgttttctatcaaatggtcacatgaagcctacatcataggagcacataagaaaaatttaaataaatttactgttgttttttcctgtcagtgaagtgatgctcaatctcctagccgtggtgggtgacttctgctggggtggagtccgacactgctttactagatcttcatctgatgctgatgtcatcaactctccaataagaattctctccaggctcccatcatcaatgcctttccccagccaccgcccacatgggaatctggtaggacagaaaacaagttttttattttttatttttttgagacagggttcycgctcagccccctgagtagttgagactacaggtgtgcaccaccacacctggctaatttttgtgttttttatagagaggtctcattacattgcccaggctggtcttgaactcttggcctcaagtgatccccccatctcagtctctcaaagtgtgtggattacaggtgtgagccactgcacccggtcagaatattttcaaactagaaattaatttgggagttcaggcacagaagaaaagaggacaatgtttccatagagtagtgttggctgtgactagtggaatccaagagatcttttcctcccactgaaattattttaggcttcttttttattttcttttttttctgagagttatattaatctttccaacacttgtggactaagcaatagcagcaaacatctgttgttttaaaaagttttttgaggctgggcatggtggctcatgcctgtaatcccagcactttgggaggccaaggtgggtggaacacttgaggttaggagtttgagaccagcctggccaacatagcaaaaccccatctctactaaaaatacagaaattagccgggcgtggtggcaggtacctgtaatcccagctactcgggaggctgaagcacgagaactgcttgaacctgggaggcagaggttgcagtgagccgagattgcgccattgcactccagcctgggcaacaagagtgaaactctgtctcagaccaaaaaaaaaaaaaaaaaaaagagagaaagaaaaaaaaaagttttttggggggcaattttgtatgacataaacaaaaaaaaaattgcccccctcacctggaaaaaaaaaccctaaaattcagaaggcagtggaagagttcaaacaattctttttttttttttttttttttgagatggagtttcaccttgttgcccaggctggagtgcaacggtgcaatctcggttcactgaaatctccccctcccgggttcaagcgattctcctgcctcagcctcccaagtagctgggattacaagcgtacaccaccatgccctgctaatttttttttatttagtagagatggggtttcaccatgttggtcaggctggtctcaaactcctgacctcargtgatccmcccgccttggcctctcaaagtgctgggattataggtgtgagccactgtgcctggcctacaattcttaaaccttttcttacctgaagagtcttaaaacaaagaattctgagttcccaaggccatttacttacctgtatgtatgtcctgtgatttcatttctgaccatgacacaatccactagccatttggctaacagtcctgagttatcgtgaccaatctgaacagtggtcagcttccccaagttctggcactgtagggacaggaccttaggttatttagtacccaatcccatcctgttacatctcagctttacaggtactttggttccgtctaatttaacaactgcagagacaaaccctgcataatgtattcagctatgcactagagaaatatattcacatatattccttgctctcagggagctcccacataatgagataggagacatatggacattaactaccaaatgaggggcactgcacacagtgctagattagagatgtaaaaagtgctagaagaacgctggggaaggaacagttacttctacttggggaacccacaaacaacacagacagtgacttrtgccttgaagggtaagaataatttctaaaaacaggaaaaagatgctatttagattttgttacaaagaggtcaagaaaacaattatagattttaaaaatcactgacactgatattcttttcttttttagaaaattttttgtgggtacacagtaggtatatatatttatagggtacatgagatgttgatatttttctgttccaataagatactaaggcagaactgacctcagacctcatatactagaagtctttgaagctattttttaaaaggcatagttatcaataagttatcttcactggtcctttgtggacaagtacaaaataaagcaatgataataggaatagcaaaaatgaatactaattaaattctgacttctaaaatctgataatgaaaagatcactgaccccaacwatgtgctggatgacaacatcagaattgtaagttcttttttttggttaattttaatttttaatttttatgggtacctagtagatgtgtatatttatggattaattgagatattttgatataggcatgcaatgcctaataactgtatcagggtaaatggggtgtctgtcacctcaaacatttatcatttgtgtgacaatccaattatacttttagttattttaaaatgtacagttaaattattgttgactatagtcaccctgctgtgctagcaaatactaggtcttattcactctatttttttgtacccattagagctacgagttttttttttttgtttttttttttagacagagtttcgctctcgttgcccaggctggagtgcaatggtgcaatctccgctcaccacaacctccgcctcccggattcaagcgattctcctgcctcagcctcccgagaagctgggattacaggcatgtgccaccatgcccggctaatttttgtgtttttagtagagasggggtttcttcattttggtcaggctggcctcagactcccgacctcaggtgatccgcctgcctcggcctcccaaagtgctgggattacaggygtgagccactggcccggccagagctrcgagttcttaaagcactttattctttgtatctcagtgagaaggcatcaccatgctctaacttagggatgatggcatcttgaattagttgtgcagcagagatggaaagaagtaggtagacatgagagagacagcttagaaatggcaatgatgggggttttaatgtactttcattattgttagatgaagaaaagccaagggttttaatattttatatacaggtggctttgagtctactgcatggataaggccaaactgggctcctgggggcgggagggcatcatgactctaagtggaaactgctatttcgagaccccaaggaacatgagaatgggacattcagttcgtaccatttccttcctcaaacacaacaattatttgtcctcttcctccaccaagatcaacctgtgtacaggcttaaccccatggaactatttcaccaagtaagactgaaaattgactacaatattaaaaggtggctgtttgttttgttttgttttttgagacacagtctcactctgtcacccaggctggagtgcagtggcacaatcctggctcactgcaacctctgtctcctgggctcaagtgacctcagccttgcaagtacccagactacaggtgcatgccaccatgcccagctaatttttgtattttttgtagagatggagtctcaccatgttgcccaggctggtcgtctcaaactcctgggctcaagcaatctgctcaccttggtctcccaaagtgttgagattataggcatgagtcactgcgcctggccaaaaggcatttttatagaatcattctataaatgtcaccatgtggtctaaaaccagtaagcagatgcttgaacccaggaggtggaggttgcaacgagtgaagatcacaccactgcacagcctgggcgaaagagcaagattccgtctcaaaaaaaaaaaaaaaaaaatccataagcatgaatatcagctctcctgtccttttgccaaaggatgaccaggtttgggcagaaaacattttacagtagggaggagaaccaccgcggggaaaacatttatttgaatatttcctgcttgctagaatctgtgctagaccctgaaaatagtaggagaagacctagaaagccccaaagcacatcattacaagtgaaaaatagagcttaacaatgaaaatgcaaaacaaattagtatataagctgcttaagacaactttagacatataatcacaaaaatgatcctgcacgctttgagtgttcctctattttatttgattcaaggaaaaatgaaaaagccagacagaatcatctgtaaaactacacgtgatacattcttctaggaaaggtattagctgaacctacctcaaaggtcatttcgaggaggtttttgggaatctgcattactcctgtgtctcccagctctcctgatacacagatccaagggtttgatgtgattattgcattgctcagctttttgattgggatgatcactgacctatacggaatcactgaaagaaaaatgcagaaattaattaaaaagcgggaataaaattctccttataacaaaacatatattaagaactcttgttggttttcattgataatttgctttttatgakctatcaagatgtacttatacgaaaagttgagatcataacctttcagtctagaaagatgagatctagtttgcaaaccagaagtctcaatactcgtagcagtggttttcacagcatgtatatcatcatgtatgtatgatgcatatatcaayattaaacgtatgaacaatctcaagcattagcacgagaatacctaaagatgtgaacactgactgtgtatattgtgttttcattgcttaaattttcttaaaaattaattttgtaacaaaattgaatagaaatgaacatgattactgatatggttttatataaaaagaggggtggatgacttcttggacagtattgagtttcttgggcaatgctttaaagcactgcatttcagaactttcctgtcccaagtttacagaacaatatgcaaaaaccacaaataataaacaatggmacctccactctggacatatcgtgaagtctataaaccacaactttgaaagctattaaggtgactcacacgcaagaggagcccagggaggctcttccacagacagaccactagatgtcactgccctatcactgtcctttgctcaaatgtggaagcacgagaggttagatgttatgcatgtcctcccttctttttttttyttttttttttttgccaacatggcaaaaccccgtctctactaacagtacaaaaattagccgggtgtggtggcaggcgcctgaaatcccagctacttgggaagctcaggcaggagaatcacttgaacccgggaggcagaggttgcagtgagctgagattgcaccactgcattccagcctgggcaacagagtgagactctgcctcagaaaaaaaaaaraaaagaaaaaagaaaacggctggatgtggtggcctgtaatcctagcactttgggaggccgaggtgggtggatcacaaggtcaggagcttgagaccaggctgaccaacacggtgaaaccccgtctctactaaaaatacaaaaattagccaggtgtggtggcacacacctgtaatcccagctactcaggaggctgaggcaggagaatcgcttgaacccgggaggcagaggttgcagcgagccgagattgtgccattgcactccagcctgggcaacaggagtgaaactccatctccaaaaaaaaaaaaaaaaaaaaaaaaaaagtgcagacagggccaggcacgggggctcatgtctgtaatcctacctagcaccttggaaggctgaggtgggcagatcacttgcgctcaggagttcaygaccagcctgggcaacaaagtgagaccttgtctctatacaaaataaaaaacataattagccaggtctggtggtacacacttgtagtcccagctactcaggaggatgaggaggggggatcccttgagccagggaggtcaaggatgcagtgaactctgatcccaccactgcactccagcctgggcaacacagcgagaccctatctcaaaacaaaaagggggcagatggtttaagcacataagcatttttgtccatcacagccatacatttctggttttttgtttgttggttttctagagacaggatgtagctctgtcgcccagtctgaagtgcagcagcccaatcagtgttcactgcagccctgatctctggggctcaagcaatcctcccatctcagcctccccagcagttgggactacaggtgcacgctaccacacctggctaactttatttatttagagtttcactcttgtcgctcaggctggagtgtagtggcacattcttggctcactgcaacctctgcctcctggattcaagtgattctccagcctcggcctcccaagtagctgrgattacaggcgtctgccacctcgcccagctaatttttgtacttttagtagagaaggggttttgacatattggccaggctggtctcgaactcctgaactcaggtgatccaccggcctcaacctcccaaagtgttgggattccaggcataagccaccgcgtccgacctctagcttttttttttttttttttgagacagagttttgctcttgtggcccaggctgragtgcaatggcatgatctcggctcactgcaacctctgcctcccgggctcaagcgattctcctgcctcagcctcctgagtagctgggattacaactgcacaccaccacggccagctattttttgtatttttagtagagatgsggtttcaccatgttgaccaggatggtctcgaactcctgacctcaggtgatctgctcacctcggcmtcccaaagtgctgggattacaggcatgagccaccgtgcccggcccctagctaactttttaattgttcttttgttgagacagsatgtcactattttgcccaggctagtcttgaactggactcaagcgatctttttgccttggcctctcaaagtgctggaactccaggcatgagccactgcacctggcctgattgtaaaattttaaagttttttttttttgagacacggtctcgctctgtcacccagggtagagtgcagtggcacgatctcaagcttactgcaatctccacctcctgggctcaagtgatcctcccacctcggcctccccagtagctgggaccagaggtgtgcaccactacgcccagctatttttttgtagttttagtagaggcagggttttgccatgttgcccaggctggtctcaaactcctaagctcaagagatctgcctgccttggcctcccaaagtgttaagactaccggcatgagccacctgccatgtatgtatgtatgtatgtatgtatgtatgtatgtatgtatgtadgtatttttgaggcagagtttcactctatctcccaggctggagtgcagtggtgcaatctcagctcactgcaacctctgccgcccgggttcaagtgattctcctgccttagcctcccaagtagttgggattacgggggcttgccaccgtgcccrgctaatttttgtacttttagcagagacggggttttatcatcttggccaggctggtcttgaactcctgaccacgtgattcacccaccaaggcctcccaaagtgctgggattacaggtgtgagccatcgcacctggccactatttatttattttttgagaagaagtcttgttctgatgcccaggctcgagtgcagtggggcgatttcagctcactgcaacctccgcctcccgggttcaagcgattctcctacctcagtctctggagtagctgggattacaggtgtgcgcccaccatgcccagctaatttttgtacttttagtagagacagggtttccccatgttggccaggctggtcttgacctcctgacctcaggtgatccgccacctcggcctccaaaagtgctaggattacaggtgtgagccaccatgcccagccatttttttttttaagtagggtagaatcaatatttgttgttatccttgggatttctgcccatttgatcataagagggggtgttagaagccctccgtgaaagatctacaagtaggatgaaaaacatttactaaagaaggtgcctagatatagcctcacaatatgagctcatggttcagtgcactcttagatgaggaaaacaaatgagataaatggttcatttccctaattttacataaaagactttctttatgttaggtgaagagtctccctttgtgtccttttattttggctttaggataggaaaatgtcagagaaaaggccatatattcacggtttagtaatcatcagaatcaaatgggttttgaaactgaaagcagaagaggttagtgttaagactttattttaggtgccagaggcttttctcatttcttgcactgctaagaaaatctgcagaaaaaggcatgtttagggtcagcagttctgtggctgcaaaaggcccacagatgcacaacagtgatttcatagtttaagtatgaaaaagcaatatgattaaatttaaaaatttctttcatgaagaattcctcaaattgaaagagttactcagatgaagagaaatctacagatataaggaggattttaggaatcctctactgctactacttcttayttatttagagacagtctcaacctgtcacccaggctggagggcagtggtgtgatcttggctcactgcaacctctgcctcccgggttcaagtgattctcccacatcagcctcctgagtagstgggactaaagcaagcgccaccacgtccggctaatttttgtattttttggtagagatgaggtttcaccatgttggccacgtcagtctcgaactcctgacctcatgtgatccacccgccttggcctcccaaggtgctggcattacaggtgtgagccactgtgcctggcctcttcgatttaattaaattaattaattwattwatttatttatttattttgagacggagtctcgctctgtcgcccaggctggagtgcagtggcgcaatctcggctgactgcaacctccgcctcccgggttcaagcaattctcctacctcagcctcctgagtagctgggattacaggcgcccaccaccacacccagctaatttttgtatttttagtagagacggggtttcaccatgttggtcaggctggtctctaacccctgcccttgtgatccaactgccttggcctcccaaagcgctgggattacaggcttgagccaccgcgcccggcccaattttaaaactgtatataactttttagtttcttacacctgcagtaacctaatcaacgaatagtaacttgacaggcattacaggatggcctaatccccattccaattcccttttcctttgtcttccgttaccagagactggaaagccaaaacctacacaattctggccagtgaaatgttagtgatatttattgagattttttggaaaattatgtctttctagcacagatcctgcccctccttggcactctctccttcctgctggaaggtatgctgagaacagccatgttgaaaccatgaggtaactagcacacacagagcatgtctaacaggaaaaagacaatgagcctgggtccgtgacagcactgcccactgcctactttgagacctttattatgtaagtgaaattactatgctgtaaaccactggttttcaagtttctgatacttgcagctaaatgcaattcctaattgatacaagtaaaaattctccaaagtaaggaagaggacccactgcaaataagaattagcaatgaaggaaagaataaatgctatcattcggctttctataaaaaatacatctcttggacaggctcagtggctcacacctgtaatcctagcacattgggaggttgaggcggatggatcacctgaggtcaggagtttgagaccagcctggccaacatggtgaaaccctgtctccactaaaaacacaaaaattagccgggcatggtgacatatgcctatatacagatgtgtgatttgggaggctaaggcaggagaatcgcttgattcccaggggayggaggttgcagtgagctgagattccaccactgcactccagcctaggtgacagagccagacaccatctcaaaaaaaccaaaaacaataacaacaacaaaaacaacaaaatctccaggtccagcgtggtggctcatgcctgtaatcccagcactttgggaggctgaggcaggtgggtyacttgaggtcaggagttcgagaccagcctggccaacatggtgaaaccccatctctactaaaaatacaaaaattagccgggtgtggtggggcgtgcctgtaattccagctactcaggaggctgaggcacaagaattccttgaacccaggaggtggaggctgcggtgagctgagatcgtgccactgcactccagcctgggtgatggagtgagactctatcaaaaaaaaaaaaaaaaaaaaaaaaaattctccaatcagcatttccttccaaagttgaatgatgtccaattgcataagtttattattaacacacagatactttgattttatgtgttttcgttaagatattgaaatatttacttaataaaacattccttttctcatctattgtaggtaacatttcctatcaaagactgggtttcttgggaagaaatctctgagtcagaaattagcatggacaatgctgctcctgggaccaacatgtgagaaggaaagcaggattggttaagcaagatgttaagcttcgatgcagtctcaatgaaatcctcatctatctaacccccatggtgagctccgggacagccctttgttcagtcatgggatgctggctggaactgacagaaggtatcatctccagtgaggtacttttcttcagtaaggcgttctctaaagcctgacagccaagggtttcctgtagcactcttagcatttggggaatatcctttactcctaaacagagacctgggcgtatgtcacaatgtcacatgtactatggcatatcttgctttaaaaaatataaatgcttttattgcattggtcacctcagtaacccttaacggtcaattctctagacttactgatagtggtgaacacactggtgaagcagaaatagtccacagcattgagagaaagaaggtggtaaagaaactgctctctttcttcttcgcaacgtagaaaagcatatcgcttataaagcttcctaggaaagggtaagacaagcacaagacagtagtatcaaagaaaaaaaaaaaaaaccaagacagtagtatcatgtacttttcattatgkcttttttttttttttttttttttaaacagagtttctctcttgttgcccaggctggagtgcaatggtgcaatctcagctcactgcaaactctgcctcctgggttcaagtgattctcctgcctcagcctcatgagtagctgggattacaggcatgtgccaccacgccaggctaatttttgtatttttagtagggatggggtttcaccatgttggccaggctggtctcgaactcctgacctcaggtgatccatctgcctcggcctcccaaagtgctgggattacaggcatgagccaccatgcccggccattttttttcttttgtttctttcccattatgtcttttttccaggatggggtctcgctatattgcccaggctggtcttgaactcttggactcaagaaatcctcctgcctcagtctcccaaaatgttgggattataggcatgagccactggggctggccctcattaagccttgactaaaaataaatagctcctcttagacaaacacctttaatcttgaaaaaatagattcattctatttcaattcataaaaatggatatataaacagttaataaaacacttttaacctaataattaaggaaaaaatgcatctattttatctatcaaactaataaagacttaaaagtgatgaccagtgttgacraggaagaaatgaatgccattctcacagttggtgagactgaaaatttcaggaaagcaattcaggtaacaattactttaaaccaatcataccccttgactcatcaattttacttttaggattcagtcctaaagaaacagatgaaatggggcaaagatttcattaaacacttacatttaagcactttcccaagtgttttataggtattartacatttaattctcactctatgaggtaagtctattagtgcctttttattatttatttatttatttatttttcttgagatgaggtctcgttctataacccaggttgctggagtgcagcgatgcagtaacagctcgctgcagccttgacctcctgggcttgagtgtgcctcccacctcagcctcccaagctgctgggaccacaggtgcacgctaccacactcaactaattttttatttttagtagagatggggtctcactatattgcccaggctggtcttgaactcccaggctcaagcaatcctcccactttggcctctcaaagtgctgggattacaggagtgagccaccacacccagcctagtgtcattttacagatggggaaaagagagatacaggaaagttaaatattttgtccgaggtcattcaaacactaactagagaaggcaatatttgaacacaagcattcagacttcagattttaaactcttctgatacggtgaaatgtttatggtacactgttaagctaawaaaaaggatgatattgaatcgcacatatagtgtatcttaataagagaacatgcatagaagaaaagtacagaagaaaatgtgaaatacttagtgttctttatatagcaggattgtaagtgattatcattttcctctttgtactttggccactatgagcataaatcactttttttttttttttgagacagtttygctcttattgcccaggctagagtgcaatggcacgatcttggctcaccgcaacctctcgtctcccaggctcaagcgattctcctgcctcagcctccaagtagctgggattacaggcatgtgccaccacgcctggctaattttgtatttttagtagagatggggtttctctacgttggtcaggctagtctcgaactcctgatctctggtgatccacccgcctcggcctcccaaactgtaggattacagccatgagccaacacgcccggcctttttttttttttttttttttttgagacagagtctcgctttgttaccaggctggatggagtgcagtggcgcgatctcggctcactgcaacttccgcctcctgggttcaagtgattctcctgcctctgcctcccaagtagctgggattataggcatgcgccacgacacccagctaatttttgtatttttagtagagacggggtttcaccatgttagccaggatggtctcgatctcctgacctcatgatctgcctgcctcggcctcccaaagtgctgggattacaggtgtgagccactgcgcccagccaataactttttgtaattggaaaaaaaaaccacgccagttttaagaaaacaaggtcagattcacaggctatatgcaacacttcatgctttatcaaacctactgtttggacattaaaactcatctgaaaatgctccagggggtatgtaatccaagtgtgatatatacaaatacaaaactacaaaaagcactggaactctaataggctatcttgtttgaggtctttgttgaattctctgcctaactttgctccttagaagtcaaagtccttagccttcaaattagcactaatgtaaatataagggcaatatatttcatccaagacagcttcttttttttgtttttgttttttgagacagggtctcgctctgttgcccaagctggagtgcagtggcccaatactggctcaaatgattctcctgattcagcctccaagtagctgggattacaggtgcctgccaccatgcccggttaatttttttattttttgtagagacagggttgtgccatgttggccaggctggtctcgaactcctgacctcaagtgatctgcccaccttggcctcccaaagtgttgggattacaggygtgagccactgcacctgacctcgaagagggtttcttgatagagtaaacagaagaaattaaaagttaacaattaattgacatgtacttgactggtttcccrgctctaaaccagtggttcccaacctttttggcgccagggacctgtttcatggaagataatgttcccatggctgtcgcaggggctggggagggggaggtggattcagaataaaattgttgcacctcatatcatcagtcattagagtctcataaggagcacataacctagatccctcacatgcgcagttcacaatagggtttatgctcctttgagaatctaatgctgctgatctgacaggaggcggagcttaggcggtaatgcttgcttgccctcggctcatctcctgctgtgcagccctggttcctaacagaccacagaccagtactggtccatggcccaagggctgggaacccttgccctaaactagtgaatgcaaggctctcagaagaagccctttactgggacctcctcacagaactttattatttctttctttttttactccaggttttatctgtatacaacctgtatacaggttttacaatataaggtttatacaaaataatataaggtttatataaattcatccgatcttttggatgttactgtcagcttgtgtgaactagccagctttttgcctgattctggcagagcaatccggccttttttttttgagatggtcttgcactgtcgcccagactggagcgcagtgacatgatctcagctcactgcaacctccacctcccaagttcaagtgattctcctgcctcagcctcctgaatagccatgactacaggtgtgyggcaccatgccctgctaacttattttttgtagagacggggtttcaccatgttacccaggctggtcttgaattcctggactcaagtgatcctcccaccttggcctcccaaaatgttaggattacaggcaatggccaccatgcccaactgcaatctggcctttggctgttaaatttggtgtgtccccccaaaacgatcaagtattacatcaaaacagttttcaaagcacacgcctgttagataaagaagaatgcatgtgcacaggatacagcacttcatactgaagaagccagtttgtcagtttatgcaacttgttttgtatgcacatggattatagaaacagaaatgtatcaaagatggtatcttacttggtgagtggttggttagaaagcaactgcttaagatgctgggacaagagcttcttttctagagacagtcttatccacgcccgagctcgtccaacatcagtcttgatctcactcatgttttgaatatgcctaaagaatagtggcaacagcaaagatgtagattttaaggataaccctgactagaaaagaagtaaagagtgaacagtactgggcacagaaaggtttatacttaaagggagcaatggataatatacaattgatgttgattaaatctttgaaggttccatctgaatcatgaagttagtctcacatcataattgccattacaacacaagcacacggacaatgtggtaagataaagcatttaacacttattcactctttcaggctttattatgtccttgtggcagactcatagatatctgtaaataagaatttggttattcctgatgctccaaaaaaaktaatgaaacagggtgaatactcaagtttcttttcaaaataactgttctatagcataattaaatatcagtcacaactttaatccactgaattacttttcaagttgcactggacaacatatggaaaatatgaaatcttactttctatggcattagagaaaataagccagactgcattgataatctttaattgtttaattattttaaatattttaaaatacagggtcttgctatgttgcccaggctggtctcaatctcttggtctcaaatgatcctcttccctcagcctcccaaagtgcatgacccactgcacttggatcttatgacactgctttaaacccatacattgtaagagttgactaagtattgtacctaaaatatttaaaagataaaagcctctgccttcctcattcaataaatctgtgttagatatcttgaagtcttctaaagatttcttaacagtaattccaagtgatgattctcagatatgtatttgcttcaaactaaatctacctgattgcaattgttctgccacatatcctgccattatttgcagaatttttcttctgtaccttcttcggtgggcagaggtgtttaagggagttttaaaaactgaacaaaagaagctataaaatagtttaggacgggcacaatggctcacgtctgtaatcccagccctttgggaggccgaggcgggagaatcacttgagcccaggagtttgaggccagcctgggcaatttaagaccccatctcggccgggcacagtggctcrcgcctgtaatcccagcactttggacggctgaggcaggtggatcatgaggtcagatcgagaccatcctggctaacatggtaaaaccctgtcgctactaaaaatacaaaaaattcgccaggaatggtggcgcatgcctgtgctactcaggaggctgaggcagaagaattgcttgaacccgggagacagaggttgcagtgagctgagatcacgacactgcactccagcctgggcaacagaatgagacgccatctcaaaaaaaaaaaaaaaagcccctgtctctactaaaaatcaaaaaaattagctgggtrtggtggcaggtgcctgtaattctagcgacttgggaggctgaggcagaaggattgcttgagcctgggaagttgaggctgcagggagtgrtgattgyaccaccgaattccagcctgggtgacaaagcaagaccctgtcgcaaaagtaaaataaaataaaaaaatttagagatgctttaaaactcttctcagctgcatcttccatttggatttaatgtcaggaaacactacaatggtataaaaataagataaatgaaatcataaaaaatgctttcttcagaatacataagccaaaaataaacacagccataatyatttgagcaatttagttaaaagccacaaaatacttcaaagttatcaccacatgctaacacatgtattaataacaaatacctcatgtcctgaataagagagaccctgagcgttggcaacataactcctgagtcagattttcttctttctggtccgagggcaactatgtagaaaaatatcaacaaaatattagaaaagtaataaaaaatatacatggttcatattaaatactttgaaactgcttcgataagaacaaattttaacaatatatatcatctagcccaaaatgtcaaaaaacaaattttaaagaaaatagggtcttgctctgtcactgagcttggagtgcagtttgcagtggcatgatcgtggctcactgcagcctcaacctcctgggctcaagcgatcctcccaacttagccctgtccagagtaactgggattacaggtgtgcaccaccacacatggctcatttttaaaattttttgtagagacggggtctccctatgttgcccaggctgggctatattattaacacagtaaatcagctattttcttttcttttttttttgagatggagtttcgctcttgttstctaggctggagtgcaatggcacgatctcagctcaccgcaacctccacctcccaggtccaagccattctcccgcctcagtctcccgagtagctgggattacaggcatgcaccaccacacctggctaattttttgtatttttaggagagacagggtttctccatgttggtcaggctggtcttgaactcccgatctgaggtgatccgcctgcctcggcctcccaaagtgctggaattacaagcgtgagccaccgtgcccagacccagctattttctttctatgtaatctggaactgcttttggaaattttaaatgaatcacaaaagactacctagcaaacaatgcaatgtgtacaaattttggccataaggaccaggcacttttttttgtatttttttttttaaacatagtcttgctctgttgctctgttgccaggctgaagtgcagtggcgtgatcttggctcactgcaacctccgcctcctgagttcaagcaattctcatgcctcagcctcccgagtagctgggactacaggagtgcgccaccacgcccagctaatttttgtattttttagtagagacggggtttcaccatgttggccagctggtctcgaactccttaactcaagtgatctgcccgccttggcctcccaaagtgctgggattacaggtgttagccaccatgcctggccagttactttctagttacttgttctaatagctctagataattacacatgaaagcaatgtatataaattaagctactaaaaaatgtgaaacatctctgggctcatgaactgaagtcacacaattaaactcttgagtgtttgaaaaaaaatctaagctgtgtacggtggctcactcctgtaatcccaacactttgggaggccaaggcaggaggattacttgagcccaggagttcaagaccagcctgggaaacatagggagaccagcctggactacacagaaagaccccgtttttgcaaataattatatgggtttggacaatgggaagctaaatatatatatgtctttttttttttaattagcttttttttttttttttaaatcagctgagcatggtggtgttcacctgtagcaccagttgcttgggaggctgaggttgggaggatcayctgagcccaccactgcactccagcctgggcaacagaatgagactgtctctgaaaaaaaaaaaaaaaggccaggcgctgtggctcacacctgtaatcccagcactttgggaggccgaggcgggcggatcatgaggtcaggagatcgagaccaccctggctaacacggtgaaaccccatctctactaaaaaatacaaaaaattagctgggcgtggtggtgggcgcctgtagtcccagctactcgggaggctgaggcaagacaatggcatgaacccgggatgcagagtttgcagtgagccaagatcatgccactgcactccagcctgggtgacagagcaagactctgtctcaaaaaaaaaaaaaaaaaaaaaaaaatctaagatttcggactcttcaatctgataagtttctaccttaaagttcagagtccaaactacagtaattacagcatgcaaagtgagtaatctaaatagacactaagtataatgtccatgagtattctcttatgaagcctgaatagctaacatttatttaagaatagctaacatttatgaaagctaacaattatgggattacaggtgcgtgccaccacacctggctaatttttgtattttttgtagagacggggttttgtctcttatgtatgaaagaagaaagattattctcatatagcaacggctaagcaaacatctattggctaatatattgtagttgcagtgtttggtctcgtgctcaatgagatgccatggagtttaggcctttcatttctatcttcccatctataaataaaaatgaaattccaacatcatactcagcaaatacacctatataagtagaacttagaatgtgaatttttgctgtatattaaacctgccattttctcaggttttagattcattctactttggggggctgggatacaataccaaaacacataaatatatatgaagttggcactaaaggaagatagggaacattttggtgtattcggatccctatgcttttgacactagcaggtataaatgagtactgatggggttgccagaaggaagaggttgtggccagtccaatctaaaagcactactttcaagggccttccataccatgtggatgataaataggacatttgttgtggcgattttgggagggagtttcaatggggcactagacccattcatcttgacacccaagaggtaataaatgctgaagaaattgttccagacttgcagggaatgtgttacatgttattaaagaaagcatatctttttttcttttctttttttttttttttttgagatagggtctcactcttgtcgcccaggctggagtgcagtggcatgatctcggctcactgcagcctccacctccgggctaagcgatcctccaacctcagcttcttgatagctgggattacaggtgcatgccaccacacctggctaatttttgtgtgttttttttttgtagagacggggttttgtctctatgtttatgttgcccaggctggactcaaactcttggactcaagcgatctgcctgcctcggcctcccaaagtgctgggattataggcatgagccatcacacccggccacagctttctttttgaggacaaagtgagatggctcagagaaggcctctacactccagatgattagacagaatgaaagatggccacacaggcggtaagaaataggttgacagaggaaaaaaggggagttgaaaccataattaacaagttggctagagggagacacgacaaccagaagtaatcatgcctcttaaactagagaacaagtgagaaacttcattttaaataatagagatgggggtctcactatgttgcccaggctggtctcaaacgcctggctcaaggaatcctcccaccttggcctcctaaagtgctggaattacatgtgcgagccagtgtgcctggcaattcctgttgtttaaaccacacagtttgtggtactctattatggcagccctaggaaatgaatgcagtaatttattagtgactctggagagaagagtttaaaagcctgtgagcagagggcaaattaggggttaggaaatggaaccacttcttttatctagagacctaaaatctaagaaggtttccatgaatcctactccagctagaagagaattttataaactatgtaaatgtatacttccattactatttcttaattgaaaatactcaaacaataggccactttctccttyaaaataaagattcatggatttaattcttggctacgagaatttgctcatctgcctgaatcaaactacaaaaatagccagatgtggtggcgcatgcctgtaattccagttacttgggaggcagaggcaggagaatctcttgaactcgggaggttgcagtgggccgaaatcatgccattgcatccagtcttggcaacaagagcgagcgaaactccatctccaaaaaaaaaaaaagaatgaacacaagttaaacattttatttattttctatttggagtggtgaattttataaatgtagcacagacagcacgtttgtagagggcagggactgtatgtttctacagtaccatgtacagtctataggtaggtaagtaattaatagataatttctgatgaagataagatgaagagtgactcaaaattcctgggttagatccagaataaccacttaaaagcagcatttctggccaggcacagtggcttacacctgtaatcccagcactttgggaggctgaggcgggtggatcacctgaggtcaggagtttgagaccagcctggccaacatggtgaactctgtttctactaaaaatagaaaaattcaccaggtgtggtggcacacgcctgtaatcccagctattcaggaggctgaggcaggagaatcgcttgaacccaggaagtggaggttgcagtgagccaagactgcgccattgcactctagcctgggcaacaagagcgaaactccatctcagaaaaaaaaaaaaaaaaaaaaaggaaaaaaggcagcatttccactcccttcagtggaagggctctacacctaccccctgccaaaatccatttccagtttagtagaaccttgtctgaaggtgcaaagtttaagaactggctcaacgtttttatttattattattattttttggagacagggtcttgctctgtcacccaagctagagtgcagtggtgggatcacagcactcactgtagcctcaaccccctgggctcaagtgatcctcccacctcagcctcccaagcatctgggaccacaagcatgtgtcactatacctggctaattaagaaaaataaattttttttgtagagactgggtctcactatgttacctcagctggtctcaaactcctgggctcaagtgatccttccaccttggcctcccaaagtgttgggattacagaactgggtcaccatatccagcctcccaacaatttttttttttttttgagacagcatcttgctctgttgcccaagctggagtgcaatggcgtgatcttggctcactgcaacctctgcctcctgggttcaagagatactcatgcctcagcctcctgagtagttgggattacaggtgtgcaccaccatacctggctgacttttatatttttagtagagacggggtttcaccatgttggccaggctggtgttgaacttctggcctcaagtaatttgtcctccttgagctcccacagtgctggaattacaggcatgagccaccacactcagtcctcccaacaaatttaaaggttaaaacttttgagtgatatgtcaagaacagtctttgttctaggaccaattgtattctgaacttctttctctgaaataggatttcaaactactaggtgcagtgatcactagatcaaaattaatactgcctacccactatggtccctatctttccattcctctgcaactcttaaaatgtctctgactcctgtttagtgctgcttctgaagactcatgataataatccagcatctagtctcatcatgattcaatgctagtaagaataatgttcaaacccatcaaaatttttttttgtttttgacatggagtctcacttcattgcccaggctggagtacagcggagcagtcttggctcaatgcaacctccatcttccaggttcaagcgattcacctgcttcaccctcctgagtagctgggattacagacacctgccacccatgcctggctaatttttgtatttttagtagagagtgggtttcatcatgttggccaggctggtctccaactcttgatctcaagtgacccatccacctaggcctcccaaagtgctaggattacaggcatgagccaccrtgcccagcccatcataaatctttaaggatctttcctaaatatgacaatgcagactgtttattgccattcattaggaagcttaataattggcaaaaaaagtatttggtggaaaaccagattttaaaaacttaatttttgcataattacaacttattacttaagaatgagagatttcaatttaaactgatgttttaatacatatttcatattcctataaatatacatcttttctgagaaggagtcttgctctgttgcccaggctggcatgcagtggygcaatcttggctcactgcaacctctgcctcccaggttcaagcgattctcctgactcagtctcctgagtagctgggattacagatgcccaccaccatgcccggctaattttttttaatttttagtagaaacagggtttcaccatattgaccaggctggtcttgaactcctgatctcaggtgatccrcctgccttgccctcccaaagtgttgggattacaggcgttgagtcaacatgcctggcctcattactatttttttaacagaaaaactggcagagaagatggacactagagaatgcttttaaacttgatctgaatctttataaatatagttacagccaaggacaacagaaccttggcattctgattacaggagctccagggcaatgtagtcagcttatattcctagctgtctgattaaatacatttaaacactaggtttctaacaataaatactacatttaggatagtgttgccctctaggggcagtgagggaaaagaaattaggatgaataaaagggtctttaaggtcaggcacggtggctcactcctgtaatcccagcactttgggaggccgaggcgggtggatcacgaggttaggaaatcgagaccatcctggctaacacagtgaaaccccgtctctactaaaaatccaaaaaaaaaaaaaaaaaatagctgggcgtgctcacgggcacctgtagtcccagctactcgggaggctgaggcaggagaatggcatgaacccgggaggtggagcttgcagtgagccgagatcgcgccactgcattccagcctgggcgacacagcgagactgtgtctcaaaaataaaaattaaaaaaaaaaatagccgggcatgggatatgcacctgtaatcccagctactcaggaggctgaggcaggagaatcacttgaacctgggaggcagaggttgcagtgagccgagatcgtaccactgtactccaacctgggtgacaagatcgagactccatctaaaacatttctgaatgtccaaagtcatccatactttttgaaaaggttccgaaatggctgattcagtataaagcaattttatctcaattagcttcccatagttacttctacttttttgtgaaataaatggttattttacataaagaaaagcatgtgttgttgtgaaaaatacacagtaggtagaacacttagcttaaaaaatcctacataattagctaaaaaattatgacacttctaacatgttatattttctataaattgaagagagattcaactcctgaaatttttgagacatatgtacatattttctccctgaaagatcattaatgatggttataaaaacttttttttttttttttgagatggagtcttgctctgtcacccaggctgtagtgcagtggcgccttctcggctcactgcaacctttgcctcccgggttcaagcgattctcctgcctcagcctccccagtagctgggactacaggcacctgccaccacgcccaggtaatttttgcattttttgtagagatggggtttcaccgtgttggccaggctggtctcaaactcctaacctcaggtgatctgcccaccttggcctcctaaagtggtgggattacaggtgtgagccaccgtgcctagcataaaacttgtaagaaaaaaaaaaattctaatgctagtgagagtaatgtatccttgtatggccatttacaattcattgggggttttcacatgataccttatttgatcagcatgaccgttctagcctaggtaatctcatttttcctattttatagatgacgaagcaggacttcagaaagggcaagtaacttttcccaggtctcacagttagtaagtaatattgctccttctactttatcccattattggcaaaatgagtaaattttagcttgagagagaaagagatcaagacaaggccaaatagtattgagtcttctcagagtccagtgctgctagttctttaccaatgatgtcatacctggtgattctgcaaggtgctcttgtttctcttctctgtcctgaaattgaattaaatgtgaccacaaagccgacttcccctgaaagtacaagatgtgtaaaaatttcataagaaataattcatcaaaaaataatttctcatccaaatcattcatattccaatagccatttagaagtctggtgacccaagctcactcattcctagttgtatgacattctgagcatcttctgcatgtatcataaaggtcatcctgtacctcactgacaagactaccaagagcctgggaaaaggaagcagctaagcaaagggccagcatggcaggcagaagatttctgatgtctgctaggttgttacttggttgtatgtaattagggctgtctacatgggctacattagtaaccatggaattaaaatgctctagcagcacagaatgtacttgtgtacatctacatgtaaaatatgtttggatatatggagtggcgataagagaaaaaaatcgaggtgagaggagaaagagaaaaagggaagaagaaagaaacatgcacacatcagaaaaaaatcagaaagggagactagagagacaaaagcaaagagaccatttgaatgatttcaccctgaattattagataacttaaaatggtaaggaactgttaattctggacagtgacaaaggcaaacatttaatggaacttactagggatacagcctctgcaatgatgtgctatttcatcctttcccgcttagcaggaaagagcccaaaccacctcctgctcatgggttatattttctttttctgaaattaaaatgcctgtggcatttttctagtccccttgtgacaaaagagcctattttttttttaatgacatatttgtctccttgttacatttcttaacagggctcttaactggccatgtcaccaggacctcctaaaactgttacctgcttgacctgcaagccatggctccatatcctctccagcaggtcacaaaggctggcgatcaaggtgttctcctccaggccggtgatgtttgcttctccatggccaagttccaccgcttcatgtcccatcttctccaccaacatgcgctttgtctaagaatatcacgtgtagtcataaggcaccccagcagtgaaaccaaaaaccaacaagtcaattactaaagtaggagacttggtttcccttcattatacttctatttgcagatttgtaatcaccttgggaaaaaaatctcttaatcttgatgttcaactaactggactaatataatttatatgtcactattttgtcagaaaaatggagtgtgactaaagagaatataagataatatttgtaaggcatccccatgttgaaaagatgcttatatacaacagttgtcaaattattaacttctgtgatattggggaattacagcagacttagaaaatgtactgtcagggctgggcatggtggctcacacctgtaatcccagcactttgggaggcccaggcaagtggatcacctggggtcaggagttcgagaccagcctggccaacatggtgaaaccctgtctccactaaaaatacaagttagccgggcagtagtggcacacgcctgtaatcccagttatttgggaggctgaggcagaagaattgcttgaacccaggaggtagaggttgcagtgagctgagatcacatgccactgcactccagccygctgcgtgatagagcgagactctgtctcaaaaaacaagaaacaataaaaaaagaaaatgtactgtcagaatatggaaccccatcctgccaccacaacttgccctatcactgccccagcatcttagcatactaaagattcttgcacttagtttgattgcacttaggtaaaaaccagaatacaaatgggcagctctaaattttttgagaactctaatttgtgaatgaaccaggactttacttctccttttttatcttttctttgttcatcaagcatgcaccaaaaaatggaaagaaaatggaaatcagtttcatgtaagttaatttgcatcagtcttagtagcttttataaaatgtaaaatgaragagaatctagctcttttaggcaagaactttaattcaccactatatactgatgctgaaaatagtagtacatttattgaatatgcagagaaggtactcaagaaatgactgtcaaataaataaataaaatcattagctaaaatgatgttttaagttttgtcaatttgtactgctacctccaataaacacaggtttctgagaggagaacgttgtgcaatatacacaaacctacaacacagctaaggtatttttccttatggggacaaaaaccatgtacaggcacaaataaggttgtacacaggtgcatacacagacacaaaagtgttgcctttcacataagatgacaayattcctgacgcaaattatgagtggcttaagacatccgttcatgttggtgaggaggagagcaatgtctgaaaaggtgagaaaaatggtagaaggctctcatgtcattgattctgtggggaatgaagaacccatggaggttcaatacccsagtaaagagcacatgaggtcaatgccacagtaaaagttttcttctagcaaaattacatgcttaaatgggggttaactcagttcatcttagcctcacacatggtgtaaacatgaatgcacactgtctggcatcagtgaataatacataccttcattctacattcttttaataagccttctacgaatttacagttggtctgtgcaataactgcaggagagaggtctgacagtttgggttgyctcaggttttttcctaaacttcgtgcctcttgcatatatttctaaaaaatcaaggagtatttttaatgcgtaaacattagctattcttctaatcttcttaaccttatacaaacaagtgcagagacaaatgaaatgcaaaaaagtccgtaagtgtatgtgcatataacaacaattaatgttttagtgtactaaaagacagaggacactcatatgccaccccataacaactgttaactcctgtgagaagtaaagtgacagaaaccccatcacgttaaaactcattcaaagtgagakgacatttcatttcatttagtctttttattgggaatacaaaaggttgtgaagtcaggactgtggttgggacaaaaaaatttaggtgtttagatcacaaatccaaggttctgcaggagyccagctgttctcagatcactgatttcctccactcctttccccatacagtaagacttaacatacctctagcctcctgggcagtgctctccaatctaaccctttgctctataatcaagtcacaacagtaaaatcaggagctttcgaatctggttgtaactaattttatgactcaggtgttatcaactaatgtktgtgcatctcagcttgttaaatgggcataaaacatgcccccctacctccccaaaaggctataggatcactctgaaaagcacgatgtgctccaagtgaaggtggcctctttctgtgatgtttttgctaaagccctaccttgccttgttctataatcaagagaaagtkaattacagtgttacttttggggtttgtggtaactctaaggtatcacagaaacttaaccaaatgctcttgagctttggttagtgaatttctattaaaaaaatcactacatgtgtttagtgcaagacatgtgctctctctcttctttctatgctgtctataaaagttcatccagaggccaggcggtggctcacgtctgtaatcccagcactttgggaagccgaggtgggtggatcaccagaggtcaggagcacgtgaccagcctggccaacatggttaaaccccatctctactaaaaatacaaaaattagccacgcgtggtggtggacgtctgtaatcccagctactcgggaggctgaggcagaagaatcgcttgaacctgggaggcggagattgcagtgagtggagatggcgtcactgcactccagcctgggcaactgagcaagactccatctcaaaaaaaaaaaaaaaatcatctggataccttatgtttacatcaggatcacagggcagaattttccaaaaagtccaagtgacttaggaccatatttagagaataactgctctacattatatagtaaaagtagcagtttattggctggtagtggggggcagcatggagactgagacggcaagccagcacatcctcccacgggcacatatgtgaaatctatccttactatcttcagaggagagcttgatattataaaagaagatgtgtaaaatcctttgcattctttaaaaaagagagtttgtacatttaatatatttctcctttggaagaaaataatctgctaagtctggtacaaataaaaaaaatcccactgattagggattccactaatctgtttacctgctacctcccaacctttgtgacgaaaggcaaaattaacaaaataatgtttttttccagtccaatcattttaacagttgtctctaattctcaattttctcttatttctttgaccctcttaaaaatgtttgaagcagaggccaggcattcgagaccagcctggccaacatggtgaaackccatctctactaaaaatacaaaaatgtggcgggtgcctgtaatcccagctactcgggaggctgaggcaggagaattgcttgaacctgggaggcggacgttgcaatgagccaagatcgtgccatcgcactccagcctaggtgacaaaagcaagactccatctcaaaaaaaaaaaaatgtttgcagcagaaagaagtatacataaatgttatgagaactgcagagtttatttttattttttgagacggaatctcgatctgtcacccaggctgaacagcagtggtgcaatctcaactaactgctacctctgcctcccaggtgcaagcaattctcctgcctcagcctcctgagtagctgggattacaggcacgcgccaccatgcccagctaatttttgtatttttttttgagacggagtctcgctctgtcacccaggctggagtgcaatggcttgatctcggctcactgcaacctccgccttccaggttcaagtgattttcctgcctcagcgtcctgagtagctgggattacaggtgcacatcccatgcccggctaattatttatttatttttgagacggagtctccctgtgtcgcccaggctggagtgcagtggcgcgatctcggctcactgcaagctccgcctcctggtttcacaccattctcctgcctcagcctcccaagtagctgggactacaggcgtctgccaccacacccggctatttttttgtatttttagtagagacagggtttcactgtgttagccaggatggtctcaatctcctgacctcgtgatccacccgcctcggcctcccaaagtgctgggattacaggtgtgagccaccgcacccggccacgcccggctaatttttatatttttaagagacggggtttcatcatgttggtcaggctggtctcaaactcctgaccctgtgatccgcccacctcggcctcccaaagtgctgagattacaggcgtgagccaccacgcccggctgtaatttttgtattttcagtagagacagggtttcactatgttggtcaggctggtctcaaactcctgacctcgtgatctgcccgccttggcctcccaaagtgctgggattacatgcatgagccaccctgcccagcgagtttatttgatttttaaaatctatcaaccattaccagcagagaagtcaaatgtaacaaggtctatataaatggtctgaaggttagtttttatttatttmttattattattttttttcttgagacgaagtctcgttctgtcacccaggctggagtgcagtggctcggtcttggctcaccacaaactccgcctcctgggttcaagcagttctcctgcctcagcctctcgagtagctaggattacaggtgctggccaccacacctggctaatttttatatttttagtagagacggggtttcgccatgttggccaggctggtctcaaattcctgacctcaagtgatccactcaacttggcctcccaaagtgctgggattacaggtgtaagccaccacgccctgcctggttttttttgttttaaaacagagtctcactctgttgcccaggctgtaatgcagtggtgcaatcttggctcactgtaacctccacctcctgggttcaactgattctcctgcctcagcctcccaagtagctggcattataggcgcgtgctacaacacctggctaatttttgtattttcagtacagatggggtttcaccatgttggccaggctggtctcgaactcccgatctcaaatgatctccccacctcagcctcccaaactgttgggattataggtgtgagccaccgcccagcctgaatacttttttgtttgtttggtttttgtttttttgagacagagtcttggtctgctgcccaggctggagtgcagcggcatgatctcagctcactgcagcctccgcctcccaggttcaagcaattttcctgcctcagcctcctgagtagctgggattacaggcacatgccaccacacccggctagtttttgtatttttagcagaggcggggtttcaccatgttggccaggctggtctcgaactcttgttctcaagtgatccgcccgcctcgtcctcccaaagtgctgggattaaaggtgtaagccactgcgcctggcccctgaatactttttaaagtcaattactggattaaaaattaaccactgtcggctggtcaaggttgctcacacctgtaatcccagcactttgggaggccannnnnnnnnnnnnnnnnnnnnnnnnnnnnnnnnnnnnnnnnnncgtggtacgtgcctgtagtcccagctacttgggaggcctaggcaggaagatcaggaggtggaggttgcagtgagccaagatcacgccactgcattccagcctggcgacagagggagactccgtctcaaaaacaaacaaaaaattaagcactgtttaaagtttatgtcctgttttatataaaggaaaacaagctagacggtggctgtcctatgagtgaccaatttactgagcccccagtacatatggggcaggtacagttattagccaacagtggattccatagggccatgtgcaaagtctccttctgggcatctctgctggagccatagaaatagcaacattccatggacatgcacagaaaggatacagggggcggcaaaaggcctctcttcacagcaagaagggaggctgcctctgcaaattgcaaaaacagagcaactgcctttaaaataaacaagtgatgataaaaataacatctggaggaaaaaacatatttcaagatgaaaaatataggagagagacttttcacaagaaatgcttttataatacagtctagaagtaaccccagatttcttctgagattactactgtgctcttctttatttctgcttaagacaaatgaaacaaaccactaggaactacctatgaaaatatatcctattattcaataaacactgaactaactgctctttaatacaggctctcccagaattttctagtaaacgccctagccctttacaagttggtgttcaacttgtgaagagaagaccattgtaaaatagatttaagytagtatgacataatgggggaaaactataagcaagatttctaagttgcttgttgcctcaagtgaacagtggttagtgcaagctggcatgcagggtaaatggaaagaatattggcctagaagtcaggagtcttgggctataggtccagctctgtctttgtgtgcttttaactctgggctaatctcttggacttcaatttaatcatgtcaaattggacaagatgaccttaaagattcctcttggcactgagattctatgttgatgactgaattttctgaccacataaaatacagaccaggaaggggaaattaaaattctgtggagataaaacccagcaaaagaaaggctatttgaaattcaatcacatctgtacttctggaaaacgcttaaataaaggggagtttgtatatttaatacatttccccctttgaagtaaggcaatttgctatctagcacacaaaaaaaatcccactgattagagacccaaatgattagttttacatgtcagcagcatagaattactcatattagcacacacaaacacagaaagggactaaacataacaagaagcagagagcaaaatggggagtgtgagttcacatctcaaggtcatgtgaggcattctagagctatgtgcactcacacatgtgtaacattcaagtaacaccaaagacaagattgggggaacatctggtaaagcactttcaagcaaagaacataccaggcagcactcagagaaggattttttaggaagtcgtgcaggaggaggtggaccctggtcccactcccagaatgccatggagttctgacagaccaaaagttccccggaaggctaagaggatggagaaatgccaatgacaggaaagcaaaaaagaaaaggatagggagaaagagacaagcagaacaagcatgcatatgataaaatcacagcaaaagagagggaagggaagaaaatacagtagccggaaaaaaaaaagcactacacaggtgatgcctcagttcttaataaaatgtttaaaatcatatatgtatgaacacaacaaaaacaagagatgtttgggatgatgttttctgctttatttttacaaatttgatactagaaaacagttaacaagtcttctgattgcatttctcttttgatcataagaaacgaaacaatcaggctgggcatggcagctcacacctgtaatcccaatactttgggaggctgaggcaggagcactgcttgagcccaggagttcaagacctgggcaacatagcaagacactatatatatatgcagatttcacacagaaaaaaatcaaaacttacttgttgtataattatggtcttattttcaaagagtacaaataaaagtktaaggatcttaatttaaaaatagttttaaaacactttcaaaaatataaagtagatttagagattcaagaaaaaaaactggtgccagcaagccaagaacaaagcataggcaagtacatcacactactccttataattatgcttgaaacttagaaatgtctaggcttctcatgcagacaatttttctcctataggagacatagtaactaaaaatttatcctcaacttgatctttacttgatgtaatacacagaaagacttgttttagagccttattatagatgtcttgaaattacaaaaatggaaaaaagggtgttttctgctatatgtccgtacaaaaggattaatattttaaactataactaaacagttttttttttaaagaacattaagaatytacacaatgacatctgctggaaggaataagcctagttcatggcgcttgctgtgaggcaccccaggaaggtagaccacatacctccctcaagtcgttgtccagcccaacatgctcagaatgctggcgaaggcgttctttcctgcgctgtgcagtggcactccgacttacccagcgactgaaacaatcaaattatttaaaaatgtgttccttatctttaaaatagaaagcattaaccattcaacacaaaagactgacacacacattttaaaatcaattatttaaaaaatatatagcagctttgttaaaatataattaaaataccatactatgcacccatttaaaacatacaaccaaacggtttttagtatctttccagatatgtgctgtcatcaccacaatcagaatttttaaaaactgaggtcaaaaaggcacagtatcaatacactttagatacttacatacataacaataagtcaaatcttaaccgagttagtccttgattatattgacatataatagtaatgccttgacttgctcaaagtaaatattatgaatattttttaatacaaagaatattctcaaaacccataatttagaattacttaattctagcgtcctaaaagaatagaaatgtatgaagcttccaaccttttaaggaaagatttctatccaacttgactagttgcaatggcttacacctgtaatcctagcactttggccggatcacttgaggccagkagttcgagaccagcctaggcaacatagtgagactctgtctctacaaaaaatttaaaaaattagcctccttagctacttgggaggctgaagtgggaagataatttgagcccaggagtttggggccgcagtgtgccacgactgcactcctgcattccagcctggatgacagtgatatcccatctcaagataaatagaaagattcaaactcataagagtgagtcctcatctgtaaagtctaagggttgtactcaaagaccactgtgattcctttttgctctaaaatttcatgactgtgtttctgaagtgatagcttgtgtttatcagttttagaaaatatttataatataaactcagtatcaaaatatgcaggacaaatgagtttaaaataaaacctgagctcttttccaaggcctataaaactcttaaatataaagacctctgcttcattctctctgatcttatatcacttctcccctaattactatgttccagtatagtaacctccattctgtttctaaatgattgataaaatcagtgctagttctataataatcttctctgctactaaactgctggtatcgaaactgcctttcagatgagatcaggtgcgttcaaggtggtatggccgaagatrtaagttgccttccagctcaaatacctttgtttttggttaataatgattcaactcatgtgccctagacccagacctgccctggatgatatgaggggcttaaaaatatataatgtttcccttattcaaaggtccttttgtcgccagcctagctacctacaggctccagcttagtgtgtaagactcaaccatccagcgattatccttaatcactcctttctatcatcttcattcagtgaagaatttggaacctggctcagttttcttttcttccctgctatgggaagtacaaagactatatagataactttgtcttaaaattctggggtcgtctaacatgcaacttcacctccactcagctttagacgcaaccaggacatcacactaaatcaaatggtcatccagaactcctctccaaatccaatggtcatccagaactcctctacctcagaaatcctgaactccaccatcttagccactgacccccatctcccattacattagctcttccatgccttgactctcacttaagacccctggtgctttctcgtctttctgttatgaacataaattctgcggaaagccacctaaactaytcccattctagcactctctcctctgtaataatcctctacttccctccttacctgcccaccagagccccaaaccscggatgaagactatcccctcacttccctattcccgtacccacacagactagttcccaatttctctcacgactacccatgaatcacttcacctgccttttatcaactcttccccattctcctcaaagactactgcaaactcttcaccctcaggtacccttgcctccttcttcctgccctctacttagacaatacacacacataaacatcctcatctttcttctaatctcaaagtataaaatayattagccaaggctcaaaactgtgtcttccacttgcatccttgaccaattctcccgtcttttcaacccgctccattagtcacctcctttgctgtatcgccaatctttttctcagtggaatctcttcagctgacaagcatgttggtctccctcgtggccytctgtagtcatgttaacatctgtttcttcacacctctgatgtaaaaattcttaaaatatttagatgtaagacttctacttatttacgtttggatcttcagttcatttcaaatcatctacttcccttgaaaacgctttttaaattttgttttagtttgtttgtttgtttgagacggagtcttgttctgtcgcccaggctggagtacagtggcaagacctcggctcactgcaacctccacctcctgggttcaagtgattctcctgcctcagtctcccgaatagctgggatcacaggtgcacaccaccacacccggctaatttttgtatttttagtagagatggggtttcaccatgttggccaggctggtctcgaactcctgaccttcatgtgatccgcccacctcrgcctcccaagtagstgggattacaggtgcaagccaccaatgctcagctaatttttgtattttttgtagagacagggttttaccatgttgcctagatcagtcttgaactcctgagcttaatgcgatctgcctgtctcagcctcccaaagtgccgggattacaggtgtgtctgttcccagctgcctaaagcccccccactttttttttttgagacggagtctcaggctaccacccaggctggagtgcagtggcgtgatctcactgcaacctccgtctcccgggttcaagtgattctcctgcctcagcctcccaagtagctgggactacaggtatgtgccaccaaacccagctaattttagtattgtttagtagagacagggtttcattatgttggccaggctggtctcgaactcctgacctcaagtgatctgcccgcctcggcctcccaaagtgctgggattacaggcatgagctaccgtgcccagccctaaaaatcctcttgatgaagccactgaaacccctaactgccaaatccaatggctattatttgatccttagcttactcaaaacctcttctacatttagtactgctgatcgctctttctacttttaagctcctgcaattttctttttttttggagatagagttttgctcttgtcacccaggctggagtgcaatgccgcaatctcagctcacggcaacctctgcctcccaggttcaagcaattctcctgcctcagccttccaagcagctgggattacaggcatgtgccaacatgcccagctaagttttgtatttttagtggagayggggtttcaccatgttggccaggctggtctggaactcctgagctcaggtgatccgcccgcctcagcctcccaaagtgctgggattacagacgtgagtcactgcgcccgacccagctcctgcaattttcaacctcagtgtttccaatgaaataagttctgtcacctctgagcctttgtccatgaagttttctcccaactttcattcacctttcagatagattagaggccactgcttccagaaagtgttctatgactctttcaaatctaagttagctacccatcctgtacgcctcaattatagtatctatcacagagtattatagttacttatctccrttttctataaaatctcctctagaagggccagtatcttgtctgtcagccatcttactggcaaagtctactatagcacctgccccccscttttttttttttgagacggagtctcactctgtcgtccaggctggaatgcagtggcacaatcttggctcactgcaagctctgcctcccgggttcaygccattctcctgcctcagcctcccgagtagctgggactacaggcacccgccaggctaattttttgtatttttagtagagacggggtttcactgtgttagccaggatggtctcgatctcctgacctcgtgatcctctggcctcggcctcccaaagtgctgggattacaggcgtgaaccaccatgcctggccatcatctgccccttgtataaatacaattaagtaaacagagatgcagtctaacatgtaggtttacagatgttcatcacagcatatagatatgtaataacaaactgtatttcctttattccaagactcacattttggcttttaaatgttcctgaaattaggatgcatctttcagtccatatgcatgtttaatatatactttttcctaaaagcctttgagttaattgcagatcgtacaaccaacagtagaatcaagaaaayatactcaaaacaaccgaaatgttcaacagtagagggtagtatacaatgaaatctcatgcagtcattaaaaaattcaaatttctaataatatgagaatgctaatgatacagtaataaaaaaggtataacattctataaacattttaattttgtttcaaaaacaagatgtgtgcactcccgttctcctgctcccccaaccttgctatgtaagagcataatatcacattttaacattccatggtgatgcgattctgagtggttaaaaattaaccccatcactttctagtattccagattttttctttttttgagacgaagtctcactctgtcacccaagctggagtgcagtggcttgatctcagctcactgcaacctctgccgctcaagtgattctcctgcctcagcctcccgagtatctggaattacaggctccagccaccgtgcccggctaatttttgtattttagtagagatggggttccaccatctcggccaggctggccttgaactcctgaccttgttatccacctgtcttggcctcccaaactgctgggattacaggcatgaggcactgcgcctggccaatattccagatttttaaagagcaaatattgtatccatctattttttaaaattttctcagctcttacctatcatcctcatgaaatgtattcattatcctaagaatacttactctttttacaatggtatcaaggaaggtagcccctctcaaaatagtttcttaagaagaggagtaggtttatggtttatataagggaaaaatgtgcaaagatctagttacagatctttgaagtggaatccctggaaatgtctccaaagcaaaagagcaatgtaagactgtaaaaaggatacaaaaagaatcgggggtgattgaaaattatgaaccacaaaaaacacattaagattctgaaacagaatataaacacaacctgaagatctttaaaggggaagaatagaatataaataacaaacaaaatgtacaaagacctgggtgtagatctttgatatggaggccttgaaaacagccctgtagcaaaaaaggtcagtataacacaaagtttgctcagggattttaaaaattagggttaatgggcaaggtagtccaaataaatagtaaaaatatgaaacagaatataaatactagctaacggacttatataataaacgaaaaggaaggcacaaaaatataaatggcataaaactgtgtctttggcaggcagaaaaggataaagattaacttaaatataactagctcttactatacactctgtggaacaaaatggcctacttaattttattttcaaaacagggaaatgagcactgygcttaagcaaaytgctatgaagtccacacattcctggtcttgttaagtaattaatttattctttgcattattaaactttatttactaagcataattttaccaatgataatcacaattgctgaaatactaaagactgcttattttgttctgtcttgtaaacagcatatgaagttctctcaacagttgatccacaggcatggttataaatccatttaccctgcaattgttctgagatcttttctcttgactatatctacctgaaaacgtaatgactgaggcttcgtgtggaaatgggaaaccataagattatatataaggcaaaagcaagaaaataaggctataagatttcaaaattaaactcctccctcctaagcactctctacttttctttcctactttgtttttcttcataactcttatcatctgacatgttacttgacatattaggttccttttttttttgtttacttgcacttggaagcagagatttttgttgttttgttcattaataaactcgtggtgactaggacagtcctcacatatagtaagagttccataaatatttgccaaatgaatgaatgaacaatctaatgccatcaaaaggaaaaaaaagcaccgggtgcagtggctcacgcctgtaatcccagcactttgggaggccgaggtgggcggataacctgaggtcaggatttctagaccagcctaaccaacatagtaaaaccctgtctctaataaaaaaataaaattagcctggcgtagtggcgcatgcctgtaatcccagctactcagggaggctgaggcaggagaatcgcttgaacctgggaggtggaggttgcggtgagctgagatcgtaccattgcactctggcctgggcaacagagggagactccgtctcaaaaaaaaaaaaaaaaaaaaaaaaaaaaggaaacaaaaactgttaaactaatagtctatccagatcaaagtgattcgaacaattaggatacttcacaaataaaagaaaaaattaataaactgatggctaatctgttcttatggaaaattctcttaattatcatccacttctgaaaaatagaatattgtatctagtaccattatctggaaagtttgaaccctcacaaccatcagtatctattagcacattttttttctttttttaaaataaagatgaggtctcattatgttgcctatgctggaggttattcacagacacaatcattgcacgtcgtggcttccaactcctggcctcaaggaatacttcctcctcagcctcccagtaggtagtactggggagtgccaccaggcctcgcatcttagcacattttttaagttcagtgtgtataaaagcagggccaccccttcactggagggtgaaaccctgcaaactaaggcaagtacaataaaaatttcagtcattagttatttgcttctgtcttgtaagcagcatattaaatgctcttgaacaattttcctccccaagactttggtataaacgtgcattttctacaagaggagaaaatttcattctgaatatataacttttccacatttctagtgaaccatcctctagtactgccttcattaaagttgagacagccttttaaatgaaaggtcaatcaaacgaagggttttttgtttttttgaaagagggtctttgcaaggttgaccaggctggaatgcagtgatgcgatcacatcatggctcactgcagcctagacctctcaggttcaagtgatcctcccacctaagcctcaccagtagctgggactatagttgcatgcctgactgcctcccaggctccagtgattctcatgcctcagcctcccaagtagctggcatgacaggcatgcaccaccacacccagctaatttttgtatttttagtagagacggggtttcgccacattggccaggctggtctttaactcctggcctcaagtgatacacttgcttaggcctcccaaagtgctgggattacaggcatgagccaccatgcctggcctaatttaaaaaaaaatttttgtaggggcttggcctggtggctcacacctataatcccagcactttgggaggccaaggagttcaggttgcttgagcccagaagttcaacaccagcttgrgcaataaggcaaaatcctgtctctataaaaaaatacaaaaattagctaggtgtggtggcatgtgcctttagttccagctacttgggaggctgaggcaggaggatcacgtgagcctggggaggtcaaggctataatgaaccatgatcgggccacagcactccagcctgggcaacagagcaagaccttgtctcaaaaaaaatgtatgtatttttttgtagagacagggtcttcctatgttccccaggctggtctcaaactcctgggctcaagtgatccttcctgcctcgtactcctaaagtgctgggattacaggcgtgagccaccgtgcctggcccaagttttttttttgagacagggcctcgctgtgttgcccaggctggataatagtggtgatcataggtcactgcaacctccaactcctgggctcaagtgatcctcccatctcagcctcccaagtagctagggatacaggcatgtgccaccacacccagctccaaatgaagttgttgttgttgctgtttttaatccacaattctttttaatactatttttattttttgagacagggcctgtttcccaggttgaagggcagtagtgcaatcacggctcaccgtagcctcaacctcctggggctcaagtgattctcccacttgagtaaatgggactacaggtgcacatcaccatgcccagataatttttctatcttttttgtagagacagggtttcgccacattggctaggctggtcctgaactcctgggctcaagctatctgcctgcctcggcctcccaaagtgctgaggttacaggcgtgagccaccatgcctggccacaattctttcactttactgtttggtgttccttttctaaatatttaaaaggatactaaaactaaaaattttcttttcaaaaaattttctctttagctcttcaagagggaagatagagcctaagaatatatcttgctacccaaagtactatcctgtcttctctggaaccactcctcttaacagaacccagtttaaggcagaggtgagacatctgaaggctctttcatctggaaggatctcattagactggtgtgacaggctgttgctaaactctcttatgttctcctaaaagctggaaaaggcaaggaaggatcattccctagaagcctcgaagggagcgtggccctgccaattccttgatttcaaatttctaccccccaaaactgtggaagaataatttctgttgttttaagccactgagtttgtggttctttgttatagcagccctaggaaactaacacagatgataaaggtctaacctttctaaattccattagatagtattatcattatatttaaatcgccatttaaagtgtggcttttccaagtgtactttgcttgaaaaagaaaaaaaaatctctagcctttgtttttttctttttttttttaaatgatggatttaaaggtcaagcactgacagaagtgtcaatccatatttcaaatgcattaatgtggtcatgaaaaaagtaatcagatagatgtttaatagttaagcattgtccatttgagttgcagagcaccccacccttcattcattccttcaaccaactactcaagtgaagaacatgcttacttgttactggttggtcctgttgccaagacatcggactgtaactttggaaagaacccctgctcatatttgccttgaccaattttcatatcaagtagatgtgggtggattgcagtgtgatccattttcatcagtctctgctcaattgattgggctataaattaaatttataataaattagagacatttcattgctagcccttcaaaaataatgcttcctccactcatgcacctacagagaacccaatcactctgacactctgaaacagatattgtgtgtgtgtgtgtgtgtgtgcacgcacgcacgcatatatgcatgttttgagacagagtttcactcttattgcccaggctggagtgcaatggcgcgatctcagctcactgcaatctctacctcctgggttcaaacgatcctcctgcytcagcctcccaactagctgagaccgcaggcatgtaccaccagttccagctagttttgtatttttagtagagatggcgtttcatcatgttgctcaggctggtcttcaactcctgacctcaggtgatccaccctccttggcctcccaaagtgctgggattataagcgtgagccaccacgcccggtcttgaaatagatttttacaagggctcttcagaaattagtataatgtaagtataaaaagttaactttaagtaaatattggatgattaattttcatggtattttctgcctttgtcaaaatcagggccgcggggatgaaaagcctacaattttgtattgaaacagtttctcttaagtaagaaattcaatattcttacacaaaaatatggttctaagtacaacattaaagaaaatgatagcaaataaaatatttttcttgagctgaaatacaagttaaagagaagacgcaagcacaatggccttattaactttacttctttatacaaagacctattaaatattcgtggttctccatctgtaaaaacaaggaacggtgtgaagtttattacctcacttttagcaacagtcacgttctcattagtaggagtcattttggagtgtttattagatcaagaaggtaatacagcaaaaagtcatataagcaggcatttagaaaatgtccagaggataagaaactggccttttgaagaataaaataggtgaatgttaagataggattactaaacatttctattttaaaaccactaagagtcagggatgttggaagatgtctcaaagtccccagaaacagtgatctatttctcaggtaaacaaataaataaaacctgatcttaaacattttaatcaactgaattgtcaagagaaaatatattttagaagcaagcctaggtctctgatcctctgcctagagattacttaaaaggggagaacaagcagtaatggtagttgtgtgataaacagaacacactgtgggagctgctaattttgtgatttaagagaagaaccaggtgcctttataaatatttcatagaatcagtttatgttgccccttttccttttttttcagatggagtctaggctggagtgcaatggcgcaatctcagctcactgcaacctccacctcctgggttcaagcgattctcctgcctcagcctcccgagtagctgggattacaggcacccgccaccatgcccagctaatttttgtatttttagtagagatggggtttcaccacattggccaggctggtctcgaacccatgaccccagatgatctgccctcctcggcctcccaaagtgctgggattacaggcgttagccattgtgcctggccacagtggtattttcaagagtattatataatttctgtgatgacagtgggagtaccaaactctctgagaggctgaaagaaaatctattttaattggaaagactttctggaagcacacaattaaggtattggtgcttagttccatctaaaaaattccatcaggaagggagaaataaaatttgtgcaacaaggcattatgctattcacatggctattaaggcactggaagtcattttattctctgaacaaggatagacaatttcattaattctactttctcaatttccaaaaccacataggtaattgccacttcctgaaggggctccagggatctaccctgattcgtgggaatacaacagggtgatgtttctatggttacataaaagacatcatttacatacttctcccttacatacgctaaagcttcagcatcatcattcctgactttgatctatttaagtaaagtgggaaaggcaggcaagcaatcaagagagacagatcaaggaagctccacatttgctgcctcctttttctccagaggaaaagttgctgtcaaataactccaacatttgaagggaaagaaataaaagggagggccgtcaggtgataggtatctgcttatctggcaaagaacaggttarggaccaggcataattgtataaaataagtgtggactagtacattttacatagttctttcttgaatgaacagctaacatgatgtkaaggcttcctgtgccagaaatcagacctggattcaaaccatggctcgaccaatcactagctatgcaaccaccaaccacaggcaagttacttaacctctcagttttctcaattgtaaaatgagggcagtaataaaacaaaataaaaataagtattccaggccagacatgatggctcatgcctgtaatcctagcattttgggaggccaaggcaggtgttttgtttgagctcaggagttcaagaccagcctgagcaacatcgtgaatccctgtctctaccaaaaatacaaaaaattagccaggcatggtggcatgcatctgtagtcccagctacttgggaggctgtggtgggaggatcacttcaacccaggaggcagaggttgcagtgagccgagatggcaccactgcactccagcctgagtgacagcgagattctgtttcaaaaaaaaaaagggtgctgggctcacacctgtaatcccagcactttaggaaactgaagcaggtggatcacttaagcccaggagttcaagaccaaccaaggtaagataataacctgagcaacatggtgaaaccctgtctctacaaaaaatacaaaaaattacccgagggtggtggcacatgcctatagtaccagttccccaggaggctgtggtaggaacatcacctgagcccaggaagttgaggctgcagtgagccatgatggcaccactgcactccagcctaggcaacaagtgagaccctgtctcaaaagaaaaaaaaaaaaattcgtgaacacctggcatgatgactgacatagtaaatactcatgttggctattaatatgattatttatttaatggactatattacactcctagacaagactggctaagactcagatttaactgctttctttttatttttttgagacggagtcttgctctgttgcccaggcgggagtgcagtggtgccatcttggctcannnnnnnnnnnnnnnnnnnnaaaaattcccggagggggggccaagccataaaggaccgttcccacggaggttgggtaagacatccccctaagcccaaaaattagggcccaatgaccactagggcccccctgcttccaggctaggccacaaatgagaccctgttcaaaaaaaaaaaaaaaattcgggaccacctggcatgatgcctgccatagtaaatactcatgtggctaataatatgattatttatttatggactatataccactcctagacaggctgggctaagactcagaattaactgctttctttttattttttgagacggagtcttgctctgttgcccaggcgggagtgcagtggtgccacattggctcactgcaacctccgcctcccgggttcaagtgattcttctatgtcagcctccctagtagctgggattacaggcgcatgacaccacacctggctaatttttgtatttttagtagagatggggtttcgccatgtcggccaggctggtcttgaactcctgacctcaagtgatccgctggccttggccttccaaagtgctgggattaaaagtgtgaaccatcacgcccagcctgagtcagatttaatttcaataagtgaagctattataattaatggcactactaaagcaaagatactgttttagtatgtaaattaagcagaatctaagatttactgttttaaataaatatcctttcttggatatagagaagaggtgagaagtaaaaatgaaacataaggccgggcrcagtggctcacgcctgtaatcccagcactttgggaggccgaggtgggcgatcacgaggtcgggagatcgacaccatcctggctaacacagtgaaaccccgtctctactgaaaattcaaaaaattagccgggtgtggtggtgggcgcctatagtcccagctactcggggcaggagaatggcgtgaacccgggaggtggcgcttgcagtgagccaagatggcgccactgcactccagcctgggcgacagagtgagactccgcctcaaaaaaaaaaaaaagaaaaagaaaaagaaaaagaaacataagtagcaagacagaaattaacattttttccatttaggcaataaagagaataaaacaaaagtcaggctggacrtggtggctcacacctgtaatcccagcactttgggaggctgaggagggcagatcacctgaggtcagcagttcaagaccagcctggccaacatggtgaaatcccaactctataaaaatacaaaaattagtcaggcgtgatggtgcgtgcctgtaatcccagctaattgggaggcagaggcaggagaaacatttgaacccaggaggcggaggttgcagtgagtcaagattgcgccactgcactctagcctgggtgacagagtgagaaccatctcaaaaacaaaaacaaaaacaaaaatcatagcaaccttccagacatacttgattcaatttattattgtttttcctcttctaagagaagaggaacgtcaagtaggagtaggactcagaaagaaaaatttacaaagcatttcgtgatatagtaccaggattagccatgaagtctaaaactgaaaattaattttgttgtacrtaaggccagcaatttgtgggaaaaaagcgataatggattttaatttaatttaaaaggcatggcaaatgtacctgcttcttttaaagtgctgcatttctgatayatagatgtccgcaaggtgggtgcccttacattatacagccttatcttatcaatccgagtgtcaaagacccgaagcaaaggatctttctcttcccactgagacataattttattatcaataaaggtggcaaacatctgtgtttcaatgaagcgtgaaagaaatggcaggtaaggctcaggctggtcagacagaaaggaagcctgtaatgagataattaggaaattattagtgcaaagagaccatctcaacactacatgataagcctgaaaattatgttaactcaggacattccttttttaaatcttataaaactgacacttgaaattcaaaaatccttaaaaatccacttttctttccattttcctaaatttagagaatgtacgtcacttaggtctttagcactgatcttaccttacaaaatttacattctgatccttatgaccattatgtagcaaagagggcatcagtaacgaaagatggcagataagttgctatacaattgtcaatcatccacttcacttgcagttaaaaatttttatccctttccccaatgagttgtaatttcgttttttttttttctttgagatggagtctcgctctgtcgcccaggctggagtgcagtggcacgatctcggctcactgcaagctcccgcctcccgggttcatgccattctcctgcctcagcctcctgagtagctgggactacaggcgcctgccaccacgcccggctaatttttttgaatttttagtagagacggggtttcaccatgttagccaagatggtctcgatctcctgacctcatgctccgcccgcctcggcctcccaaagtgctgggattacaggcgtgagccaccgcgcccrgctacaagttgtaattccttctgttctctattcctagcctatgaaatatactttcaagccacaaggtagtgagatgattaactgatacaataaacacatcagcattaatcttaaaaaagacatggaatttatgcttakgggtgaagttcttttgttcttctttaagtgaatgcttttctagactctttaactctgtgagaaatcaatagatgagtgttaagccaaggaaaaattccttccacacctgtgctgacacaacagtctcagccttaacaactaaaaaaggcactgcctggaagctgggcatggtggtggccacctacagtcccagccactagggaggctgaagccggaggatcctgtgagcccaggagtttgaggccagcctaaagaaacatagtgaaaccgcatttccaaaaaaacaaacaaamaaaaaacaaatcattgcctgaaaaaccatcagaagcaagcctttggagaacgagtacaataagctgtacacctttcctgttactagcctgtctgatgcatgggatggttcagtacatcgtaatcagttcctaattaaaagtgtcatttttttttctgttgttcttccatgctcatgtgtgtacagggattctacattcaatgcagtactaaaatctggaagtaaatttggaagtaaattcctattttggttgctgggttggtttttatttttgcatggcagaagccagaaggggaaaggggaaagaggaaagagaaataagttctgacataaggtgacttttaaaaatactcatcagcttcttgctagcatatttactttcattctgaaatttaggaggtcttcttaaaatttccttatagaaatccacttattcactttaagtagttccatagttcaggtgtatatacataaatccaaataaccacagaaagattcacagtagtctagaaatcagttcaccttcaccaataaacatcttacttttcatacatcaaatagcctttttttwaaaaaagtgggccaaagatctggcttttgatattcagaccctcataractataaaattttaggtcaacaacgatttggcttgtacgactagtatgtcctgcagattttcctagtgaaaggtacttataagccttctggaatccaacagaaaattttcatttctttaggggttatgtaaaaagaattccatttatatagtttgaggctacataaagattaagaaggaaggaagtatcagggcttgatttaggtaagaatttgaattgtcccaaggataaaccatggatatacacagattagtttttttkttkttttttttttttttgagacagagtctcgctgtcgcccaggctggcgtccagtggcgtgatctcagctcactgccaagctccacctcccgggttcatgccattcttctgcctcagcctcccaagtagctgggactataggtgcctgccaccacgcccggctaatttttttgtatttttagtagagacgaggtttcaccatgttagccaggatggtctcgatctcctgaccttgtgattcgcccgcctcagcctcccaaagtgttgggattacaggcgtgagccactgtgcccagcccacagattagttctaagctagataggaaaaagtatggaaaatggttaagactaacgaaaaaggaacctaagggcatacacttaaagaagtgaagtcttgttaatattaaagaagttttctcaaacgtaagtgcatcaggatgcttttgtagttcataaatgtaataattggcttttcatgctcatgtgtgagatgtaccttcctcaaactttgttaccatgttagaacattacctgtctgatgtggggaaaaacaaagaacaccagaacgtaactgttcaacatacaatatcatcctccaacagaaaaaatatctgatgaagtaaaaaaattatcttttatttgtttttttgagacagggtctcactcgctagcccaagctggagtgcagtggcatcatcttggctcactgcagcctcaacttctgaagctcaagtgatctcacctcagcctccagagtcattgggaccagaggagcacaccaccatgcccggctaattttaaaattttttgtagagatgagttctcactatgttgcctaggctggtctcacactcctggcctcaaatgatcctccagcctcaacctcctagtgttgggattacaagtgtgagccaccatgcccagccactatgtacctttacgaaaatttttcattatttccaaaaattctccagtactgtagattagcctcttggaatgtatcagcccctttagaaggcctttcatgacccaaagaggccacttagtgaaacccatgatacattctaatagcagtattatacctcagcaatcacagcagtaaagaactaaactgtaccctggtgacctaaaagagttactatacaaccctaagtgcatctgtctgaaaaataaaatctgggagataggtgaaaaaaaactggcagaagaatccagtaccccttagaaatcacaggacaaggaaagctggtatattttctgacttctctttccaaartctttggaaytgttttacacttacagccataaaacttaatttagtcactctttttctccttttatcttaaaatgagatagagaaatttggcttctgaaaccaaactgttaactttacatggacaagttgtgacttcctgataggataaagactaaataaatgatttctagactaaataaakagatttcttcaaaaaggagtaggcttatttaaccatacttgatcataaagtaagagtaaataaaactgttataaggttaaacagtattaacagatttggaaaacctgcaaaatgtaagagtttctataawtttttatttatttatttattttttttgagatggagtctctctctgttgcccaggccggagtacagtggcgctatcttggctcactgcaacctctgcctcccgggttcaagcgattctcctgcctcagcctcctgagtagctgggactacaggtgtgcgccaccacgcccagctaattttttgtatttttcgtagagacggggtttcaccatattggccaggctggtctcaaactcctgaccttgtgatccgtccgcctcggcctcccaaagttctgggattacaggcatgagccaccgtgcccggcctgagtttctataatttaagcatctttaaggtaaagaaaaattgaaaatgagattacaggcaatttaacgcacaatttaatgaccagttcaatgagctggtttatttgcttgtaaaattattttatctaatgtaaaaatacttggtaaagaaaagttcttaatggggctggaagacaaaaagtctgcatttaaaaaaggttaacaaaatcaataatatatgggtaagcataggcacagaagaataaaaaatttaaaaatgttaaaatcaataataaagccactaataaccacaaaaggaaaactatggttctttttactttgtcaaagttctgcatctgttcccggttggtcagccaggattccatgtcctgsgcagtctgaatgacaaatgcttcgtaatctgcaaacatctgtgtaaaacggttagcaaagacctctcggagctgtacattgagctggtagtcccttagttctgcctcttcacaatkcagttttaaatccttgtctttttcacccagagaagcagagaggtccattytttccacagccacaccagtacgcttggccagagcctgcaagcgggctatggtttcattgcccttcagtaactcatacatgctgatgttattagtacagacattgccgttctttttgtcattgaccaagtctttcagaaccatattcttcagtttgctggtactctcactgcaatgyaggctgccctcaggagggatcccaaattgaacaagaacctcagagagttcttggataaaatccactttattggggaactgtggaaattcttcaggcaactcaataaaatggttgtcaatgtccacaaaacacaaattagcctgaaagagaaaaatgaaatacaaaggtttaaaataaaggaattgtatgtgctaacatattcttgccagccagccacagtggctcacacataatcccagcactttgggaggccaaagcaaaaggatcgcttgagcccaggggttcgagacaagactgggaaacacggcaagattctgtttctacaaaaagaaaaaaaaattcttgccaactattacaaacaaaagcatagattatggtgccttttatgttaatctttgcaaggtttagaatttcttattctttaaaaataacctctttttccatcatttttccctatgtgagttttttataccatacttaatatatatgaataattttctctgggtctcagcaatatattataatctgaatatgattttctaacaattggcatccatttaggcattcctatgtgggtaagcgtgcccagactcataagaccttacaaatacatgatattaggtaaaatgctcactgtatgcacttgaactttctttgccactccactgctctaacatctgtaatgcagaattgacaataatcaccaaaaaccagcagctgtagtatctcccaataggatgaaactggcaaaatcaatccaattcacagataatccacaaattttaactttactcaaaattcactaaacctcctagagcaaaaccatttcagaagtcattatacctaatgcaggaggcagagagaggtggtagaggcaagtgcatatgtaactaygcacttgattaacctttgaataattaagagttcacacaagatatttttgagttgagtagaagaggtgacagaaatcagaagaaatgtttgagtttgtttacactctacatttggaatttattttgaataaatattttaaatatttttcaagtagatatagaaaattcaagaggccaagcatatgtataaagttctgattatccctcaggtatctgtagtagacttcaaacagtatttaacctctactgtccatactctcttaatcasgacaaggttgttagttaaaaagaaggttgtgyttctagattggggggtggagtgccaaaagtgtagcccatcacataaaaataatattgattacatcaatggttgaacataagacatggggtggaagttaataaacaaaayaggaagcttcactatgtgtttctccctggctcccccacccccaggcaccaaggggaaaattcacactgctctctgatcctagacggcaaagtaaggggaaaggggaaagcaaccagtcgggtctttgtttttctcttttgatccttgctcttcatgttagataccaattagcaagcagcatagtgaaactctaaattaagctcaataaaaactcaaaatgaggcctagcatggtgcctcatgcctgtaattccagcactttgggaggctgaggcgggaggatgacttgaggtcaggagttcaagaccagtctggccaacatggtgaaactctgtctctactaaaaatataaaaattagctgggcatggtggcatgcacctgtaatcccagctactcgggaggctaaggcaggataatcacttgacctcaggaggcagaggttgcagtgagctaagatcgtgccactgcactccagcctgggcaaaacacagcgagactttggccaaaaaaaaaaaaaaaaaaatttcggtttccctcctttcaaagccagatgatcaacaatgattcctaaagcctgatgtaatctttgaatccagtcttttaattttgcagatgaagaaaccgaggcccaagaaattaggtgacttcctggcacctgttccaaatgtgcaccctcaaacagcctggtggcttatggcctttccctgctatttttcctcacctccaatgtcagcagttttctctaaataaataaagagctgaaatgtcgcatcttgctgaagacagtagcactgcctacaccattcttttcttttctttttttgagatgtagtcttgctctgtcacccaggctggagtgtagtggtgcgatctcagctcactgcaamctctgcctcctgggttcgagcaattgtctgcctcagcctcccgcgtagctgggattacaggtgtccaccaccatgcctgggtaatttttttatattcttagtagagatggggtttcaccatcttggccaggctggtcttgaactcctgacctcgtaatccacctgcctcagcctctcacagtgctgggattataggtgtgagccactgygcctggccggcctacaccattctttacactgaaaggcttaaatgaaggtcacataatttgaatggatgattcagtatcttttttttttttttttttttttttgagatggagtcttgctctgttgcccaggctggagtgcagtggtgcgatcttggctcactgcaacctctgcctcctgggttcacgccattctcctgcctcagcctcccaagtagctgggactacaggtgcctgccaccacgcccggctaattttttttgtatttttagcagagacagggtttcaccgtgttagccaggatggtctcgatctcctgaccttgtgatccgcccaccttggcgtcccaaagtgctgggattacaggcgtgagccaccgcgcccggccaattcagtatctttaaaatggaagaaaaaatttactaatttgctaatctaaatgttaaccagcaacctcccaccacttagattttgtactatcaccttcactaatgccttcctactacctttttctatccctctcctcctcctatgaaaagggaaaatgatacattttctgaaattttaaagcttattatggtcatgaaatcactgctgagctgagtgtactacaaagtaggagttccaacaccatagctactggtctgtcttcatgatcccacaaaagtctcctatgtctgcttaagaagggcccaagctggggctttgattatctcaaagtagaacaggaaatacaaactgtgttatgaaaatgtattgaagaaaaccaaaaagccctttctccaaaacaaacgagaactctataatagggcattctgataagttgcttctcacttttaacaccattaaattaaaaaaaattcagaagagctcaataagtattacatgataaaaatttactcaacacctcaatctgacattgctttaggactaaatatttctactgatcaacactgctcacaagccttcatgatatgtaactacttcctattaaaaacaacaaaagtgggctgggcatggtggctcatgcctgtaatcccagcactttgggaggccaaggtgggcaaatcacaaggtcaggagtttgagatcagcctgaccaacatggtgaaagcccgyctctactaaacacaaaaaataagctgggcgtagtggcaggcgcctgtaatcccagctagttgagaggttgaggcaggagaatcacttgaacccaggaggcagaggttgcagtgtgccaagatcatgccactgcactccagcccaggcgacagagtgagactccgtctcaaaaacaaaacaacaacaacaacaaaagtggccgggcacagtggctcatgcctgtaatcccagcactttgggagcctgaggtgggtggatcacttgaggtcagaagttcaagaccagcctggccaacatggtgaaaccccatctctagtgcaaatacaaaaattagcgaagtgtggtggcrtgcacctgtaatcccagctatttgggaagttgaggcaaaagaatcacttgaacctggcaggtggaggttgcagtcagctgagacggcgccactgcactccagcctgggcaacagagtgagactccgtctcaaaaaaaaaaaaaaaaaaaattccctcaaaagtaagaaaacaaaggcttaaagcttaatcatctcttctgtcatgaaaccttcctatacccttaccctaaaggcattctgatctcctctggatcttctctgttcattcattcctcttactgacttactttttaacttgtgttattggtatttgtaaatgacttttttgaaaagcagaaatcacctctttttgacttggtgtctcccactgtattctacacaaatagtgtatgagacaactgtttggcaaatgaaagaataagctctgaggagatggtcatttgggggaaccctaaaactgtaggccggagcaggaagtatccacaaatgagagactaatgcagctctcttcatgtttagtaagtgatctcacttctcagtgtctgaagttaagccagcttgagggtaagccagagagaggagagcatttaaaatattccctctgggccagatgctgtggatgatgctggtaatctttggaaagccaaagccagaggatcgcttgagcccaagagttcaagaccagcctgggcaatgtagtgagactccatctctacaaataataattttaaaaaattagctgggtgtggtggtgtgtgcctctcgtcccagctactcatgaggctgaggtgggaggatctcctgagctcaggaggtcaaggctgcagtgagctgtgccaccacattcctgcctgggtgacagagtgagaccctgtctaaaaaataaaataaattattycctcagaatctcagggcaagatatgacaagaacaaagttgcaaaagcagctctgtttcagtttttctcttaactttttgtctaccagttactgtgaagatgagtaagaacagtagaaagtgaggtacattccatgcaattaatcttcagtgccttccttccactctcattctctctatcctactccctaaaaaacagtattacaaatggctacttgtgggtatcactcttaaatcatgaggatagctaattggtgattaatttataaatctatgtagttatattagttagctagcaactaaaatcataccttcttaaaataatcattttgcaaatttgttatttttgtaactatgtttagaagtcttgtcactatttttagccattattttattttagacttttcagggaaaggtggaggaaagtattactagtgagtgcatttaagtcatttttttaaatgactatttttatatctacttcctctccaaaattatgtgaagcagattatttcacctcattgtaaaatgataccagaacaaagaggctgttagccttttcttataaaacaatgatgtcctaatttatagtttctacacagaagcactgctattttcttttctttttttttttttgagatggagtctcgctctgtcgcccaggctggagtgcagtgatgcgatcttggctcactgcaaactccgcctcccgggttcatgccattctcctgcctcagcctcccgagtagctgggactacaggcgcctgccaccacgcccggctattttttttgtatttttagtagagacagggtttcaccgtgttatccaggatggtctcgatctcctcacctcgtgatccgcccgcctcagcctcccaaagtgctgggattacaggcgtgagccaccacgcccagcygaagcactgctattttcacagctaattcaggttatttcatattattctactctatgaacagatgagtatacgtatttattaagcagtgttgatctcattaatgaaaaattagaaaatcacagacattactgtaggagctttcagaatccttaaatttgtttatctttagtggatacaaacaggcatagagatggaaaggtttcccaactacagatatatcaagctgccatttaaaaatctctcaacaattgttatgaaaaatggaaagacaacatacatataaattatcttataaamtattacatggattaacatacaaaatagatcagtcactcaacaagaaactaaaatatcattaagtcttcaaaacaaaatgcatttggctagtctatttctttttccttgaaaatttaaaggattaacttcttggagcaaataacatacttgactaatttaatgaaagcaaaaacaagaacattcaaggaatagagaaaagaggtaaaacagagaagaaaaacatgcacaagcccaaaaagaacaatagtctgtatatgtctcttatgtgatctgaatcatgctattttcctttgagcaaaaaccttaatttttgtggggaaatattcattagaataaaagtaagcagtggatgattatgagaatcattacaggaaataatggctgtggcttagtgtgttaaattcacttattaaaatgagaatctctatgggaaataagaacaaataaaggtgaatctcagcatgagattctattaagaaagatgtgaattaaatagctagtgatataatgtaattaatcatcttatgttttgtaaaaggctgtggcacactcttatccatatttcatttcaaagaccttacatgktaatcctcagtaccattaacaataagtaacaattaggccaggcacggtggctcatgcctgtaatcccagcattttgggaggccggggcgggcagatcacctgaagatgggagtttgasaccagcctgaccaacatgaagaaaacccgtctctactaaaaatacaaaattagctgggcgtggtggtgcatgcctgtaatcccagctactcgggaggaygaggcaggagaatcacttaaacccaggaggcggtgagccaagatcccgccattgcactccagcctgggcaacaagagcgaaactccatctcaaaagaaaagaaaaaaaaaagtaaaaacaacacctaggaggtgttaytattcttactttatagatcagaaatatgctttcaataattcttgtttatttatttatttttgagacggaatctcgctctgtcaccctggagtgcagtggcacgatcttggcttactgaaacctatacctctagggttcaagcgattctcctgcctcagccttccaagtacctgggactacaggtgtgtgccaccatgcctggctaatttttggtatttttagtagagatgggtttcatcatgttagccaggatggtctggatctcttgaccttgtgatccgcccaccttggcctcccaaagtgctgggattacaagcrcttgtaatcccaccackcctggcctatttttttaaacatttgaaagtacaacacacagaaagtataactttaaggtggcataaaaactaggtgttagaatttttatctcaaccaccaagccaagytgacatttagaacaaataactggccttgtatctgaaaacagagaatactgaagtgtttgatatttccattatccctagtttgctgcaacatgttacttttcatttgatagaggtcaaaaataaaattcaattgatacaatgatttaaggatgctaaaacctgggctgtattgtttaaaaacaaaatttataacgtgaataaagaaaaaaaatatgttactagaataaagcaatgagatcatgctaccactgctccatcttcagaaatttatagttgtraaaatcagccactgtcttgttttaaaccaggtttaatgactatgtagtagtcatcatcaagagtctgcattctatagctcaggctctcccctagccatacttggagatttaggagagtcaaagagacagataaaattttgacaaagacaatgcaatctaacgaaagtcgccttgacctaaatcagcaaacagcaaatgcttcatcattcattgtagttttacctcttgaggaagttctagtttagaacggtcagttccttcttttgactgaaggcccatcagataagggacaggagcatcaagaaaatgtagcagagaagcaggtagaatgggcacataaacatgttgccattgaaatgggaacaaaagtgtggtgatgccttctgccacagtcatcaggcgttgataatctgcacagaacaaggaaaaaggaaagggaagagtccaagtaaaaacacaatcacttcattaagctggaaaatgtggatcttaagaaaaaaatttctgcgttaaaagtaaatatttctttatgatcatacagaaaataggtcagttctattccactrtaattaaagaattaaatggtttcatttgaatagttttaagggggtgtgggtaggtgggaaacatcacactctttgcttcttaaaatcatgggtagacgaacttatattctcttaaagtgtggaggaatcaagaactaataaaactgctcttggcatttatcccactaaaaatgtacaagatacagtgtaacattgttattatttttgagatggagtctcgctttgttgcccaagctggagtgcaatggtgcgatcttggcrcactgcaacctccacatctcggattcaagcgattctcctgcctcarcctcccaagtagctgagattacaggcgcccaccaccacaccaggctaatttttgtatttttcgtagagatggggattctccatgttggccagggtgatcttgaactcytgacctcaagcaatccgcctacctcggcctcccaaagtgctgggattacaggcgtgaaccaccgcaccaggccagtgtaacatttttgatcatttttttatacatgaatgcttacacaattcccatttttcttttttcttttgttttgagacagtctggccccgtcgcccaggctggagtgcagtggcatgatctcggctcactgcaacctccatcagaggcttttttcttacacagtatatatgactgtggctatagctttggttagctgattatatttattttagcctttattttgggggtacaagaagtcaaacagatacatgcattcatagttacactttctatgtctaacccctagccacaaaactatcatatctgggtattctcgagttaacagaaaattaaggattagtgtttttgttatgttttatttacatgaactcactagtttatcaaaattaaaagctccccacaatagtaaagcagccttttaaaccactctgcaaaggctgctttatacttacatatgtccacaagtccgatttaaatgtttggaagtagatatgctttagaattcagattttttaatttagaaaagcagtatggtgcatataccacatatatgaactatctagggcagtatcctataattaaatacattaatatttctgyagcaaaccatatatgtcccagtaggacagataatcaaagaatatgaatagggtcactttggttcaggtctggttttgctgatgaatgagttacaaaaagaatgtttggttttcagaattttttggatttgtagaattgaggataatggattgtgggcttrtaataatcctttcacagaacccactgtgaacaaacacagtaaaatctttgggaggaagaatttaggggagtctttttaaaaaggttaagaaaatgatcagatgttacttgagtcacatcaactcaaagacctgaccaagcataaacaggatgttttccatttaaattttttgtgtcattttataattttaaatgactacctttttrktaatgaatcatcagttatccacagcccaagtttacttaaaattttccttatttgattcataaagattcaaattttaggtgaaaatctgtttataggaataacttctagaacaaacaccaggtggcctaaaaggtaggggtcagtcatacgagcacaaagagctaacctaattacctggggtggatacacacattttacagccaaggcccactgaagaagctaggctgagacagctggtactctctgtgcaggtgaggcgggtagtagaggagatcagaaaatcagttcctaccactctgctaggataatcaggcagatgtttgaactgtaggcaatatgggtcttttatcccaggggcgggggcggggtgaggatgaaaagctgacctgaaacccctgaggtcggctggatggcccctagaagtagaaactgtgccctaatcagaactaaytgaagttctgcactatcacaggactccattatggcacttggcccccgtactgtctctcctctctgtgggtttcctaaggacagagtggcatccactttctctgattttacccataaagcatagggcccacttcacacccagtgctgactaaaatttactgataactactaaatgttatgttttttttcctcttaagttcaacagaatcctaacaaaatacaaaaaaaggccgggcaggcacagtggcttatgcctgtgatcccagtactttgggagaccgaggtgggtggattacctgaggtcagaagttagagrccagtctggccaacatggtgaaaccccatttctactaaaaatacaaaaattagcagggcatggtggcaggcacctgtaatcccagttacttgggaggctaaggcaggagaattgcttgaacccaggaggcggaggttgcagtgagccgggattgcactactgcactccagcctgggcaacagtgagactccgtctcagaaaaaaaaacaaaaaacaaaaagccaagcacagtggctcaagacctgcaatcccagcactttgggaggccaaggcaggagaatcacctgaggccaggagttcaagactagcccgcccatcatggcaaaaccctgtctctagtaaaaatataaaaattaggcatagtggcacatgcctgtaatctcagctacttgggaggctgaggtacaagaatcacttgaacccaggaggcagaggttgcagtgagctgcgatcgtaccactgcactccaggcctgggtgacagagtgagattctgtctcaaaaaaacaaaaaacaaacaaacaaaaaacccaacaacaacaacaaaaactcaccaggagtaggcagagacagtaatttacagttatagactatgaagaccaaatccagagaaatctccttagattctgctctgtggccatcatttcaaccaaggattggggccttttatattcttgtaacctcagtatctaccacagtatctgacatataatagaggctaaaacaatatttttgaacgaatagatgatgatgggataagaatatatataattttgctagatatctataacttaaaaagacatgcttagattttattccatccatgtgttgtgagtgttctatgtctattcttctttccagttctgyattctcttcaagactggttgaagtaccacacacattattaattttttttttgagatcgagttttcactcttgctgcccargctggagcgcaatggctcaatcttggatcactgcaacctccacttcctgggttcaagcgattctcctgcctcactcagcctcctgagtagctgggattacaggcacacgccaccacacctggctaatttttttggatttttagtagagatggggtttcaccaygttggccgggctggtctcgaactcctgacctcaggtgatccacacgcctttgcctcccaaagtgctaagattacaggcgtgagccactgtgcccagcccacacrctttttaataatgcaattactcagcagaaataagacaattctttttaactgaatcaagaaataaaaggcagagttttcttctttaagcattttttttaaacttaaatattttaggaaagtctttttataattgatactcaaagtgatgaatgtataaaagaagttattttaatatttaagacaggcctcagcaaggcacatgaggctyttcatgatttggcccttgtctgcctcattccttatcatcactccatatgcagtaagaccacttgcttgcagtccatgttttcacaggccttgtgccccttgtatattgttttcctctgcccagaatgtcccttcctcttgcactgcctgactaggttccactttttcctcaggcaattgcttctttggaaagccttccctaacacttcttattatcaccagagtactatctacatgcttcaacagtaccctatctttatttccatcccaggaattattcatctcactgaaacattacaattctatcataattctctcttcatggtctctcttccycaataccccatcatctcctagagagcaatatatgtatttttctttttatttatttatttttggagacagggtctcactctctcgtccaggctggagtgcagtggtgcgatcttggttcactgcagcctctgcctcccaggttcaagtgattctcatgcctcagcctcccgagtagcttggattacagctgtgcaccaccacgcctggctaattttttgtgttttttgtagaaaggggtttygccatgttggccaggctggtcttgaactcctgacctcaagtgatctgcctgcctgcctccgcctcccaaagtgctgagattacaggcatgagccactgtgcctggacatatctgtatttctaatctcagaattgttaacattcaacatatgacctactacatgatgagtagccagtaaacgtgctttgagaaattaatatgttaacatctaaggcatgtaaaatgaaataaaagtagacattaaaaaattatgcttgactatattatacaataaaaacatactgtcaaaaatgtgcctagtgatggctctggcacagatcccaaggtggcaatggcctctgctgcctcagcccctgccaygctgtccaccagcatcactgtggagaataaggtcagcycctcaagggcaacagaggggtctaggtctggacctgtggctggcggcacaggagccatggtggtgcagaccagragctgtgtctagcaaggcttatgccctgccaagcactgccaatggagatgtgaagctgctggtggtatccagcaygcctctggtggacttcctgatgtagctggaggattatacacctatgatcctggatgctgtgactgattattttttatttttgagatggaatctygctctgttgcccaggctggagtgcagtggcatgaacttggctcactgcaacctccgcctcctgagttcaagtggttctyctgcctcagcctccccagcagctgggattacaggtgcacaccaccatgcctggctaatttttgtatttttgtagagacggggtttcactatgttggccaggctagtctcaaactcccgacctcaagtaatccacctgtctcagccttctaaatgcagggattacaggcgtgagccatgcgcctggcccaatgtgactgagcattatctgaattatgttggctttgaggtctcagacacatgcataatttggcttatctccctagtttcacagaaattcatctcaggtattgccaacaatgacctacggcactagaaaatgaaaggcacagcctctsgcagctcctgaagtaagagcaaagactaatcatggagtacttgacccctgtcctcagtatgacatcaatgtggagccaccacaccacctaagccacccaayctaaacatgtttgtctgtaacaagcttcactgtgaccaaaaaatgtcaaagaaagggctaattgtagattaaacacaggtaaagagagaattcataaagcwggagacagatgtggagaaattacccagaatgcagcacagagacacacagaaaattggaatgaggctgggtgtggtggctcacgcctgtaagcactttgggaggccaaggcgggcggatcacaaggtcaagagatcgagaccatcctggccaacatggtgaaaccccgtctctactaaaaacacaaaaattagttggtcatggtggtgcacacctgtggtcccagctactcgggaggctgaagtaggagaaccacttgaacccaggaggcagagtttgcagtgagacaagattgcaacactgcactccagcctggcaacagagtgagactccatctccaaaaaaaaaagggttgagagataatggaagattgagcaagacagattaacatgtttaaggctggacacagtggctcatgcctgtaatcccagcactytgggaggccacggcgcgtggatcacttgaggttaggagttcgagaccagcctgaccaacatggtgaaaccccgtctctactaaaaatacaaaaattagctgggcatggtggcatgcgcctgtagtcccagctactcaggaggctgagacaggagaattgcttgaacccaggaggcgraggttacagtgagcagagtttgcaccactgtactccatcctgggcaataaagtgagactctgtctcaaaaacaaaacaacaacaacaacaaaaaaaagtttcactagaatttcaggaggattaaaaaaagatacaygaatgcaatatttacaaagatagttgagaattttccaaaatgggtaaaggacattaattcttaaatttcaggaaacataatgaaccacaagcagaacaaataaagcctcattcagataaatcagtcaaaatatcacacaccaaagacagaaaatcttaaatataaccagagttgaaaagacagatttctggctaatgagtaacaatgagagtcattcattagaatgacattagaggtgatggctgacttctcaacagcaatacaggaaaccagaagatgatagaatattatcctcagagttctaagagaaaaaaacttttaacatataatttaacatccaatgaactatttaagatgatagaatattatcctcagagtactaagnaaaaaaaaaaaacttttaacatagaatttaacatccaatgaactatttttcaaaaacaaggacaaaataagatctaatagagaaagctatctcaggaaaggaacttctaagaacacatgttaggaagaagactgatctcaaaagaaatctctaagatatgaaataaaatgtgaattttcaaaaaataataactgaggctgggtgcagtggctcacacctataatcccagcactttgggaggctgaggcagaggactgcttgagcccaggacttcacgaccagcctggacaagacagtgagwcccccatctctacaaaaagaaaaaaaaaaagtaagaaaaaaattakcccakcatggtggcntgtgcctgtagtcccagctatcaggaggctgaggcagtaggattgcttgagcccaggagttcagtcgcatcactgcactccagcctaggcaayagagtgagaccttatttcaaagaaaaacaaaataaggtcactatgagtaaatttaaacaaaaccaagtgtatagaataaaaatgtctaatttgagggattattaaaactgaacaatcataacaagtaagccacaatgggcatggagttaaagcattttatagttatctgtgaagattctataacataagagtaactgttcatgttgaaatctcaaaatttatcattmagaaaaakagcatataacatctaaacagaaaaaactgcaatgagaaaaaaatttaaatcaattcaaaacatcaaaaacagagagagagagaaaagcaagacaaatggccaaaataaatgaaattttaaaaattcttagaactagccaggtatgatggctcacacctctaatcccagcactttgagaggccgaggtgaaagaattgcttgagcccaggagttcaagaccagcctgggcaacatacagagaccccacctctaaaaaaaatttaaaaattggccaggtgtggtggcatgcacctgtagtcccagctacaagggaggttgaggtgggaagatggcctgaccctgagaagttgaggctgccataagctgtgatcacaccactgcattccagtctgggcaacagagcaagaccctgtctcaaattatttatttatttatttatttttagaattcaatgataatgaaagtatcagatactaagacttgtgggatgtagctaacacaggactcaagtgcttaagatactggttttggtgggcaggtggggagaaagaaaggtttaataagcccaaaaaaagtagtagaaagaagtgaataataaaaacaaaaccataaattaataaaacagaaaacaaaggtacaacagaagataccaatgaaagtaaaatctggttctttaaagagtaatagggctgggcacaatggctcatacctgtgatcccagcactttgggaggccaatgcaggaggatcgcttggacccaggagtttgggactagtctaggcaacacagtgagaccctgtcatttcaaaaaataaaaaaaaaaattagccaggcatggtggcacacacctgtagctccagctacgtgggaggctaaggcaggaggattgcctgagcccagggaggtcaagactgcagtgagcctagatcgtgctactgcactccaggatgagcgacagggtgaggccctgtctcaaaaaaccaaacaaacaaaargaagtaatataattgacaaacttcaggtaaaaataattgggggaaaaagagaatgcacaaacagtattaggaatgaaaaggaggacaaaactacagatataacaggggtcaagaaaacaagraaatattaagactttttgctaatatattgaaagcttaataaaaattttcttagagaaaatagcaaggaacaaaaatttattcaagaaaaaaatagaggtggccaggtgcattgcctcaggtctgtaatcccagcacttgggaggccgaggcaggtggatcactggaggtcaggagttcaagaccagcctggccaacgyggtgtaacttgtctctactaaaaatacaaaaattagctagctgtggtggcatgtgcctgtaatcccagctactcgggaggctgaggcaggagaatcacctgaacctggaggcaaaggttgcagtgagccaagatcacgccactgcactccagcctgggtgacagagacagactccatctcaaaaaaaaaaaaaaaagaagaagaagaagaagaagaaatatagaggagcttctggactggcaaatacattaaggtgctgggtaagtccaaggaaagcatagcagttctgcacccacccctacaccttttgcacctctcttccatttggctgtttctgagttgtatcctttataataaaccagttagcaataagtaaagtgctttcttgagttctgtgaatcattctgggaatttatagaacttgaggggttgggggatggtgttggggaacccctgattttgtagtcatccaagaaaaaatgtatgtggcctggtgctacggtttggacatggtttgttggccccaatgttggnggtgaggtgtttgggtcctgggggtggatctctcatgaatggctttgtgccattctcatggttgtgagtgagtagtttttcactcttactttccatgaaaattggttattgaaaagagtctggcatctccctcctctctcttgcttccttcctcttgccatgtgattctggctccccttcacctcctgccatgagtagatgcttcccaaggccctcatcagaagcaggtgctagcacatgcacagaactgtgagccaaataaacctcttttatttttctttgagacagggtctcgctctgtcacgaggctgtagtgcagtgacataataatggctcactgcagcctctaactcctgggctcaggtgatcctcgacctcagcctcccaagtagctgggactacaggcatacactaccatgtctggctttttttttttttttttytttggagatggagtttcccttgttacccaggctggagtgcaatggtgcgatctcggctcactgcagtctctgcctccagggttcaagcgattctcctgcctcagcctcccgagtagctgggattacaggcatgcaccaccacgcctgggtaactctgtatttttagtagagatgaggtttctccatgttggtcaggctggtctcgaactcacaacctcaggtgatccrcccacctcggcctcccaaagtgctgggattacaggcgtgatacactgtgcccggccttatttttaatttttttgtagagacggggtttcaccatgttacccaggctggtcttgaactcttgggctcaagagatctgcctgtctcagcttcccagagtgctgggattacaggtgtaagccactgcaccaggccaaacttcttttctttataaattaaccagcctcaggtattttayagtaacacaaataaaccaagacacctgatacctcatttgtggctggcatcagaagtgaggacagtcttgtgagaatgaactcttaaacctgtggagtctgacattcagttaggaatgaattgaactgttgggcatccagytggtatcacaaattgacaggtgttggggaggaaagactctctcacttggtgtcagaaaaactgagatttgttataacagcccaggctcatggaaacctgtggtttgggaagagggacaatgagagggtggggaattaggaacctttaattcctgggtggccactcatgggatggagcagtasctgtgctgagaccatttactgaaggtaaaagtaactaatggaatttagagatgaatccacctcccagggagtgggattcactggatatataaggaaatgcaaaccaacagaaaaaagttaaatataaaatcccttggttattgttctatgtaaaagctaaaatgaaatttaaaagagtgctaggtcaaccttgatgctggaccaagctcagatttctgctggtcagggcgtgacaactagcctcaaagccactcccaacgggaaaaattatgtggaaaccgcctgggcatttcctcaccaacacccttaggtattctgtagtttcttggttttgtggttcccccatgtggagtacctttctggtgaccagagatcttagagacactctttgttgtttccacataattttgttgtgtttgagaaggagtctcgctctgtcacctaggctggaatgcagtggcatgatctcagctcactgcaacctgcaattctcgggcctcagcctcccaagtagctgagattacaatcgcacaccaccatgcctgtattttttttttttttttttttgtagagacagggtttcgtgatgttggccaggctggtctcacactcctgacctcaagcaatctgccacaagggaggtagagatggagtttcaccatgttggccaggctggtcttgaactcctgccctcaacagaaaccaggggatagtatgaagtctcattttatagataagtatcatccacttcctgatgaatctctgctacaggaactaatttcgaggcagtatctttatttttaaatgctgcagcgtggaagaacatgcttgggttgacacagggcccacagctcactatggaacaatcacagatggctatatgtgatccagacacaaaggtgatgattcagtcagaaatgaattgaactgttttatccaatccttgagggamcagccagtctcaaggactggataaaagctactcgaagtctgtttaccttgagaagggagactgcccaattccccctataaattccaagtggaacaccccagatgaagaagctgatatgctctgcacaaaagccacgcaggactggctttatgataatcgggatattcacccgctgaatacatccgttacccagggcaaatgctgcggttagggaggctccttttatgtgggcactccatgtaactttactgcttcaaaatctaacattacgagaagccttattgaatttgctatctcagcttactctcatcttacagatgctaataaaaacattaataatgagtcaaaggactcaacccagcagggtggaaatttttaagtgtctattaagaaatagggtgaataaaacagaccttgatgggactgaaacaaaagtcttttttgagatggagtcttgccctgtctcccaggctgcagtacagtggcacgacctcggctcattgcaacttccacctcttgggttcaagcgattctcctgcctcagcctcccaagtagctgggattacaggggcacaccaccatgcctgcctaatttttgtattttcagtagagacagggtttccctatgttggccaggctggtctcaaactcctgaactcaggtgatctgcccacctcggccttccaaagcattgggattacagacatgagccacggcacccagcctgaaatgaaagtcttaatatagcactaccaaaggttgcatggactataaggaccctcagatggtttcccaaaattaaagggctcaaacaaatctgctctatttgccccagcacagagaaatttaaaatgtaagaagggaaagattacaattagaaacatgatctggaattgcttggggatatatagtaaggtaaattaatcaaaataaagactcacaaaagggccaagataccttgctgaacacccaaaacctaatgcacaggagtgggtcaaataatcaagggatggagaagtttctgggactcatttgagagccttatatgctgttgcaccaaaatcttctagtgaagtctttttaaaaaaaaaaagatagggtctcactgtgtcacacaggctggagtgcagtggcacaatctcaggttactgcaacctccacctcccaggctcaagcgatctcccacctcagcccctgtagtagatgagactacaggtgcacactaccatgcctagctaatttttgtattttagtagagatggggttttgctatgttgcccaggctggtctcaaactcctgggctcaagtgatcctcctgcctcaacctcccaaagtgttgggattacaggcaggagccattgcctcaacacagtggcttacagccttaacgcaggctacaattagaatgataatatattaaagtgttaaggttgataggattaaggaggaagtttgaatgaaattggaatgtttaaacacactttatctaaatgttttatgggagtggatcttaggtttgactgtttcaccccatttctcctacctagtacagtaaaacagagggcacagtgtcaatctacccttcaagcattattaattggacatgctaaatgggaatgaattagattgcctgagctcacgcagtgtagaaccgagaagctggagcactggtacagacaaattctctgtatgtggagtgtgggctagggcttatgtcgaaagcctgcgagtgcctcccagtgacaactatcagggtgctggactacagactttccatttcagaggcaactactaagtttgctattggatattgatttaaagtgcccctatgactgaaggacataaaacaatgctgaaacttgaaatatccacggtatctaaggcgattttggaaaaacactctaatgggagaggacagtgcccaaaagagwtccctattgaaaaagaaatggtttatactggatcttgttaccagaggaatgcaaggaagagattctcacatatagggagcctctttttcccttggactgactttggaactgtaggagaaccttctgcatttaattgtcacttggacaatgccctataaatacctctcagttgaccagcaaagtactgtttggtttatggatggcagttccaaggagaactatgatgtccacttgagcatgcctagcaatttgtgatgagaaagctcccaactttttcaagaaaactttaagtagcttccaccttctgacaaggttaattcacatacaactcaaagaggaatgaaacgaacagagggatggcagacaagcactgcaaaggcacacaggcatgcagtgtggtgtgggtagtggtttatttccactatgaagaaccaaaggaggtaagcaaggcccaaaaatgtttcttagacttcaattattggtatcaaaagttagacaatggtgtttaaattccccttttattcttccactagttctttgaaaaaagaatcatactctgattttcatactgtgctgctccaggtatttcccagttgcagaacaaagtgcccatttctgatctggggtcctagaaaagagccttcacatcctgggtacattttctctacttagaatttctagctagttaccactgcaaagtgacagtgatatatgcatttcctaaataacagattgaattggtttaaatgggctgtggatcagaatttcaaatcagtctagaaggacattttcatcactgaaatccacctactttgattcactttgggttttcatggtaactcttcagcacaygcaatgtttttaaatttatggcatagctttatcagtgagtaagaaatgaagtatcacatgttattaaaacccccttaacacagttaagaagagtaaaggagggcacccaagtacaaatcaacataaggacacctatttcattcatttaactgaaatatttttctctaatagaagagacattgtcaatattaaaatctagatttacacagcgctttcattttatactctacaattacttcgcatgacacctttacaatagacccacagaatgagttaatcatttaaaaataaatattgagacagataaggagaggttaagtgcagtgcccaatacagttaacacagtggttaagcatctgaaaaaagactgatgaaacccaattcttagtagtactacattacttactagctgtatcatcttgggcagattacttagtttccccaagcctcaatctcctcctcaacaaaaaatgcacaacagcactaacycactgctgttgagaggattaaatgtagggaaaagatccaaaatatacaatgcctttttgtagcacaattcctaacatagagtgattttagtgaatggttataaatttactgtatggcaattttttggggtatgtcactttaaattttttaaaaatctagctctataatctcaggattcactctgttgttctcggcatacagattacaaaaaaathgagtataaaaccatatccataaatgcttattcttcttcatttgaaactgaaataaattggtagatattaatgagctaaaactcctgaacagactccacaaaccaaacaggacaagctaagcagtggctcacacctgtaaaccctacactttgggaagctgaggcaggacgatcgcttgagcccaggagtttcaaaccagcctgggcagtgtagtgagacttcatctccactaaaaataaaaaacattagtcaggtatggtaatgcatgcctgtagtcccagctactcaggaggctgaggggtgaaggttgcttgagccctggagtttgaggttgcagtgagctacgatcatgtcactgcattccagcctgggcaccagagtgacaccctgtctcaaaacaaacaaacaaaaaaagagcagaaataggagagctcaggacagaccacaaacggtgagacataacctgctacttaaaagaggaggtgtgggccgggygcggtggcttacacctgtaatcycagcactttgggaggccaaggcaggcagatcacctagggtcaggagttcgagaccagcctagccagcatggcaaaacctcatctctactaaaaatacaaagaaattagccaggcatggtggtgcgcgcctgtagtcccagggacttgggaggctgaggcaygagaatcgcttgaacccaggaggtggaggttgcaatatgctgagattgcgccactgcactccagcctgggtgacagagcaagactccgtctcaataaaaaaaaataaaaataaaaaataaaagaggaagtgtgataatggaagcttttggrktttttttttgccttctaaaaaaagcatggtatacaatataaaagaacatttattaggttctcaactctggaataaactcttgactgtatcatttaaaaaggttttatgttaaatgtagtaatatgttgaaccttcacaacttagagataagtgtaatttatagaagattatatgggactaataaaactagtaattattataatagcatcagctatcatttagtcagtgtcaattataccctaagtattttatacacgttttcttatttaattgtcataatagatcagtgagaaaggagaaaaaaaaaaaacccaaactattatccctatagagatgtggcaactgtcacacaggaggattacctaactcgcccatgggtatagttaataaatgacagagtagacatttgaacccaggattgttatgacttcaaaaaccaatactctaaaccaggcatggtggtatgtgcctgcagtctcaactactcgggacgctgagatgggaggatggtgtgagctgaggagtttgaggctgcagtgtgctaagactgtgcctgtgaatacactgtactccattctgggcaacacagtgagaccccatctctaaaaattaaaggcaaaacaaaagaacccacccacccccaatattctttctaacccaaattgcttctctaggcagaacataaataaattgaacttcaagattcaagaaaatggcctttaagatttcttctaagtctagaatacaaagttctttttttcggccaggcacagtggctcacgccggtaatcccagcactttgggaggctgaggcgagtggatcatgaggtcaggagttcaagaccagcctgaccaacatggtgaaaaccctgtctctactaaaaatacaaaaatcagctgggtgtggtggtgcgcacccatagtcccagctactcgggaggctgaggcaggagaattgtttgaacccgggaggcggtggttgcagtgagccaagatcatgccactgcactccagcctgggcaacagggcgagactctgtcttaaaaaaaaaaaaaagttatttttttctaatgggctaaaacaccataaggtattaagctccaagcctctgccccttctagccattctctaatccctactccattcagggaaataaaaggaagaaaggaagagagaattacttaaggtaaaatttttcagatacaaaaaggtgatctgtaagtaataatggaagcagtgagtcctcagcttctgctggtsggaaggttcatgctgaatatttagcaggcgctctctctaaagagaacagccaccacacttatggcagggactttgctgtcagtagctcaagaggcaaaatgaactacagactgggacaaaaggtgtgaagtctctcgtttacatagattggattcatcacaaatttaccaggtcaagaattccatataaagsgtttcagccttcacttgcagatcatgaaaaatatgacggagatccacagaatcctcagaaactgcatattgttaccagaataaaaaagtacaaaaaggtgtccatattgggaaaaagacataataaagatgctcagattagaaaacacacatatccatcaagttcacaagcatattgcttcagtgaatgcaaaactgaaagtggtttaacagtcagtaagaatcaagcccctgaagttgccacaaggatttccaactgaggaggacatgtctaagctctgcctcaagagcactggggaattagtgcagtggcatctgaaatctgtggagcagaaagcaattaactcctaatgcccaaggagcttcagattaaaaaatggattttttttttatctaaagatgatgagaaagtgtttcactaaaatatattttaaatatatacatataaaaagaaagtgggtgaaagaagaaaggaaagaatttagattggtcattagagaataacttcctgacaacaaaaattgagacatgaaacacattatcaaagaacattatgttggataaactgaagaaaatacaaccttgtgaacggctgtcaacacacaaatagtgtcaacatacacacaagatggggaagtacaaatatagtctacttggctcagccccacttataatttaaaatagaaaaataaaaaaaggaaagtggtaaaataagcttgacggcaccagtcgggattgcactacaattctgccagcttaaatacaagttagcaaaatgctaaccccagttgggtgcaatgcttcatgcctgtaattccagcactttgggaggccacggcaggaggatcatttgagcctaggattttgagagtccagggcaagacagtgacagtccgtctctacaaaaaataaaaaattagctgatgcggtggcacattcctatagtaccagctactcaggagggtgaggtgggaagacagcttgagcacgggatgtcaaggttgcagtgacccatgattgcactactgcactccagcctgggtgacggagtgagaacttgtctaaaaaaaaaagtgaatccaaatatttgtgtaaccttttttgaagaatctatcagtgtacaggtactattttataatttccttcaattcactatccattaagacatagcatctctattttctctacacattcatattcagatgacaactagtatcctagtctaggctcagcattagtcttcacaaaygtactggtaaaataaaatccatagtttgttattttcttaatatgtgttggaagaactttgaatgaaagataccacaaagataacttccttctgagattaaaaaacataaacaaaaaaccacacacacacacacacaactctggcagaactgttagacctgggaaagtcatctgtctcatgcctgctcaccttttctctcactcagatgaaatgctcccacaggcaaagatccaaagttgattgcctcaggaagctgcagagtcaacaatttcatttatcccttttcaatgttcgctgagttttgatgtgaacctttactaatccataaagaatgggaagtctacacgtttctggtagtaacagagttctctcactctcattatgatgaagaaaaaatgttttcttaatgacgattatatattatcaggaaaaaagggctatttccattaataaataaatayacccaaatcagccaagttaacacttgtgttccttcctatttctctctgcagtcactgactgccacctcaaagagaaacagcagtctcatctcagccrctggtcccaccatacctgctccctttacacaaaacagaaaagactgtgatcattattcggttctaataatayaccccatggaaacacagtagttgggagcaaaagtacttgtttttggaaaatgtaaaatccaaggaaaacctaccttgtgagtagagaaggatttgcatctctaaaagaacacaggtaaacacctgcaccaggttctctaatcccaggagctcaaatgcctcccgaagggggtaatcagagagggggagttcactgggcccaggcctctggcagatgacaggttcataaacaccataaaatttcagtgacctccctggaggtggaaggggtacttcataaagaatattgtggatatagctttcaagtggcaagggtggtggctgctgtgaggtaacagccttgtaaagctggataaggaatttcttgcaggcctgcatgaatggtaacggtgtgatcaagcatatactttttgaaacatacagggtgtctctgctaatatcataggagttgtatcgctggagtttcaaaagggaagttgtatctccttcatcaagactacttgccaatgagtccatactgcaggaagatgaagcatacacactgctgtaatgctcagcgttgtgcatctggtaaagtgtctgcattgctgtgcagatttgcttacttgtaacttcttcataaaaagtgagaacaaaaccataggtgcgagaaccatcttccctggtaatkataaatgagtgaaactgggggtctttattgtccgtttgtgtcctgaaagatagccctttaggcatgcacaactgtgaaagaaagaaaaaaaaaaatcagaatgcagtacacaaataacttcaagccagaaataaatgttgtttttttaacataacaggattcaaaaagacaggttttatccagatttaatattcgcaatagccttaaattagaaatatattataaattcctcatacacatgtatataaaattattcttaaaaggagtatatacaagggaaaaacttttactgtgtgatgttacatgcaaggggctttactaagaacaagagaatcactgatttagtcccagagtaaacctctaaccaagcttgtggcctttagcaagccatataacttctgtgagcctcagttcctttatctacaatagttgctgtatcaacgacttgaagacagagtaggcaaaagcatttcacaaatattaaaaagcacttcacaaaaatagtactcaagtatttaatacagggaaataggaaaaggctcatttaggaagtggaaaaaagttaaacaaagaataataaaaacaacagtgtcatctttgctattttgaatagtatggtattttatccaagaaaaagaaactttggaaattgaaagctttttgatctactaaagcagaagcacagaaacaaggcattttagattacttctagtagagattatgctctagttcttgggaactacccaggattgaggaaacttgagaacaaaattacccagaggagctaaagatgctatatttaagacacttaaaatgcacagaaaattagaattgattctttaaaacattttaaataaaagaagtgaaattacagaaaagttgaaatatactaaggaaaacagaacttgtaattcaaccatcctaatactcattattcatatttagatatttctatttttgtattgcaatatgctttttacatagaaataatttaaccatatattattactatttttctatatttaataactgatgtggtacaaaatttagactgtctcccacatccccacattaccaagaaaatacaattcctttatttcttcattcaaaccgtcaaaaaacatttattaagtgccttttatgagaggggccctatgatacaatggtgggaaggacagacatggcccatggtcctatggtatttccagtcgagtaaggttaacaggtaagttttaaaaatcataaactataaagtaagggaagtgctatgatagggtaaataagggttgctatgggaaaaacatataatagtaggaagacacacattagaaaagraggagctaccaggaaaaaatgaagcccaactgaaacctcaggacgagtataggtcttagtggataaagaagattccaggcagagaggacatgtgcaaaagcccagaagagtttgaggaactgaacaggtcagtgtgggtggggcagagaatgcaaggtgggaggacgtgagagaaagcaagagaaataatcaggggctagcccatgaagggccttggtaggccatgttagaactgtggggaggacaatgggaaacctctgaagggtttttagragagggacagaattagaygtgcctcttagcacatccatcttggaacactaaggggagtggttttcaaaggggttccaaagaggcagcaggaatgtctcagggccttggaagggagtgagaggctagaggaagaagttgagagggccagtgtcccttcttcccctatgcacattccactttcatttattctgtagagtggaattctttcagtgttaagatttctgggttcccactgcttaaaaacaaaatcttgatggtgggataggattaatgcaacacaattgtcattaagcatgaaggcgggtgggtgtccaaactgctcctcacagccatttcagattgtggtcctttcctttaccctaaaaactattggctttgaagctcatgtcatgattgtgccacattttgggtttcttttctatccaagttcatttccagagcaacttcttccatgattttaaatatactctttcaactcccaaatctacaatctcatgaacctgactcttaactgagtaactacttgacaatcccatcaagatgtctaataggcaactcaaacttaccatgtcccaaactgaagttctgatttcttcctccaaatcagtttcttcttatatcagtcttttctgtaattccatccatctaatttgcccaggacaaaaaccttggagtcatctttaacttcttcctctctttctcacttaccccattatccaatccatcagcaaatattatcaattctatcttcaaaaatacatgcagaaactaattgctgttgcttctttttttttttcttttttagaggtgaggtcttgctctatcactcaggatgaagtgcagtggtacaatcacagtttactgcagcctcaaactcctgrgtaaaagcaatcctcccgcctcagcctcctgagtcagaaagtaattgttttgatctttacgcttaccactctaatctaagtcaccctcttttcttgtctggatgtaacagcctgtttctgcccttgtcccccataatctatttcccttataagagccaaagcaatccttaaaaaatatgttagatcttgtcactcttgccaamattctccaatggactcttatctcactaaaagctgatgtccttataatggcctgcagggaagccctgcatgactcagcccccaacaacctctctgccctcatcttatactctctaactcacccactctgctccagcaacaatggcacgttactgttctatgaacacaccccgcgtgctcccatcaaaatctgctcttcccttttccagcagctttcttccccttggtatccacatgactcattccttgtggcagatatagctccaataatatttctactttcacacactcttccaaaccttgacacttccccattaagaagtggagctcactctccttgaacctgggtgggctgctgagagtgcctataccaggatctgggaaactttttctataaagagacagataagtattttaggctctggaggccattacagtctttgtcacaactgctccactccacattgtattaggtgagtgcaaaagtaactgtggtttttgcattgttggaatttgccatttgacattggaatacactttttaaataaatgtggttatagtatacatcttttttttttttttccaagacggagtcttgctctgtcacccaggctggagtgcagtggcgcgatctcggctccctgcaacctctgcctcgcaagttcaagcaattctcctgcctcagcctcccaagtagctgggattacaggcgtctgccactgcacctggctaatttctgtatttttagtagagatgggtttcactatgttggccaggmtggtctcaaactcctgacctcatgatccgcctgcttcgtcctctcaaagtgctgggattacaggcttgagccactgagcctggaccatcattttaakgggcatttctcgctttatgtttttttgctaatgacttattacttgctgtttattttagattttagactgaaaatgttagacaaaaaagcaaattagagcagttttcttttcttttctttttttttttttttttgagatagagtctcactctgtcactcaggctggagtgcggtggcgcaatcttggctcactgcaacctccgcctcccaggttcaagcctcagcctcccgagtagctgggactacaggcctgcaccaccatgcccagctaattttgtgtttttagtagagacggggtttcaccatttttggccaggctggtctcaaactcctgacctcaagtgatctgcccgccttggcctcccaaagtgctgggattacaggtgtaagctacccgacccggcctcgagcaattttcttattcaagttcaaaatgggtcgtaaagcagtggagacaaccacaacatcgacaatgcatttggcccagggactgctaactaacgcacagtgcagtggtggttcaagaagttttgaaaaggagatggcagccttggagatgagragcatagtggctggccatcagaagttgacaatgatcaattgagagtaatcactgaagctgaccctcttcagcaacatgaaaagttgctgaagaactcaacgtcgaccattctatggccgtttgacatgtgaagcaaattggaaaggtggaaaaactcggtaastgggtgcctcatgagctgagtggaaattttaaaaaatcgtcatcttggagccaggtgcggtggctcatgcctgttatcctagcactttggaaggctgaagcaggcggattgcctgagctcagtttgaaaccagcctgggcaacatggtgaaatcctgtctctactaaaatacaaaaaattagcagggcgtggtggcatgcacctgtagacccagctactcaggaggctggggcaggagaattgcttgaacctgggaggcggaggttgcagtgagccgagattgtgccactgaactccagcctaggcaacagagtgagactccatctcaaacaaaacaaaacaaaacaaaacaaaataaaataaaagcatcattttcaagtgtcgtcttctcttattctacacagcaacaacgaaccatttctcaatcaaattgtcatgtgcaacaaaaagtggatttcattagacaaccggcgatgaccagcttagtggctgaacyaagaagaagctctaaagtacttcccaaagccaaacttgcaccaaaaaaaggtcacggtcactgtttggtggcctgctgctggtttgatccactacagcttcctgaatcctggcgaaatcattacatccaagaagtatgctcagcaaatcgatgagatgcatcaaaaactgcaaagcctgcagcgggcactggtcaacagaaagggcccaattmttttccacaacaatgcctgaccgcacatcacacaacaaatacttcaaaagtttaacgaattgggcyatgcagtcatgcctcatccaccatgttcacctgacctcttgccaactgaccacttcttcaagcatctsgacaattttttgcagggaaaacgcttccacaaccagcaggatgcagaaaatgctttccaagagttcatcaaatcccaaagcacggatattttacgttacaggaataaacaaacttatttctcattggcaaaaatgtgttgattgtaatggttcytattttgattaataaggatgtgcttgagcctagttatgatttaaaattctgtccaaaaccacaattacttttgtaccaacctttaaacacgtaagtatggytttgttccaacacaattttatttataaaaacagtcagctggacagatttggcctgggggccatgtatgcccacccctggcctagtcaagtaaaatgcaacagcagtgacaagtgacagagtgacttttgagcagaggctaaaaaaggcaatacagcttccatctcctctctctctctctctctctctctctggtaacctggtaacacactctgggagccctgaggcaacatataaaaagtttagctagcctgaagctgcctgactggtgagaccaaatgaaagaccacacagagacagaaggagccctagctatatgcctggtccaggagacaggcctgtgagtgggtgagctttcagatgatttcagtcctcagacttcaaaccttccaaactaacaccaagtagaatacaggcgcagccaaccaaaagctacctacattgcagatatgtaggctaagtaatgattttgttgctttaaatcaagggtcagcaaacaacagccctgctatgggtttaaatatatgtgtgcctccaaaattcatatgctggaacatcacttcagggtgacggtattaaaaggtggggacttttgggaagtgattaagtcatgcaggctctgccctcatgaaaggattcgtccttcttataaaaggttgaagggagcagcaccctagtgctttctgccatgtgaggatacaacatttgtcctctctggagtacacaataacaaagtaccatcttagaagcagagactaggccatcattagaccctaaacctacagacaccttgatcttgtactttcaacctctagaactgtgagaaataaattcttattccttgtaagttactcagtctgaagtattttattttagcaggaggaatggagtaagaaaaacccttaggtcaaatacaatctgccacctgatctgtaaatagtttcactgggattcagtcacaaccatccacttatgcactgtctatggatgycttcacactacaacagcagagctgggtgactgtggcagaaactgtatgcccacaatacctcaactacttattatttggttcttcatgaaaaaaattgccaagccctattttaagccattaactggtaggcggatggattgtcatgcagcgatagataatcaaaatacttccttacttcccttaagtctctacataaatactaccttagagaggtcttcctttacctttccataaaaaatagtgttctcttcatcttttgcatgccataaaatgttactcctctaaaaagtatttattgtggagaagcaattaaagtcttgcaccactgtaaacatatgtacattatataaacatacacattactagtattgtataattctgtttgatctctacattgccagctactcaagggctagtacttcatttcaataactttaaacattcaagggaactgcaatggaataatataccatttggggccataacaggtggtgactgataacatgggtaaaaagaaaaaactgtgaagctcagcattagtgcaccagtgaaaatgtcttcatatttcatatcattgaatatgagatgtggaaaggactaaggcagatttactcaattcttttacatattaaattactatgtatatttggatagaatgagatatagacttaggtaaaacctatgaatacctggatttggtagggggtaaaagccacttaytcctagtcttaggaataactgtataaggaaaggctatggcagaatcttttaataattctacgttcacattaaggctgatttcatcataacaagttaatgagttgctctgctgatagcatgaataaaaactcatttggctgggtgtagtggctcacacccataatcccagtacttcgggaggctgagacgggtggattgcctgagctcaggagttcaagaccaccagcctgggcaacatgacgaaaccctgcctctactaaaaatacaaaaaattagccgggcgtggtgggacacacctgtagccccagctacctggaaggctgaggcacgagaatcgcatgaatccgggaggcagaggttgcagtgagccaagactgcaccactgcactccagcctagaagacagagtgagactgtctcaaaaaaacaaacaaacaaaaacaacaaaaaaccctaaaaacccaaaaacttcatttgacacatttattgtagtcaataaagattgtagaagggataatttgaattattcttgctccaggctaaactcaaacttgtttagcacagtgcatggcatataacaattggttgaatgaataaatgaatgaacaagaaaacaaacaaaaacagctgggggtaaagcaccaggcttagttcacctcttgatctggtctgtaattctttttttgtctttttggagacggaatctcactctgtcgcccagtctggtatgcagtggtgtgatgtcagcttactgcaacctccacctcctgagttcaagcaattctcctgcctcagcctcccaagtagctgggattacaagtgtgtgcgattataggcgtgcatacccggctattttttttttttttttgtacttttagtagagacgaggtttcaccatgttggccaggctggtcttgaacttctggtctcaagtgatccactcgcctcagcytcccaaagtgctgggattacagtgtgagccacagtgcctggacttcagcttgtaattctttttccatcaagtaggcaatacagaaacatagtgaccaccaaagtcaacataaagatttaatttaattgataggcgttcctgtcatcctaaatcacaaaatcatagctcaactgctgttgaacagctgccaaatattcccttaagggtttgtagctttcttgagcgcacattcaaacatttacagaaaaagcttgccaaaagttgtactcaaagtgaagaatggctttctatgctacagacaacagatgtaagaatttttcctaaatgctcttccaacaaatcaaaaaaagtaagaactatatatctaatcgggaaacatgaactgcaaaatgctattatttttccatttttaaaagatatacagtaytgttttatatcaggaactacaagatactttctcagaaaacctgagtttcatcagaattgttaaactgtcaggaactacaagaaatctcagaaaacctgaaatataaatcaagatttgtttatcacggtattaaacatttctaattaacccttaactttgctatctactaacaataccccctcaccatcccacaataaaacaactaaaaattagaggtgtcactgatgatcagaytactactagtaaccagattactttagccaaagcaggcttataatgacaagtgtgtaactttcccagtttgagtcagcaaatgttcttatatttctctagaccgtttcaggcagtttggctagaattttaaaattcctttttccacatcttgtagttctatgacttccatggcctctccctcattatgcaaatacaatcatatactgtataaccacactctggtcaacaatggactgcctataggacaacggctggagcaatacgttataccatataacttagaagtatagtaggctatatcacctaggtctgtgtatgtgtatatacactctatgatgtttgcacaataaaatcacctaacaacacatttctcagaatgtctccctccctccctcccctcttctctccctccttccataaacacttattttgtcccatgttttgcattagatcttggtaactcaaaagacaaagataaaaataatcctttcctttagggagttcacagtctagtaggaaagacagacacagaaaccagcagttaccaaaaaaatgtgatcagtgttgctacggactctgttcgagatatcataagaaaagacagagtaactactcctgcttaagagatggttttgcagtggaggtcacacctagtcaaggacagggaagagaagtattgtaagcaagtatcacttcatttattcaacaatttgaacatctactatgcgcaaagctagggatataacaatgaataagagacactgctcctgttctcatggtgcttacattaagcacgagatacacagttgactactagctaagtaattggttaactgcaactgagataggtgctacaaaaaggtatacaaggtactaagagaacctaaggtgacctgagtgctgggaagacggtggaaggtgatggtcaggagcagcttctctatataaatgtttacagtgaagtctgaaggaatagtaagaattcactaggtgaaggagaggtggaagagccttccagagagaaggaacagcagaagcagaagctatagtatgaggaatgaaatggacaggttactgcaggagtccaggtaagagatcttgatggtttggaccaaggtgagtatacggaacagagagaagtagacagataactgattatatatgggagagggtgagtaagtgagaactttcagggtgatgtgtacattgttggacttggcaagtaggtggatggttgtaccattcactgacaaaagactggtgggaygaataatgaattcagttttggatatgttgcatttgagatgccagtgaaatattctagctgcaatgttaaggaaacgggsgagaggatgggggtggcgggggcaaaagggtcttccagcaatggtcctccagcaatgaaagccccattcctataattttactgtgagatatggctaggcatcgtggatcacacctgtaatcctagcactctgagaggccgaggtgggcagattgcttgagtccaggagttcgagagtagcctaagcaacatagccaaaccccgtctcctcaaaaagtacaaaaattagccaggcgtggtggtgcacacctgtagtctcagctacttggggggctgaggtggaggatcgctagagcatgggaggtcaaggctgcagtgagccaagattgcaccagtgcactccagtctggatgacagagtcagaacctgtctcaagaaaaaaaaaaaattttattgtgagcttgaacctaaacttggctcaaaatgagggcttatcttcattctaatgtcaaacctatgaatgtaatttgggattatccatttcaaattcaagtaattgctaagtctacaaaaagtatatatagccctttttccttttactcttacaagataagcatctgaataggtttcttcagccaacctttcaccgtttactctttgctcttcattccactatatccttctttgtaatcaaagttaacagcaaattataaagtaagagctttataatagttattactcttttgttacctaaaatatatttatgatgtttcattaggacagacataaaaaatagaatccttatattttcatacagtttgcttaaaagttattgaccaygttttcttcctatgaattcttaggtacaacacaggcttaaagataagatctatcaactagaatattacatagtcatggatgccaataagcagattacctcaaagagatgtgaaagtggggtgggggaccttcagctctgtttgcaatgctttatttcatttaaaatgaaatgcagaccaggcacagtggctcacagaggtcgaggcgggcagatcacttgaggccaggagtttgagaccagcctggccaacatagggagaccccgtctctaccataaatacaaaaattagccaggcgtgatggtgcgcgactataatcccagctactcaagaggctgaagcatgagaatcacttgaacaccggaggcagaggttgtaagtaagccaagattgcaccactgaactgccagggtgacagagtgagactgtctcaaataaattaattaatttaattaaatgtactgcactccaatctgggagacagagtgagactgtggaaacaagggaaagaaagaaaagaaagcaaagaaagggaggaagggaaagggaaaggaaaggaaatgtagagctctgaagcaaacatgtcaatgttgacatatgttagttctaggtgattaatacatacattgactgtttattgtattgttctttctgttctgtgatatttactttttttcataaaaatctctgatcagcaactgaggaaaaaaaactaattcaggaattatttcacctgtcacttgtatttattttctattttatttgcactgtactcatacacattaaacattttatttaacaaagttcactgctttgggtacttaatttatgtatgaaattaatgaccttttattcaaagcactactgttgttagaggaatgactaatattacagaaggtgatgactcactgcggtggaattttgctaaaggcaagacaaagctttatatctttaggtgggaataaattacagcttcatacaaacgcacttactagtaaatcaaagaggaaattaaaggcagtaaatctgtgacccgaatgcaaactactttaatgggatgcttttcagagattttccaggagtacaagcaaatccttttagatttgcagcaataaaaaaaatgctatgtggtgcttaaccatcaaaacacagcctttgcgattattcttcagggggaaacttttgctgcttacataaaataacctcaggggcaaggagtaaagaaaatatcaaagatcaaggaagctgataattactttaaagattaatgttttgcagatagaggcaaaagctatcatggatatctcactattaattcattcaaatgattaaaagaaagaaaacacatgaagggtggcattttgttccaaatgactgtggattcatatagtaagaacgtacttgtacccaggccccagtgatcctcccacctcagcctccagagtagctgggaccacaggcatggtgccaccacacccagctatttcttttttaatttgtagagacagggcctccctatgttgcttaggctagaacctcactttgaataccattctgatttctcacagaataagttatattttgaaatatcttactaatttaagaagattaagtattgtgatctattcatattcttatccagttttccactgcttgatttaaacactcttttcctaaatgcctttctattaatttgctgcataagcagctcataagttatttttttgtcactgctgttcaactattttagtcagatgcttgtctggactcttccaagtcttataaagataactaacagttgtgttctacataatatctatagtagagtcttcaccaaagatgacgctaggcatctacaatattaacttccagcaaaatggcatctctgattattttagtattgtataacagtttaggaaaataaccacattgtactctgtaaggaatcaaagtcaaagtgccaagtgctttaggcatttgtccttacaaatagcaccatgctatcccctccctagagcgagcccaggctggaaagagtttactgtgatacaaaaatatcacaaagggtccagtgtgacccataacatttccagtgtagatcaaaactcagttacacagtttttcttttgggaaggcagcaaggcagwtgagaaaaaaagtgagctagagagtaaaaatgatctggatttaatttctgagtcttactgcctaactttgggcaaattacttaacctttgaaaatataagaattctcactgggtacatgtaaacatgtatgtgaaaataacatacataaagtactctagcaggcatctagtgaatattaatttccttctgttagattatcaggttataatggagtcttttaacaatatctttaaaatactaaaaaagaggccgggtgcagtggctaacgcctgtaatcccagcactttgggaggctgaggcgggtggatcactagaggtcaggagtacaagaccagcctggccaacatagcaaaaccccatctctactaaaaatgcaaaaatgagccaggtgtggtgggatgtgctcataataccagcattctgggaggctgaaggagggcagatcacttgaggtcaggagttcaacaccagcctggccaatatggtgaaaccctgtctctactaaaaatacaaaagattagctgggcatagtggtgtgcgcctrtaatctcagctactcgggaggctgaggcaggaggattgcctgaacccaggaggtggaggttgcagtgagccaagattgtgccactgcactccagcctgggtgacagagcgagactatctcaaaaacaaaaacaaaaaccaaacaaaacaactcaaaaatagcaatggctatcactgtgtctcagttcacctttaatcatttctgtatcttttttatttttttcccattcttacgtatatacccaattcatttctatatctatcatgcctgctacctccttactttggggccccctgaattatataatcatagagtttatgaacatctcaaatattattcaggcttctaagaagagcccttcctaaataatctgaaaactatgacctactttatttctaagaccctctcaaggttgactatctctctatcttctatctatctatctatctatctatctatctatctatctatctatcyatccatccatccatccaccyaccyacctacctacctctacctacctacctacctacctacctacctacctattttgagacagggtcttgctatggtgcccattctggtctcaaactcctgggctcaagcagtcacactgcctcaacctcctgagtagctgggcttatagatgcacaacatcatgcagggataaaagagacatttaatcagcactggtaactcattatgaggcaggagaacagggtctggaggcagggaacctaaggccgattcatgctgactttctagaactaaatcaaaaggaaaaccccaactttccatgcccaagtagcaaaaggaccagtggctactccctttgtaccttccccctaccctttttctgcatgacagactaaaaactgaaagtacctctgattgtttccttcccacaaccaatcaggatggtcgtgggccaagtcttcatttgcataggagtgtaactttgtaacttcacttcagcctctgattggttgtatgtttgtgtagggtgtaactttgcttcagcttctgattgatatcctcccacaaccaaacagactgatcgtgggccattacttcatttacatagagtgtacactaagtaaccaatggaaaacctctagagggtatttaaacctcagaaaattctataatgggctcttgagctgcttgctcgggcctgctcccaccctgtggattgtaccttcatttttaataaatctctgcttttgtcgcttcattctttccttgctttgtttgtatgttttgtccaattttttgttccagacaccaagaagctggactccatccaccggtaacaataatacaaattcagatttctactgtacctaaataacgcaattaagttgcttttcatctttacaytgtctgtaaaaatgacarattataggcctaccatacaatattccttgaaacatgagaactgtaatcaggctctttccatcaggctcctctcaggccaataaagtaatatcactgtttatcaaagcttctacatattaatacaaatgcacaacacagtttaatagtaggaaactaaaatgggcttttaggatctattgtataaacttattaactatggaaaccctgggcaagtaacttgcttctctgagcttctgcttccagatctttaaaatgaggagagtatcacatttctttttttttctttttttgagacagagtctcgctctgttgcccaggctggagtgcagtggcgtgatcacggctcaccacaacctccgcctcctgggttcaagtgattctcctgcctcagcctccygagtagctgggattacaggcatgtgccaccacacctggccaatttttgtatttttagtagagacggggtttcactatgttggtcaggctggtcttaaactgacctcaggtgatccacctgcctcggcctcccaaagtgctgggattacaggtgtgagccaccacacccggcctcacatttcttataaaatcacttaaagaataaatgaaatgaaataaggtagacattcaaaatacagtcactaccttcatattaataaagtgaaaacaaggctaaagagtaaatgaggggaaaaaaaacacataccatgttcaccgcatcttgatcaaaagggttccattctatattctgaggatagtgggcgagaactttggatttgaatgttcttytcaaaggactctggtcaaaattttcgcctacaacaaataatacatagttaatatctwgaacttttccaaaagcatgtcatagttttctatttattttatagtcctactactgactgataatrttgagatctgattcaatttctgcctctaaccatctgtattgtaaaatcccgayggacaactaaaaaactgttaacaacagagcagcatttaaaacttcagaatctgaattttaaaatcctggctactcaactgatactaaaaatcaaaatatggtaatataatcattgytgtaacctaattatggtccacawttcagtgtgtggtaataataaactatatgaaaacatttacttcagaaaagaaaagtcttacattaagctaatcatatgtcttatgatcctaaaattttatacacacttagacccccatgctacagtgctcaaaggaagcaattttgcttgagtttccacaaaaatctctgagaaatgtgattgcatatccaggttctccagtaacaaaattaacagaattagaaacatcattgctgagtcatcctgtttagtagacagaacacattaaacatactaaccttttaaaataaatgagctatcctaagttaaattcattatctggcaaaattctggaaacataaaagtaggctacattttaattactaagaaaattcaggccaggcacagtagctcatgcctgtaatcccagaactttgggaggctgaggtaggaggattgcttgagcccaggaatttgaaaccagcctgggcaacatggtgagaccccgtttcttttcttcctatttttttttwaataaattttttaaaaagtaaaacattgaaaattcaataatagctatcagattagtttttttaacctcctcaaccagagtaattcccttaagacctattatccctaaatgttttagtttcatgaaatattttaaggtagacggatcttaaattcccaatgtcaaaaatttgggatcaaggaactagaagatcttgcaacaattttattgtgttgtgtgttttcctacttttagagttctaattaagtgcaaaatactagctgttacagcaaaagataaatgtcactttaccagtatttatactattaaaaatatcacaaagcaatttgatttatgaattgtatttgacttctagttagactcagtttctattttgggtaaaaatatgaaaaaaaaaaaccaccttggaatgcaaaacagatcgcagaaggacgaaaaagtcacactcaaaaatcttgctggagacaacaatataaaatacataggaatttttttgaacaaggacacataatttaaatayatttgcttaggcaactaaactactatttctaactgaagtccttggctaatgatcattattttctttagattcctctgacttatttaggcaaacatktcatctctgtatttttctactccatacttccatcttctaagagttgagagcattcatttctagaagagaaattgtcagacatccttaaggagagtttatcaatttttgcaccaagcttctagagtatgtaagcatcaaaaagtcagcagaggaatgtgaaactgtccatgagagtcaatgtggctgaagaacagattcagggctcagaactgatttcaggaagagtccatgatgtttttaagctgatgctagattttcctgtgaacactaagaattgtaaattattcacttcttcatttaaaaaaaagttacttggccagaatgtggtggctcatgcctgtaatcccagcactttgggaggctgaggtgggcagatcacttgagaccagcaacatagtgaaacctcatctcgaaagaaaggaaagtaagggggagcggcatggggagggtggagggggaggggcatggggaggggcagcggagggggcagggggggcaaggggagggggaggggcagtggagggggcagggaggggcaaggggaggggtaggggcaggggcaggggcaagggcagggggagggggcggggaggagaggggaggggagggaagggaaagaaagagaggaaagaaaggaaaagaaaagaaagatagattgattttttaggttacttttcatttcactttagagaaaaaacaaaattcctcccagttatagtctaagctgctgatagtgtactgacacagcaacagcgtaacttcatgatagccatcaagaaaccctctccttcacctaccctctaacaccagaaatacttgcttttattatccacaaatgtaaataaaatatgaaacactgcagaagcagaagaaacaagacataacctatcataaaactccttgcaacacttaccttttaattcagtcctgcctgtgtatagttaaaataacattatcttcattcatgtatcaagttattaatgggacaggagatatatcagaaaggtcatgaaagtgccattctcaatataattgttctgttaactaaggaacattgcaccttcttgacacacaaagaatcaacaagaaggaaaccacctccagaaagaaataattttacaaaaacaaaaaaagccacaaaacagtaacaaatctaacaaaagaaaagcaaaaccaccaccaccactgcttattagactgcttaaaaaaggggtaacaggaaagatcattgctatatatacacagctgtcttggcaaatatgatttggaaggatattaggggaagaactaactatgtagaaattctgatatcactgttaagaattcagaaatgggccgggcactgtggctcatgcctgtaatcctagcactttgggaggctgaggcaggtggatcacttgaggtcaggagttcgagaccagcctggcgaacgtgctgaaatcctgtctctactaaaaatacaaaacttagccaagcatggtggcatgcacgtgtaatcccagctactcaggagactgaggcaggagaatcagttgaacccgggaggtgggggttgcagtgagccaagatcacaccaccgcactctagcctgggtgacagagtaaggctccgtctcaaaaaaaaaaaaaaaaaaragaatttagaaatgactggatgcagctattcctactagcactggccaaaagaagagaatcttggtgatgacttttggggatgagagatgggggaacaacctatacttctcattttaaacacaagttttacctctaacttaraatttactgctgggraaaaaaaacaggaaaataaccaagtctaagaatttggattcccaggaaatgaaaaattacataagcatcctgtacttaaaatttaccttttaaatattatcttgaaacaaacaaggactataaatttgtacgactgctacaactacatatcaacttaactccaagtaacactgccaaataacctcctactaaattgaagctgcaattaatcctttcctcctaagaaagtaggaaatatctgccaagagagcttaaagactactgaatacatgttttcaaggcttgaagcaaatgaagtctttatgaaaattaagatgcagatgagagaagagaaacataaaataacatctacaagtctgaccaagcaaaactgaataaagaaacatttataatgggcttgcagtcaattaaaataatgatttataatagcccatccttgttcttaattttatttttacctgaagtcgtatttgcagcaccttggctcttgccatgacgatctgcttctagccattggtacaaaactacataatgtaacagaaacaaaaaagctttatgaacaaataaaaacaaacaaaaagcaaaaatgactttgaagaatggaaaatgagaataattaaccaaaagcaatcacacaggagacattaacattagaatgtagcttaacaccaatggaatgtagctgataagggattagtaatgaaagcaaagagaataggtaattttaacaaaataagtgaaatgctattaaatatctctaacaggttttgtatgggaaatagcacacatattctcttcttaatgcttacttaaagaggaatattaggagaaagctaatgcttctatagtcagatatcatacaagttgagtatcccttatccaaaatgcttaggaccaagaagggttttggatttctgactgtttcagattttgaaatatttgcattatatttacaggttgagcatccttaattagaaaattggaatactggcactcaaaaagttcaaattttggagcattttagatctcggatttttggattaggaatgctcaacctaaaaagtatgacagtaagactaaatgaccaactttaaaaattaaagagcatccctaattagaaaattagaatactggcctcaaaaagtttcaaattttggagtattctggatctcagatttttggattaggaatgctcaacctaaaaagtatgacagtaagactaaatgaccaactttaaaaaattacatcctggctgggcatgttggctcacaactgtaatctcagcacttcgggaggccgaggcaggtgaattgcttgaggtcaggagttcgagaccagcctgatcaacatggtgaaacctcatctctactaaaaatacaaaaattagctgggcatggtggtgggtgcccataatcccagttactcaggaaggccaggcaggagaattactkgaacccaaraggtggaggttgtagtgatctgagatcatgccactgcacttcagcctggatgacaaagtgagactgtcacaaaaaaaaaaaaaaaaaaaaaaaaattacatcccaaccactgcatattgattagaatggcttaagtcccaaaagctgactataccaaatattgacaaggataggaagtgacagtaattctcattcactgctgatgagaatgcaaaattgtacggccactttggaagagagtttggcaattccttacaaggttaaacagtcttatcacagaaccccataactccagtctaatcataagaaaaacatcaaattccaggaggagtaacctatagtatatctgataagtactcatcaaaactatcaaggacaacaaaaacaatgaaagtctgagattctgtcatagccaaaaggagcctaagtagacatgacaacttatggggatgggatacctcaacagaaaaaagactgatatggtttggctatgtcctcacccaaatctcaccttgaattgtagttcccataatccccacacaccgtgggagggacccagtgagaagtaattgaattatggggttggttacctccatgctgtccttgggatagtgagttctcacaaaatctgatggttttataaggggctttcccccacttcactctgcacttctccttgctgctgccatatgaagaaggatgtgtttacttccccttccgccacaattgtaagtttcctgaggcctccccagccctatggaactgtgagtcaattcaacctctttcctttataaattgcccggtctcaagtctatctttattagcagcatgaaaacagackaatacaagaatattaagtaaaaactaaagaaatctaaatagaggccgggcgcagtggctcatgcccgtaatcccaatactttgggaggccaaggaaggcggatcacctgaggtcaggagtttgagaccagcctggccaacatggcaaaaccctgtctccactaaaaatacaaaattaaccaggcatggtggtgcatgcctgtagtcccagctacttgggaggctgaggcagaagaattgcctgaacccgggaggtggaggctgcagtgagctgagaacgcgccaytgcactccagcctgggcaacaagagcaaaactccatctcaaaaaaaaaaaaaagaaagaaaaaagaaatctaaatagagtgtagactttagttagcaataatgtatcaatatttattcattaattataactaatgtaccatactacgagaggttaatgataggggaaattgtgtgtgtggggtgaggcaagtatatgggaactccattctcaatttttctgcaaatataaaaacaactttattttagaaattacattccagtatttaaggtaaaaacaccagcaacattatattcaatcttgccgggcgcagtggctcacgcctgtaatcctagcactttgggaggcggaggtgggcggatcacgaggtcaggagttcgagaccagcctggccaatatggtgaaaccccatctctactaaaaatacaaaaattagccgggtgtggtggcacacacctgtagtcccagctacttgggaggctgaggcagaagaatccctcaaacccgggaggtggaggttgcagtgagccaagatcacgccactgcactccagcctgggtgacagagcaaagctgtctcaaaaacaaaaacaaaaacaaaaaaaacattatattcaatcttataagtaatctaccttttataaatcatgtttatcaatgcaaacataagctgaaatttgctttatactgatatcccatttcgtcaataatattcctaagcataattataaagtgtcaactcttggaggaaagtttactactgtaacgacacaggctataacttagcagctttgaagagtgtaaaaacttctgaatgtcttttattggttactcagatgtctaaaactcagatatctttaaagagatgtcagagtctttcttttaaatagtcaataatgataatgtagggtaccaatggccaagagagcttgctatccacacccccaacgtttgatgatccaaggacagcaacaaatattaagcttctacgctggggggctacttacccacagatactgtgagaactgaatatcccaaacaaggtttacagaaacctttcatactctctcctcaacaaaaacaacaaagggctgagaaagctgcctacagaactgaactagrgtaataaaggaatcggtttattacaaatatctaagagaaccctgaaatcatcaaagtggttacttagatctctgaggaacagccagggctgtgaactgacatccatggtcatggatagatagctgaaagacctctgagcaaacatccaagtccttggttaagggtgccacagagggcacagaagtcagcaccctcctccagaaacacacttctgggagggaaacaattgttacatatgggactagcatgaaagaattcaagaaggagacctcaataattaaatatatactacaggtatttctcttccctttagtttacagggataacagctactcatgagaggaggagagaggggaattacactatgacacaaaaatctccccgttaggaaaagcaagcatgagctttacaattgacaatgaaggctgggtgcagtggctcatgcctgtaatcctagcactttgggaggtggaggtgggcagatcgcttgagttcaggagcttgagaccagcctaggcaacatggtaaaaccctgtctctacaaaaaatataaaaattagctgggcgtggtggcaggtgcttgtagtcccagctactcaggaggctgaggtgggaggatggcttgaacccaggaggtggaggttgcaaygagctgtgatccattccagcctgggcaacagggccaaactctgtgtctaaacaaacaattgacactgaaaatcacttccacaaaatgagatgcaaagtagggaaacaaatccattaactggtctaacaattttgcccagctcctatcttaagcctgtattttcccctgattaaggcagaaactcttggctatgttcaggttatcactaggaatatttaccaatagttccaattacttcacatagtcctcgtttccggttttatcagagaggtttatcatgtttgatttcatgtctcactgataaaatcatagtctgtttctgaccagagactttctccagaaaacaaagctaagtctcacactatttccctctcttcctgtcctgacaggtaaccccagaagcctagttttaaacaaaatcattaataaaatgagacatgaaagctattccaggtcaatttaaccagttatatagagaactacacataagcaaaaatcattttaatagatttacatattcaaatatttcatccttgcctctagattaccaaagtccaattaacttcagtttaaataattcagagaatttccagtgaaataagtacatctgattcaagtgcgctataacgtaaatcaccatttatataaagtttggactttaaagtctactttataggacatatatttaaacagataatgtataatttaaaaagaagtgtgactaattttttaacttaacatactagaatgtacatgggcagctctggaaatactgaactcctaaaatttctcaatctccataaaatacatgaaatatagcacaaaagttctgctactatgaatgtagatgatgttagaatgccaagaacacatctctcttcaccaaaggaatatgagatctggccttctggttgcttcacgcttcctctcagttggcagtggaaatagggaccccatccccagctcaaagttactggtagagatttctatagcatgcttgtggggttgcaaatgaagaggaatatttgagatttatgaaccttgggggctgtttttcagcctgatcatcatggttaaatatttcttcactcactctcctccctaaaccttcccactaggagggccccagtaagttacctcctgcactatccacttccatcatagcctgtttgtgaccagagactttctccacaaaacaaagctaagtctcacactatttccctctcttcctgccctgacagataaccccaggagcctagaagttttaaagaaaatctgcttctgggtgggggtcaaacgattagttcttgccaatgatatgtgggcagcaatgacgtcatttccgggtcaaggcacacaatctatctttcctctgccatctatcagctaaatgcaaaggaggccttaaaagatggacagttctcaaagtggaagaaagttgagtcactaaatatctttgtgaagtagagtgcctcccaccttggcctacattacactaaacgtgaatgagaaaaacttttattgtctcatgccactgaagtattatggggttgttattacagcagttagctattcatgtgtttactagcctgagtttttatttgtgttcgttttgactttctgactataatactaacccctgactatatcgtaccttctattggtaactgtctacattgcttgttacatgtttaaatacacgagtacagttctccaagtataagacagaatttgcctttttttttttttttttgagacagagtcttactctgtcacccaggctagagtgtgacgttgagatcttggctcactgcaacctctgcctcctgggttcaagcaattctcctgcctcagcctcccaagtagctgggactacaggtgtgctaccatgcccagctaatttttgtagttttagtagagacaggatttcattattttggccaggctggtctcaaactcctgacctcagaygayctgcccgcttcagcctcccaagtgctgggattacaggcataagccaccatgcccaggccagaatttgcccatttttaatgcatgttctccacctttcatagaaaaagccatatatcctactaagctatttatgaagaccacaggttctagcccatgacaagcttgttatcctttctaaacacacaacccccaaatctagtcagcaaacttgaaggtctagggtgatggtcatgaaaggaatcaaacaaaagaatcttggaggggtctctgcaaattcatcgactccattaaggaatattcaacaacacagaaacttaaatccaggtaatattaaagtttattttaattaattaattaattaattgtttttttgagacagagtctcactctgttgttgtccaggctggagttcagtggcacgatcatggcttactgctgcctggacctcccaggctcaagtgatcctctcacctcagcctcccacatggctaagactacaggcatatactctcatgcctggctaatttttaaaacatttttgtagaggcagggtttcgccacactgcccatggtcttgaacccctgggctcaagtgatctgcccgcctcagcctcccaaagtrctggaattacaggcatgagccaccttgcctagacttagttaagattttagtaagagtacatcaacatcaatccagtaagctttgagtttttaagagattcacaatatctttcctcttgattayatcaaaattaaagagccatgttatatttacctaacactaaatatagtttctctttttaatttattatttatttatttttttaaaggccagtcaagtgaagcagtgggagtggagaaggaacaaagaaatctgtaactgattgtaatgaattagttatcaacaccactgcactcggwcctgcctaaatacacttgcaattactaaaatttattcactgaaaaccaaaatttcacaacacagttattctgtttcaatctcaactgagtgtactgcaatccgattctctcatcagccacccaaagttagcacagaccccacaagtaaaagggtacgctcccaaataggcgtgcccttatttcagacaccagccacactttggaagtcccaggctacctgcacttctaacagactggctataaatttgagagtttccacaagtccctcaggtacactaaattcactagagcttgcaggactcaggaaagtgatgtatttacaattacagttttcttacaaaggacacaaatcaggatgaccaatcaaatgaagagatatatagggtaagatcaaggagagaatgcagagtttccatgccttcttcttgtggaaaaagggcatgtcacctactttcccctgcgcatacatcagtgttttcaccaaccaggaagttccactaaatctcagtgtccagagtttttactggctttactacatatgcacaactgattaaatcattggctacaagactaagctgaatctccaactcctttccctctccagaggccaggttggttcagagtcccaaccacatagttggtccttccagagacagcgcctatcctgaagctatccagaggcccatcattagttacctgattagcataacattcccgtcgtcactcaggaaattccaagggtttgagaagttcaggaaacacagacaaagaccagacaaattccttttttttttttagagacaggctgcagagcagtagtgcgatcatagctcagcagcctcaaactcccgcctcagccttccttgtagctaggactacaggtgcacgccaccatgcccagatgagtttttatttctatttttcatggaaacaaaaaaataaaaatgtttcttggcctcaaactcttggcctcaagtgatcctgcctgggcctcccaaagcactggcattaaaatcatttgccactgcacctggccaaattattatacgacagttttaggtgctgtgcagcttaccaccaatcaaagaacacaacagcagattatttacttgcaaaaataaccttagcaatgaattcaagatctagagttctctgataataaggaataaacaaagtttttgatcctagcccatgtttgtcatactaataataaaatttgaagtgagaaaaaaaaattttttaagtaatttaagtattgtaactgctattatgaaactctaagaggaaagagtccataatttttagattaataaatgtcatgcgcttgccagtgcttagtaaataatttttattattctgaagaacatctaagtgattttcaaataataaatacagccacgaaaacaaggttctggttctggctgaatatgctggtctagtagcctagtgcaaatcacaatgtctttgagcaagagttttctcttatagaaaacacattattttattactaaattagaaacacattattaattattcttaagtatttaccttctatggaaattatttatccaatgtatttctgggaaagcatattgttatccatgtcacattttattattcaatataaaacaaatctttccccattactaaagaacatattctttgctaaagagacaccaagagagccacgctttgccttccagaacaaaagaaagtaactcaacattaaaaaacttagggctgacaagtaacactatggagcaacactgctaagctgattcaaacaaactttcctgctgcatgactcaaagaagcagtcatttggtcagaggtaaagtagacctttccctccatttccattaactacttttgctgccaatacatactatcaccaaaaaaatttttataagaagtcaaaaacacaaggaactcagttaagcttacacaaaaataccactttcttcctcctacattagaaatcaacaaasttctctaaaagaaagatataaattacaaggtagagaagggggtacatttgttctactaatgtaaaatatcacattagtcaatgcagtctattagtaaatagactatcctgtttcatggtctatgaaattatcctaacatgagcaaactgggctaaatatgttagaaacgagactcactgggaaagagaatcttcctgtaagaatcaaacagaagtctcattattctaacaattaaatgaagttgttggaagcttaaaatggttcagttgatgtgatttgtgctaaacaaaagcagttatctgagtctctctgcgttagtgtgtggcctttcatctaaaggccttcaaggccctcccctactatgtttggtgttagaagacccagattttaaaatagtattaaggttctgcacagactgaaaatcacacatcacatatatcaggaggagaacaatgacctataagatgactaagaccctcccagttctatcagagactgtgattctcaaagctactacctaacgtacttttttgaaatagaaaaaagtcaagtcacctttgggggaggggcgaggtggagccattttaaccactttttgaagtctgcaaaattaacataaaacaaagcaaccaaaaccaaaaaaagtgaggtgaagggagcagaattttccccttctccatgggaaaaacaaagtcttccttcctccctccatcagaaaaacataaaaagaaaatcctcaagatgatccccagccctgagtttcaattcatgacttttactatccaccaagaatctccacttgctgtctcagactcagcagcctcaacatcaacgtttacacaaccaagctcatttttcccctcaaagcttttcctctgtcgacagtgccacaattcatgtagccatctaagtattattatccacttattcatccctaaagaggagttaatttggccaagtgtggcagctcacgcctataatcccaacactttgggaggctgaggcattctaaggggagagacccatagttttgtatgcctacaggcctagctacttgggaggctacagcaggaggactgcttgagcccaggagttaagaggttacaatgagctatgattgtgccactgaattgcagagccaagactctttctcaaaataaatacataaaaataatttttaaaaaagtttggttgttttaagtggctaaattttgagatagtttattatgcaacaataaataactggaaaaaatagtgaacaaaatatccaaaataatccttgctctcacagtttacattctaagaggagggagataataagtataataaattatatagtatgttggaagatgaaaggtgcaatggaaagttaaaaaagaataaagtgaggaaagccagcagtacacaagttgcagtattaagtaggatgatcaagttggccctcattgaggtgatgtttgagcaaacttgaaggagacagagaattaatcttacctccttgggaaaatcaacgtgaactaagataccagtgtcacaaattcagtccctgccaactaagtccagattccttagatggcatttgaggaccaccatgatctagctggacctactttagtttctgaggctcctgcacttgagccacgccaaatgacgtgcagttcccttttaagtacgatatcttatgggtccttgctagacttcgtgtgtctgaaacaacttttcccctgtaataattttctattgccccaagttattatgataaatttagcagcttaacacacccacatttattatttcacattttccatgagccagaagtctggcacagcatggctcagctgattcctttactccaagtctgacaatactgaaaccatcctgttgacagggctgcattcctttctggaggctctgaagaagaatccactttctttattcttattctttgagatggagtctccctctgtcacccaggctggagtgcaatggcacaatcttagttcactgcaacctttgcctccggggttcaagcaattctcctgcctcagcctcccgggtagctaggaccacaggcgcccgccaccacacctggctaaagaatccattttcaagcacactgcggttattgctggaattcagttccttatggttgtagagctaaggtccccgtttccttgcaagctgtcagccagctgcccttagcacctaagatctctctttggtccttgtatatggcacccaacatctcaaatcaaaccatcttgcacttgaaatctctctaatttcttctctcttctgcagcagctgagattttctgcttttaaggactcgtgattatacaggacacacctggataattcaagcaactctccctattttagggtcagctaattagtcaccttaattaaatctgtaaaattccttaacagcagaacctagactgctctttaactgaatacccagaagacaatgtttgggaatattttaaaaattctgcctaccacacccctccttccatgtctgcctattaggctcctacacatctttaagaattctactcagggctgggtgtggtggctcatgcctgtaatcctaacattttgggaggtcaaggcgggggaaataacttgagcccaggagtttgagaccagcctggccaacacagtgagaccccatctctgcaaaaaaattttttttaaaaaattagccaggcatggtggcatgmgcctgtagtcccagctactcaggaggctgaggcaggaggatctcttgagccctggagttccagactgcaatgagctgtgactgcaccactgtactccagcctgggtgtcagagggagaccctgtctcaaaaaaaaacaaagattctattcagaagagacctcctggggaaacctttcttgacctgtccagaagagaggagtttcttccataacrctacaaaatctacaaattagaacagatttttatggtccaatattttaaaaattccatagcttaatttttaaatgaaccactatcgtacaaacactgtactaaacaaatattaattgatgtgttaaaataaaattttttctcaacagtaaggttcaagataaagcatttatcttcctttcttggttatcttaataatacgtgaatatgatgtcttttttttttttttaacagagatagcactgtgaagttcttggaactttgttctcataattgctatggcatattgttgtctgcttaccatattacattaacactgttaaattatatcttcccctttataaattaagctcttcaacacattattcacccttacatcctcaacacctacttaatattgtgcctggcaataaaaatgttcgttgagtaaatggatagatgaataaaaactgtactcttaggtctgaattatatactcyaaaatttttaagwcacttatttaaaatattggtagctttgaaaatgattcatttcaaagccttgactatatataaactaaaatataatttaagaaataaaaacatcccctccactgcccttttttttttttttttttttttktgacggagtctcgctctattgcctaggttggagtgcagtgctcagctcactgcaacctctgcctcctgggttcaagcgattctcctacctcagcctcctgagtagctgggattacaggcacgtgccaccatgcctggctaatttttgtatttttagtagagacggggtttcaccatgttaatcaggctggtctcgaactcctgatcttgtgatctgcccgcctcggcctcctaaagtgttgggattacaggcgtgagtcaccgcaccagcctccactgcacttttctttgacatagagtcttgctctgtgacccgggttggcatgtggtggtacaactacggttcactgtagcttggacctcatgggcttgtcaagcgaccctcccacctcagcctccagagtagctgggactacacgtacacaccaccacacccctggctaatttttttttttttttttaatttttagtagagataaggtcttgctatgttgctcaggctggtctcaaactcctgggctcaagggatcctcccaccatggcctctcaaagtgctgggattagaggcatgagccactgcactcagcctattttctttagaatattttattcctttaataatttgtgttggtttgtaaattaaaatttgatacctaccttatttcaaacatagggatattattattgtactgtatatccgtcatggtgtcacataatcaaaattttattaacctttgctttgaatcctagatttcatggttatcttctttcttcagctttgcattggtcaaactcatttcattgttttaagaaactttttaaaaagtaaatttaatttttagaatggttttagatttacagaaaaatagggaaaatagtaaagtttccacataccctaaaaccagtttctcctaatagtaacatcttacattagtacatttattaaaattaacgaccagtatttggtacattattagcgaaagtctaaactttatctagattttctgagtttttacctaagatcctttttgtgttcaagaatctcacccaaaataccacattagagcagtcaagcctccctaagttcctcttggctgtgacggtttctcacattttccttgttttagatgaccttaatagttttgagtagtattggtcaggtattttgtagaaggtccctcaactgggatttgtctgatgtttttctcatgattatactgagtttataggtttggggaagaccacacaggtaaagtgccattttcatcacttaatatcaatgattcatactgtcaatatgacatcacagttgatgttaaccttgatcacttggctaagatagtgttcttcaggcttctccacagaaaagttcttttttctctccttttctatattgcaatcttcagatggaaatcactctacccaacccacattttagaaatagagagttatacttcacctcttgagggtaaagtacgtatctacctctatcatttggaattcttctgtaagggagatttgtctcttctccatttactaatttatctgatcatttatttacatcagtatggactcatgcatatttattttatattttaagtcatgacagacttttatttttctgctcagtgtgttccagtttgggccatttacaactcttttatttggctcctatgcccatttgatgcacccccatctatgtgttgtgtggcttctttgttctgttttgggtttttgagcacttccttaattgccagcagtataaggctcatatttcttgccccatttctagaaatcagacatttctccaaggaccccctgctcctttaattggaaaatggtattagaaatgaagacctctggggtgtcattgcttgtaagtccctcagataacattttttttttttttttaagagacagggtctcactctgtcacccaggctggaatgcagtagcacaatcattgttcatggtaaccttgaactcctgggctcaatcaatcctcctgcctcagtctcccaagtagctaggattataggaatgtgccaccacacctggctaatcttctttaaaattttttgtagagagagacagggtgtcactatgttgcccaagctggtctcaaactcctgagctcaagcaatcctcccacctcagcctcacaaagtgctgtgattacaggtatgagccactacacaaagccaggataacttatttttgcttcttacctaaatattcagaaataggggaargttggtaataccaktttataaataaaatgtttaaatcttttataacaataagagcaacaggctgtatcatatagtcaaggtttgtagtaggctatgctacctagttttatataagcacactctatgatgtttgcacaataacaaaacctcttaatagtgattttctcagaatgtatcctcatcgttaggcatatgagaataaacgaataattatgaacatgggctagttgaaagaacacaggaatactactgactttgtgtaaagatttttaccttgtttgtacaaattctacaataatggttttgtaggactatgaaggttatttaataaaaatttaaggctgggcatagtggctcacgcctgtaatcacaacactgtgggaggccaaggtgggtggatcacttgacattaggagtttgagaccagcctggccaacatggtaaaaacccatctctactaaaaatacaaaaaatttgccargtgtggtggcgcgtgcctgtaatcccagctactygggaggctagggcaggagaatcacttgaatctgattcagggaggcagaggttgcagtgagctgagactgcaccactgcactccatctgggtgacaaagtgagactccgtctcaaaaaaaaaaaaaaawtaagatttgtgacactgggtgcagtggctcacgcctgtaatcccaacactttgggaggctgaagcaggagaatcactttggaccagcctgggcaacatatcaagacctttttctctacaaaaaaaaaaatttttttttaattaggcatggtggtgcacacctgcagtcctagctactcaagggactgaagtgaaaggattayttgagcacagaagttcaaggctgcagtcagctctgatagtgccactgtactgcagcctgggcaacagagtgagaccctgtctctaaaaagaaaacagaacgtaagacttgcgattataagccgagtgtggtggtgcatgtctgcagtccgagctatttgggatgctgaggtggaaggatcacatgagcccataagttcaaggctgcagggagctatgattgtgccactgcacttcagcttgggtgacagagtgagaccccatctctaaatayatacacatacattttttaaaattgcgattataattatactgaaattatgtttaaattatcattattattattattgtaacagtattggattctttcacagtatgatatagaaatagatgagaaataaccagggaaactacattattaattttgtacttctgtaagaccattccacatacttatagttttgcagatatacttacatggtgggtaaattttattgccataaatgtttattaagttgtacttctgtgagagactacagtatgtcaattcctttcaggatgagttctaaacaacttcccattttgtatgaaggaatgaacaaaaaaaggaatgaacttgaactctgttcaattatatacaattaatcagtagaaaaactgttacatagatatgctttttacactaagattaaactcatctattcactagtaacacaatattactggtataaatagactactcaaaattctgtactgccaaccaacaaatatattgagccttgctacaagcttagccaagcatattaggaatatagaaaatttatcagtaatggttcttccctcagcatttatagaagaaattcttgaaaaggcaaaaattcaactgttagagacaattatagcacaatggagaggctttagagcatrtcttaaaataatttaaatatatgcattaaaagctactctttccgaaaaaagtgattacacttatcttgcacgtagatgtatgggtatgaaaactaggttgccccttgtttattgggctgaacttgctccttttgataattactaaagtatgtcatttatttatattcattttctctaatgatgtacagcatattctctgtgttagtatatctcgcacctaaacaaattaagcatgggtgggcacggtggctcgcgtctgttagctctttgggaggctaaggtgggcagatcacttgagcccacragtttgagaccagcctgggcaacatggcaaaaccttgtctccacaaaaaatataaaaattagacagstgtggtggtgcacacctatagtcccagacagctacttgggaggttgaactggatcacctgagtctagggatggtgaggttgcagtgagctgtgatcacgccactcctctctagcctggacaataagagtgagaccctgtctcaaaaaaaaaaaaaaaaaaaagttaaccccaagccatgaagaaaccttggcccattatctattttttccatttcttcatcacatttgagctttcatcattgatgatagcagtcatttttctgttctttggttgcaaaacaatatacgatttatgkgctccttcaagactgatataatatctgactgccattaacacctaccttttcaagagctgaccatctgatctatatattatttaagttctttcctttgtttcttgggctgctcaactttaatgcaatttattttcctgtctgtaattttaaaaaatttcaggctgggccctgtggctcacaccttctaatcccagcactttgggagactgaagtgggagggctgcttgagtccaggatgttgaggctgcagtgagccctgatcrtgccactgcactccagcctgggcaacagagtgagaccctatctcaaaaaaattaaaaagaagaaattagagcatatagagaagtaaaacagaaataattaacactgtgtgtagataccttccctcctgaattcmacaaatgttaacactttgctatattcattkcacaactttttaaaacaraaatatgaatcttaaattcggctggggaaaaaaaaacagaaataaaaactttagataaatgaaaattccctcagctggagctcagaacatcagcctccattctgcacatccatatctttcaggactgtttcctacatgtataaactaccccactacaacccacggtgattccttttttctctaagccctacccacttgattatctaatataggcaaatgtttgttttgttttgtttttctgtgagaatgtcctctatcctgcgcttaaagcggactatgagtagttagcaccctgtatcacacccagctctatgccctaattctgtattggctgtttgctgcctttgtcttgagacttaaggtgaaarccatcttagctgaggtgaagggcagtgaaaagtatagcacagtactgaatgagaagtgcatagaaatatgaactgataaaagaaacaatctctccataactacacaagcttcagttaaattaacagctgtagccttagttttactaacgattgtatttggacgttagtctgtaaaagaattcacctcccataggaacaatgttataagatgattaagtctcctcatttcccagccctaaactagtaggggtgcttttaatgatccaagactgggatctgggaaggtcagggaggagaaagtgacagagatcaagttcagaagtccttgaatccagagttgatgaagggctgggaagtgaagcacaggggttctgggagtctaagaagtcaaatgacactttggggatcatcaaacactatgaagtttatcctttactgtgcctttctgcctcacactaacccttcctataacttgttacctgcagctatgtactcttgcctttgcaggtggatgagaaagtgggggctccttccctcaactcagccttgcattgctggaataaaaagcctgagttcccaaaggtagatctgcgggcagtctctgcaatgggagcagtgcaaagtggagaggcagggaaagagctttataaactgaagctctggaagtcagaaacctctcacattcagcttctctgattacacagctcatctttcctcctcaaccagactggatgtcccactatcagagactatgaacacataaaacttgattcaaatattttaggaaataacactacacaaacaaataattcaaaaaatgttagacttgaattatctttaagagcctgagcagtccctctcyctctctcattgtttacattaggagaacacagatgctcagctaacatggtttgcctaaggtgagaattaaagacagagctgaggcttgaattaagagtctccagaaacccagtctcaaagacagtgtcttcctctattaaatgtccacctctgtacccttgtgccaggaccagggctaagcatgtaagcatgaggcacatactcaataaaaatgggccaacagacttttctacatgtaatctgtgagctttgaggcactattcaaatatacctttttttttttttactaagatagttagcaagcaaatatcttcaagcagcttttaatcaagcttttagtactgtatattaccttcccttctcaaactaacttaaaatcaccttaattccacactcactgcatcatactcaaaagcatagctaattttctgggttttttaaatcttttttttttgcctcatgctgtgctaatttaacctcatcttggtaaacaagaaaatggtcctagtttgacagactctagctgcagcaactgcagctggcctatatgcaaaccaattttgttcattctttatcctggcagggagccctgccctagaattgttttagggctaatcagcattaaacctgcgtcagaaatgttgctgaaagcagccctagagcaagaccacagcaacaaagctcttcaggaaagggatgacaaatgcagcagctatgtaaaaatctatgggaagacttttgttcatgagagtaaaagtggggcctagcttcttttctgtgctttggcacttatcctgtggaaatgacttcgaaaggagatacggaagacaaacgatgcaccaaatttgctctatttctttctttctgggtgcttggtgattagccaaaaaatgttactaacttcagatggtagcaaatggtaaagaaattagatttgcatcctttgctactctctgaacttgaaaacactgcatgacttgtctttttgaaaacactgcatgacttgtgagttagcatgattttctataggatgaacctgaggtacaagaaacagatgtgcataatgacaccttgagtagatataaacaactctgtctaaaaactttgttaatggataaattccttaacaacaaatgattaaatattggagtggttttctttctactcatctgctggattcagtctgtacctttcagtgtatcacattcattttacattagaatttgaatgtattagcaatctaatacattgttagtaactttcacaagtactcacaaaagaaggccattaggcttccctaaatgccaccagatctgtggggctcacacagaagtcaaaaaaggacagtccatttttgtctgatcactgtagttcttgaacatatggttgctttctgtgtctgctcacttaattctcattaaatgactagtaaatcagtaactgcaacagataagcatgcttcagaatttttttataacagctttattgagctatattgcacatacccttacactcacccttttaaagtatacaattcagtgattttagtatatttatagagttgtgtgagcatcactactatctaattttagaacattttcatcaccccaaaaagaaaccctgcacctcaccttagcagagagactttttgatatggtagccatccctgtttgctaggtgtgtttgctacctgttcaggcatttcttggcctgtgtcaactggaacatggcaaaaaaattttatagtgtttaggcaataaatgaaaaccctcataaaatgtgtttcaaataagctttttctctagtccaatcctatccatgtaccagcttggagactttcattctaagaaataatttatttgcagaagagttaataaacactatccaacttacagatatcaaaatgaattgtgataacatctacaaaaatcagtttcctgcagatattctgcgttgaagttcttactaatcaactatagggtgctatagaactttttaaccttgtttccaaaatatgggaagacaattttgcattattgcagtttccaggcacttataatgaattaaaatgaaacagctgttaatcatatgcagcaaatctctagctagtatagaagttaggcacacctagcatagaaactaggcagataatggaactgaaataaacttagtaagcaaagaaagttaatagaaagataatgtgaaccatatatataatttaaatttttctagtagctacttttttttctttttgagaaagagtctcactctgtcatccaggctggagtacagtggtgtgatctcagctcactgcaacctccacctcctgggttcaagcgattctcctgcctcagcctcccgactagctgggactacaggtgtgtgccaccatgccyggctaatttttggtatttttaatagagacagggtttcactgtgttagccaggatggtctcgatctcctgacctcatgatccacacacctcggcctcccaaagtgctgggattacagggggttaacccccgtgcccggccttaaagatatttttaagtttaaatatttttaaggttaactccttttttatagattcccaagagcccttctgatgaaaatccacttaattttgcttaattttttcctgtccaggcctggagaatccaggtttttgcttgtagactatatttcttgcccctcccttctcttcctcttttctagtacaacatactctgtcatttatttaaacaggaaattatcctatagtttgagaaaacatcaatgtagaagtgataatgtaaattaagtaaatttctgatcatcttaattcctcagtacagcttgnnnnnnnnnnnnnnnnnnnnaaaatgaaacagctgttaatcatatgcagcaaatctctagctagtatagaagttaggcacacctagcatagaaactaggcagataatggaactgaaataaacttagtaagcaaagaaagttaatagaaagataatgtgaaccatatatataatttaaatttttctagtagctacttttttttctttttgagaaagagtctcactctgtcatccaggctggagtacagtggtgtgatctcagctcactgcaacctccacctcctgggttcaagcgattctcctgcctcagcctcccgactagctgggactacaggtgtgtgccaccatgcccggctaatttttggtatttttaatagagacagggtttcactgtgttagccaggatggtctcgatctcctgacctcatgatccacacacctcggcctcccaaagtgctgggattacaggggtagctacattttaaaaatagttaacaacaacaacaacaacaacaacaaaaacaggaaaaattcatcatgacaataaattttacttcttgtatccaaaatattgctccaacatgtaataaayatacaaaaatgttagtgagatattaaatctttgaaatccagtgagtattttacatctacagctcatttcattttgaactagtcaagtttcaaatactcaagtcacatgtggctaagtggctcccatatcaagcagcacagccttagatcattaaagttggtcttttttttttttttaatttcatcataagggattgcctggctataaggatgccaagggaaataatgctaactgaataaaataggcgtcaaaaacaatagaaaaggttatatcaatgttatatatagtaagttcagagataaggcattagaattccactgtacattctgtggggtgtgcagatatcagacattcactttagtacaaaaaaacttttttttttttttaatatttagagacagcgtctcactatgctgctctggctgcactcgaactcccgggttcaagtgatccacctgcctcagcctccagagcagcttgggaatacaggcacacaccactgcacctggctattctaccaatacttatttttgtagactgaactgtacagggttaagtaaaattataatgagaaaattgctgattgtatttcaattaaatttaagaaacagtttcatttttgttagtctgtcctatacaagatgcctacataaaacagaaatgtgtgtgggtttttttagtggcttttctactcctgtatatctagcgtcaacaaagaccaccaccatccatccaaaccattaaaccaaggaatgattcttgcttcctcttgcttcccctagccatttaagtaactgcctgtaatgctaagttccgttccatccccatgccttagtttaggtacacttcatctcttgtccagacyacttcagtagcctcctacctggcctccctatcaaccagactccatactattgccaaaatcatcttcttaatatgctaatctgatcattataatyccctgcataaaatctttcagtggctctttatgactggataaaaattccttagcttgtaatacaaatttatatttggcccttggctaccctcttcaattctatttactacccttcctcttctctctcatgttagctatagtaaatttgctgtcatatcctcacccctttctgcttttacaaatgttttccctcagtttaagacatcccccactcaatccttgcccacttagcaaacatctgctcatrgtgcagagttacattctcagtgaaaatttccccatctcccactagggagagttagataaacacctctaaacgctgatttacagcatctatcacattgtgcagtaraaaaggctaagctgagagtcaataacctttggaaacttcttagraaagcatggccatatcaggaactaaaatttgctgtactctgcagtcctaaattcatgtacctccctttgaaagctgggctgatcccaatttcctaggtgaggtaaatatcaaagaggttctaactagttcaaaattttaaaactattaaaattgctattattattttgagacaaggtctggctctattaccctggctgaagagcagtggcacgatctagctcactgcaacctctgcctcctgggctcaagccatcctccccagttcaggctcccaagtagttgggactacaggcacacaccaycatgcccggctaattttgtattttttgtcgagatgaggtttcaccacgttacccyggctggtctcgttacttgtgagctcaagcgacacacctgccctggcctcaccctgggactacaggtgagcgactgcacacggccttttttaacctttaactctccaataacttactgcatttgttcagttcttacctgatcccagtaaagtatccatgacaaaaacatctaaatacctttccttttttaggcaggagggagtggggcttatatgcaggctttgacttccagttttattgagggtggcttcatcccttagaacaacttttgtgttgttttcagacctagagtggggctgtgaaactcccaagtcttgggttataggggaccaatatgggagattccctgaggatgttagcattcccagaataggagggaaggtgagataaatgtgcctttttttttcctttttttttttttttaaagaaaaagcctcattctgtcgcccaggctggagtgcagtggcgtgatctcggctcactgcagcctccgcctcccaggttcaagcgatcatcccacccgaacctcccaagaaactgagattaccggmatgcaccaccacacctgcctggctaatttttgtatttttagtagagatgggggtttgccatgttggccaggctggtctcaaactcctggcctcaagtgatccgcctgccttggccttccaaagtgttgggattacaggtgtgagccaccacacctggcctattcttgcaattctggaagatttagggggctggcaggagacaagactgagattgtttaggccatcctgttgctgacacaatcctggcacttaagcgggaatgcagtggcctaagtgtaaggcaacatatctctcataccatttcaccaaaacaaaacaaaaaacacttctgagtgaatgtctggccatcttattagcatcttattaatctgttttgacattatcctaaaaatatgcttttcctcaaaaaaaaaaaagtcgtacaacactgtgaatgtattaaatgccattaaattgtacacttcagaatggttaactttatgttatataaattttgccccaatttttaaaaatgaaaaaaagagtatatgacaagaaagataactacaggattaccaaagccattatattttccctcatttgtatgtacatgacacactggttctataatgtttcccaagaatagatcytgaatcctaagactgctgtgatgggactctgagagaagagattataatgtcagaatacttagctcctaggatgtgattaagcttattttgttcatcactaaagtggtatcatagcatyctttctaccatattaaagtaaatgaatcctaattaacatctgtaatagctcagtgggcctctttgtcttttaagtgaaaactactgagcccttttttttttttttttttttttagatcatgtcatagaaacattggtggcacaatccaagtggtgacgaatcaattaatgcatggaataaaaaaagagctgaaaagacagtagtaaacatagggctaatttatgaattgtatttttaatgaaattaccttttattaggaaactctaagaggtctatttctctccttttgaatttgggcttgccttgtgaccagcagaatatggcagaaatgtcactgtgacagtcctaggttcagcccttaagagagtcctggmagctcctgttgtttctatcttagaattcatttaagaagcctggttgggacgggcacggtggctcacacctgtaatcccagcactttgggaggctgaggtgggcaaatcacctgaggtcaggagttccagaccagcctggccaacatggtgaaaccccatctctaccaaaaatacaaaaattagccgggcatgatggcatgtgcctgtaatcccagctacttgggaggctgagggaggagaatcgcttgaacctggaaggcaggggttgcagtgacctgagactgcaccattgcactccagcctcggcgacagagccatgatactctgtgacatttacaaaagaaggaatatccttgaaatttaagaaaaaataaaaaccaaaaacaaagaaaaagaaaaaaaaagaaatttgagcaaggtaagcttaggataagcagaggacagtgtgacttgacacatcagcttagagacccagttttctatagtcctctcttaactcctatcatctgagagccctactctcttttactgattctctcaccatttctcaggcctttgtccctgttctcttgctcccttccattcccctttcttcatctactaaaatgatacacctcatgagaacatacacaaatgaccaataggcacatgaaaagatgcaacatcattagtcattagggaaatacaaatcgaaaccacaatgagataccacttcacacccacttgcatgaccaaaatagaaaagacagacattaacacatgttggcttagatgtaaagaaattggaaccctcatccattgctggtggaaatgtaaaataataactgctttgaaaaagtctgctaattcttcaagtggttaaacatagtatatacccaacattaataaaaacatgtctgtccatgcaaaaatctgaatgttcatagcagcattattcataatagcccaaaagtagaaacaacctaaatttccatcaactgatgaatgaaaaactaaaatatacttctataaaatagaatatctggccataaataggaatgtagtactgatgagtgctacaatgtggatgaatcttgaaaatatgcaaagtgaaagatgtcagacacatactgtacaattctatttatatgaaataccagaataggcaaatttacagacatataaagaatatgtgttgccaggagctgagtgaaggggagaatggggagtgaacacaggtatggggtttcttttgtggctgatgaagatgttctaacatttattgtggaatggttgcacaactctgtgaatatatgcatagcaattgaattgtttgctttaaatggtgcatttgatatgtatacgttaataatatctcaataaagccatttaaaaaaattctatgaggtcaggcacggtggctcacactataatcccagcactttgggaggctgagatgggtggattggcttgagctgaggagctcatgaccagcctgggcagcatggagaaaccccttctctacagaaaaatataaaaattggccaggtgtggtagcaagtgcctgtggtcccagctactccagaggctgaggtgggagaattgcttaagcccaggaggcagaggctgcagtgagctgagattgcaccattgcactccaatctgagcagtggaagtgaaaccctgtctcgaataaattttttaaaaaattctattaatactttaagggcaagtttaaatgtgatcttctccctatttctcacctcacccagttaacattaataatttcctctgtgctrtcaaaccagttgttattacagtctgttagttatatattacctatattagaacccaggctagtaaaaaacttactcaaatttctttacatcccccttcacaaggaggaattcgatacagttcattacacagggtaggtacctaacacgtctttactacagaaatatttacatttacccattaaaatgtcacaaacagttaatggttaggctaggattcacctcttcaaatgacaacatgaaaggattgggaagctctgatggcagaagagaagacrctagataaactctgcatttgacccagaaaacatgtcaaatcctatgatcttgtctaaagttcaacaatgccctgtagctatatattctagtgctcctaarttttacaacctttccttcctttagaaatattcacgatgtgaatgctgaggcataaataaataaaagaaatattcacttgagcaaataatccacaagaatcctttaagaagtagtctctgcagagattaggggagactaaagagacataactaaatgcaatgtggtatcctggattggacagtggaacasaaaaagggtattagtggaaaaattcacgaaatccaaatgaagcctggagtttagttaayagtattattccaatgttaatttcttagttttgatgaatgtaccatggttatgtgaaacgttaacatttggagaaactgggtgaagggtaaacaggaattctacactgtctttggaactcttccgcaaatccaaagttatttcaaaatactgttgtgactctactgtgaattaaggcaaagaaggatatattaatctaaagtattttcatattcatccattcaacaaactattttgtgcctgctatgaacataacattctgggatgactctgggaacaaaacaaagattcctgccaccatggtgcttatagttcagtagggaaaacaggcaataaacaataaacataataaataagttacacggtatgagagagggtgatatggaaaaacatgacagtaaagagcattgagggatcagcactgggaagcaggtggagaatcacaattttaaaaatagtcatctggaaaggactcactgacacagggcatttaggcagacatgaaggaggtgagacagtgagccaaaagatccttggggggaagagctttccaggcaaccagaacagctaaagcaaagatcataagacaggarcatgctcagattgtctggaaaagagcaagacaaaagcaatataatgagtgaagaggagagaaagctccagaggttacgggcggccagatcatatgagggatctggcttttcctctgaacaaatgggaagtcactggagactttcaaacagaggaatgctgcgctttgaaagaatcactccaggctgggcrtggtggctcatgcctataatcccagcactttgggaggccgaggcgggcggatcatgaggtcaggagttcgagaccagcctggccaacatggtgaaaccctgtctctactaaaaatacaaaaattagctaggcatggtggcccrcacctgtaaycccagctactcgggaggctgaggcaggagaactgcttgaacccgggaggtggaggttgcagtgagctgagatcatgccactacactctagcctgcgtgacagagcaagactccatttggggaaaaaaaaaaatcactctgacagttgtattaataataggctttatgcaacatcacctatatggtattcttggaaaaaatgtttaatgtgaatctaattatgaggaaacaatcaggtaattccacaacgtgggatagtctgcaagacaatatgcctagactctttaaattaaaaacagtcagtgtcatgaaaaacaaaaaaggtgagggagattattttagattaacaaggccataacaaccgaacataatgaacaaccttgactgaaatcctaaacaggagaatgtattaatttccaatggctgctgtaacaaatgacctcaaacgatatggcttgaaacttattctttcacagttctggaggccagaagtcagaaatcagtattactggtctgaaatcaaggtgtcagcaaggccgaactccctccagacggtctaggggaaaattcatttcttgtttcttccaagttctggttgctatgcgcattctttggcttacagctgcatcactccaaactctgcctgtcttcacatcacttcctccwgcgtgtgtcaaacttccctttgcctctctctagaagggtgcatgtgatagcatttagagccaaccaggataatctccgcatctcaagatcctgaatcacatctgtaaagatattttttttccaaataatgtaacattcaggttccaggtattacgacctgacatttaatctacctaagaggtaaaagtatctctgaccaaggtgtagcagcggagatagtgagatgtatttgaattctggatatattttgaagggtgaggcaataatacgaacagaccaaacacggagtatgatacaaagagagtaataaagaaagcgtgcaaggcttttgagagactgcactgtcaactgacaaagggaagattacatttctgaggaaacaataggaatccagttttgaacatactgattttgagatgccaattctaactggagatgttaagacagcagtcagataaatttaagtctggatttcaggagggaggtctgagctagagaggtagatttaggactcatttgtaaagagctgatattggatcatattaaagtcatgagggtcaggcacggtggctcatgcctgtaatcccagcactttgggaggccgaggcaggcgaccacctgaggtcaggagtccaagagcagcctggccaacatggtgaaaccccgtctctactaaaaaacacaaaaattagctgggtctggtggcgggtgcctgtaatcccagctactcaggaagctaaggtagggtgaattgcttgaactcgggaggcggaggttgcagtgagccaagatagcgccactaaactccagcctgcgcaacagagcgaaactctgtctcaaaaaaaaaaaaaaaaagaaaagaaaaaaggcatgaggtattggatgagataaccaagggagaagatgatgacagcaatctatgaaatcacaagatgcctgacagggcagaaaaaaactagagaaaatcttataacctcagtcatcctaagattggatggacccagcagttctctaagaaaactgcatccaaaggagtccacagcactcaaagatcttggaagattttctggttcccctcaatttaaaaatgtatgcagctaatcaaatggcaggtccaggatccctgagataggaaacttagaaccaatattccacttaaacattccacaaaagcattccaagtcctaccaaaataattcaacagccatcactcaagaaaacatcctttaggctgggcacggtggctcacacctcactttgggagaccaaggtggggggatcgcttgagccctggagttcgaaaccagcccgggcaacatggtgaaaccccatctctaccaaaaatacaaaaattggccagtctcataacccagtctcaaaataaataaataaataaaaatttaaaaataattttttttaaaaaaraaaacatcctttaaaaaatgcccaacacaaaatcacatcagtttttattaagaatctcttacatttttaaaacacagagtgataaaaactgctataattgccatatgaatagccatggcttaaaatgctgcattctcccaaaaatgcacttagcacaactgcacttttttattttattactgcttccagaagaaggatctagaaactttgtgttatacaaattaaacaccatagcactataaatcaattttaatgaaactgaatacaactggacatgttaactaaatgaaaatatactagtcacatatctaaagaggagcaacatttaaaaaaaatacatgcagccgggcgcggtggctcatgcctgtaatcccagcactttgggaggcagcggcgggcagatcacttgaggtcaggagttcgagaccagcctggccaacatggtgaaaccctgtctctactaaaaatacaaaaattagctgggcgtggtggcccatgactgtagtcccagctacttgggaggctgacgcaggagaatggcttgaacccaggaggtggaggttgcagtgagccaagatcgtgccattgcactccagcctgggtgacagagcaagactccatctcgaaaaaaataaaaataaaaacaatatatkaatcagtttcaggattatttgtgaaaagtgaaacactgtatacaatattttgaatatgcaaacatttttctagaaagaaggttcaaaacattttactatattctcaatggtatccattattccaacatagtttaaaactctcaggtttgaattaacattgctaaagacctgaaaatcaaaataaatcayagttgaatatgtcagcactgaaaaaatattaaattttaaaaatagaatacacattttcacgctctttaaaaataattatactaaacaaagaagggaaatttggcaagttaaagccatgttcagacataatgaaaattatttaatgaaaagagtctccaaagaatttccttaacaaaataagtacatttacttctgaaagctttaagccttagaggaacccaagcctgggatctcaagtttaagttgctgctatcaaagttgccagtgaggtaatcagctaaaatctttctatttctagtaatcagccaagattcatctcctattttactctagggatctcaaaagggcttttaaattataataagaataggtaaaattgagaaaggtccgaaacacaaaagggaagcagaaacaggctaagtaattattttcaacacagttcattatgcagtgttcaaagaaatgcatgctttcctgaattaaaatgttcttaatacatttaatattaggcataatgttgactcaaagtctctttggctctacacacattacctaacacttttatatcctactacgagttaataactgttcttagaactaactttttttttttttcctttttactttgagacggagtctcgctctgtcacccaggctggagtgcaatggygcagtctcggctcactgcaatctccgcctcctgggttcaagccattctcctgcctcagcctcccaagtagctgggattacaggcgcatgccactacgtcccgctaagtttcgtactttcagtagagacagtgtttygccatgttggccaggctggtctcgaactcctgacctcaagggatctgcctcagcctcccaaagtgctgggattacaggcgtgagccaccgtgcccagccagctctaacttgtattaactcatttaattcacatatactatggtaaaatgatttttttttctgagatgaactccttggactgacagtaagcactataggtttactttagggtttgagtcagaagttacttccataagaaaagtcttttaagtcctgattcctggcatcatgctattgtggctatagtcaacccagaattacattccttccagaatgaattgaagaatctcattaagttcaaaattcacttaaatactgacggaccctgcaacttccttgatccgcccagcagaaactgagcttatatctccattctactcactacaacagaaaagctggaactggcctaraagtaaaatcagaatagagagatacttgtaggctacttatytggagacatgaaggtcttcagccagaccttacagagaattacttcacttactcaggtaacgtttatggagccatttcactgtgctgtgtactggaaatawaatagaaaataaaaaaatacaccaggggacaaaaaataacaaatgcctgctctcatggaatttccagtttggggagaagactgacattaatcaaaggaatgcaattatgactacatggctataaactgagataattctctgaagaaagaagcacagtttacttaatgttgattaaaataaaggggtggcatggagtactctgggatgtcagagacttccctgagtgacagatgcctgacctaggacttaaagaataattagtcattaattaggcaaagactgggggatagggggagtaggtaagaagcattccaaaatcaaaataagcccaatgtgtctggagggcaaagatacaggaagagaggggaggtttaagamaagagggtgggcagggcttgctaacatatttaggctcatagacctcaatataacagcaatggaaaaatcactgaggtggctttaagtggtgtagaagagaccaggcagggagggggaaaaattctcattctaaaaagatcattctggcttcactatggagaacacagatgggagaatggtcaggatagacctgtgagaaaattagtgagttatatagtagtgaaatagggaggtgggagaatgatagagagaagcaggtagatttgagacctatacaggagataaaattgatggtacctgataagttattgaggataaaattagatatgggggaattgggaaaaataaagtattcagaacttctaagtttctggctttggcaactagttagattgtggtaccaacttgttcaaaaacggaaggctggaagaggatctggtttgaaatgaaagcatgttccatctcagatatgttgatgattatttcactggctgaattattttgtacaatgagagaaaaggttcccgtgggaccagaagacctaggatcaagttctgggttcagacattataaacaggactctgattttaacaagtcacaatttgtaggcatcggttttctgaggcttatttcattgacttggactacatcacctgcagttctttcctaagctttggagactaagagcttgcacaagtcattggataatcatccttttgatctgattaaagaaactacatgtaaataagctcacattaaatattgtgagctattaaatattgttaaaatatgaatgcttaaatttgccctcctattacagcaggctctccaaatccacagttctgcatctgaagatatgaccaactgtggattgaaaatatttgaagaaaaaaaaacaatttaaaaagccaatacaacaacaaaaaatacagtacaacaaataaaaaatacagtacatgctatttacatggcatttacattgtattagctattgtaagtaatctagaaatcatttttgttgttaaaacttatactttattttcttgaatgtttatattatgctttttgtcactatccatactgtttttaagcctgagccactgtgtggtttcagcctcaatataataatcatcccctcacttttagaattccttttcccttatcactttgctttgtaaggtttctataaaacaaagaccttggaaaatcaacatttcctgtgaactcaagagattatgtaagcagtgcccaaatcagcaggattaggcaggtaaaagcagttggatggcagatacactatgatctctttgaccacaatgtagttgtatgcatgtctaaaaggtcatactgattcaccattagaataaagatcacatgtaggttgaccagggaggactatccacagaattgtgtgaactgtggtaggggaggcagtatacaacattcatggatgaaacacctagctaactgctttcctaaaaattatctattgtctaaaagacaaacatctaggctttttagtgttttttttttttcctttaacttatgaagattcaagtcactaatatgttagttcttctggtttaaaatgaaagtaactggctatggtaatgtagagaagacagatgactgcatcaatatttaagacttaaattttgagttacctcaccttataaaaatatatatcaatataytaaatactcaacaaagatccaggatgtacagtatttaaaaatacatttctcttggatcagcaccaaaaataatcagtttctgttcaacttgtgtcaagttttttttttgtcggttttttgaggctgagtctcactttgtggcccaggctggagtgcagtggtgcgatctcggcttactgcaacctctgccttccaggttcaagcgattctcatgcctcagcctcccaagtagctgggattacagacatgtgccacgatactcagctttttatttttatttttacttttattttgtatttttagtagagacagggtttcaccatgttggccaggctggtctcgaactcctgacctcaagtgatctgcctgcctcggcctcccaaagtcatgtcaagtttttaggtctaggcaagttaaaattatctctgataaaaatcacgagctccacaaaaataattaaagatatatccaaacatctttcaaatacattctgatatcaggtcaggcatttcactttaaagaacataatagtaactaccttaccactgaatttttgtagtaagacgttttaaatcaactttgtcttatgggaatattttatatcttgcacgaaggagccactggtacttagacacctaaaattactagaaccattaagactgaggtgaagaatttgtatagccttccaccattacaaagaaggagtgatagatacttgtcctcctggcaatatcaaatgccgtttctttgaagttgtttttcagccctggtttgatgtaatggttcatcaggaggagttctaggttatctttgctgtctcctttcccagcagcaagatgcaaaggggtcaagaggctttggtttgattaactgggtgtggcggcgtgtgcctgtagtcccagctacttgggaggctgaggcaggaagatagcttgaacctgggaggtggaggttgcagtgagcgcagattgcaccactgcacccaagcctgggygacagagcaagactctgtctcaaaaaaaaaaaaaaaaaaaaaaaaaggcttttgtttgggcattgatatctgcatcacactgaggtaagaaagaagccactctggtaccacttgcaagtactgtgcaggggtgtccagccatccgccatcactgcatgaacatctgcctcttgtgctatcagctcagggacctaagtgtccactgcaggctacttaatgaacactagggataaagatatactcatggcttccagtctgacccagcacagtcccagtggtggtagccacaggggtgactctgtcaccccaccccacctccaggtgaattagcacagagaaagagagagagagagacacacacacacacacacatatatacacatacacacacacacacactctgactcagtttgtctgggagaaagtaagcgaagagaaccagagtctctgcctggtaatccagagaattcatccaggtcttatccgaaactaccaaggtggtaactctacaaatccgcaagaaccacaggttactgggcttgggrtgccccctaaggcagacacggcttagatctcaatacccaagttcaaatacctggaaagccttcctaagaagagtgggtaaaaaaaaagtctagactgcaaagactacagtaaatacctgactcttcaatgcccagacaccaacaaacatccgcaagtatcaagaccatccaggaaaacatgacctcaccaaatgaactaaacaaggtagcaaggaccaatcttggagaaacagagatatgtgactgatatggtttgaatctgtatccccaccaaatatcatgtcaaattataatctccaatgttggaggtggggcctggtgggaggcgactggatcatgagggtggtccttgaygaatggtttagagccatcccctcggtactgttcctccygatagtgagttatcgcaagatctggttgtttagaagtgtgtagcagctctccgcccctcttcctcctgcttctaatcatgtgagacgtcttgctcccactttgacttccaccatgattctaagtttcctgaggcacccccagaagtcgagcagatgtcagaatcacgttacctgtacagcctgtggaaacataggccaattaaacctcttttatttataaatttcccagtctcagatatttatagcaatgcgagaatggactaatacagtgacctttcagacagagaattcaaatagctgttttgagaaaactcaacaaaattcaagataacanggagaaggagttcagaattctatcagaaaaatttaacaaagagatttaaataattaaaaaagaactacgcagaaattctggagttgaaatatgcaactgacatattgaagaatgcatcagagttttttaatagcagaaggatcaagcagaagaaagatttagtgagcctgaagacagactatttgaaaatacagtcagaggagacacaagaaaaaagagtaagaatgaagtacacctacaagatctagaaaatagcctcaaaagggcaaacctaagagttactggtcttcaggaggaggcagaaaaagagataggaatagaagatgtatttaaaaaaaaaagtttattcaaagaaataatagcagaaacctaggaaaggttatcaatatccaaatataagaagattacagaacaccaagcagatttaacccaaagaaagctatctcaagccatttcataatcaaattcccaaaggtcaaggataaagaaagaatcctaaaagcagcaacagaaaagaaacaatatacaactgaactccaatacatttggcagcagattttcagtggaatccttacaggccagaagagagttgcataacatatttaaagtgctgaaggaaaaaaacttttaccccagaataatttatctggctaaaatatacttcaaacatagagaaataaagactttcccagacaaacaaacactgagggatttcatcaacaccagatctagcctagaagaaatgctaacaggtgtacttcaatcagaaagaaaaggacactaatgagcattaagaaattatctcaaggtacaaaactcactggtaacagtaattatatagagaaacacagaataacactgtaactgtggtgtgtaaattactcttattttaagtagactaaaagataaatcaaaaataactacaacaacttttcaagacacagacagtacaataagatataaataaaamcaacaaaaagttagaaagcagggggatgaagttaaggtgtagagtttttattagttttctttttgcttgtgtgtttatgmaaacagtgttaggctatcagtgtaaaataataggttataagatagtatttgcaagcatcatggtaacctctaatcaaaaaacatacaacagatacgctgaaaataaaaaataagaaattaaaatcataccaccagagaagattaccttcactaaaaggaagacagggaggaaggatggaagacaagacccataaaacaaccagaaaataagtaacaaaatggaaggaataagcccttgctcatcaataacaacactgaatgtaaatggactacattctccaataaaaagacagagtggctgaagggattaaaaaaacaaaaaacaaaaaaacaagactcagtgatctgttgccyacaagaagcacatttcacctacaaagacacacatagactgaaaataaaaggatggaaaaacacattccatgacaatggaaatcaaaaaagactaggagtagctatacgtatatcagacgaaatagatttcaagacaaaaactataagaagagacaaagaaggtcactatataatgataaagggggcaattcagcaagaagatgtaacaattgtaattgtatatggacccaacactggatccatataccagtgttggagcacccagatacataaagcaaatattgttacagctaaaaagagagacagaycccaatataataatagctggtaacttcaacatcccattttcagcgttggacagatcttccagagagaaaatcaatgaacatcagacttaatctgtaccaaatggamctaatcagaccaaatggacctaatagatacatacataacatttcatcccaaagctgcagagtacacattctttttcctcagcacatggatcattctcaaggatggaccatatgttatgtcacaaaacaagtcttaaaacatttwaaaaaactgaaataatataaagcatcttctctgaccacaatagaataaaactagagatcaataataagtggaattattgaaaattttcttgaaataaatgataaaggaaacacaacatacgaaaagctatgggatacaacaaaagcagtactgagaggcaagtttatagctataagtgcctacatcaaaaaagaaaaaaacctcaaayaaacaactatttaatgatgtatattaaagaactagaaaagcaagagcaaaccaaaccccaaattagtagaagaaataataaaaatcaggccaggcgcagtggctcacgcctgtaatcccagtactttgggaggctgagacaggtggatcacttgatgtcaggagttcaagacaagcctggacaacttggtgaaaccccatctctactaaaaatacaaaaaaattagccgggcatggtggtgtgcacctgtaatctcagttactcgggaggctgaggcaggaggatagcttgaacctgggaggtggaggttgtagtgagccgagattgtgccactgcactccagggtgggcaacagagtgagatttcatctcaaaatacaaaacaaaacaaaaaataaagatcagagcagaaataagtgaaactgaaacaaaaaaaatacaaaacttcaatgaaacaaaaggtttttttttttttgaaaaaaaaaattgacaaactgctagacagactaagaaaaagagaagacacaactaagtaaaaccagagataaagaaggamacattcaactgataccacagaaattcaaaggatcattagtggctgctatgatcaactatatgccaataaatgagaaaatctagagaaaatggataaattcctagatactacaacctaccatgattgaaccatgaagaaatccaaaacctgaacaaaccaataacaagcaacaacatcaaagccataataaaaaatctcccagtaaagaaaagcctgggacctgatggcttcactacagaagtctaccaaacatttaaagaacgaataccaatcctactcaaactattctgaaaactagaggaggagggaataattccaaactcactctatgaggcctgtataccaaaatcaaagacatattacatattaaaagaaaaaaaattacagaccaatatcactgatgaaaattgatgcaaaaatcctcaacaaaatactagcaaaccaaattcaacaacacattaaaaagatcattcatcatgactaaataggatttatcccagggaygcaaggatrgttcaacatrtgcaaatcaatcaatctgatatatcatcatatcaacaaaatgaagaacaaaaaccatatgatcatttcaatggatgcttaaaaagcacttgataacattcaacatcccttcataataaaaaccttaaaaaaacttggtatagaagaaacatatcttaatataattacaccatatatgacagactctcagctagtatcatacygatgaggaaaaaaaaaaacctttcctctgagatctggaatacaacaaggatatccactttcaccactgttattcaacacggtactagaagtcctagctagagcaatcagacaagagaaagatataaagggtatccaaattggaaaggaaggagtcaagttatccttgtttgcagatgatatgatctcgtatttggaaaaacctaaagactccaccaaaaaactattagaactcatacaaaatcagtaaagctgcaggatacaaaatcaacctacaaaaatctagcatttctataggccaatagcaaacaatctaaaaaagaaatcaakaaagtaatcccatttacaataactacaaataaaattaaatacctaggaactaaccaaataagtgaaaagtccctacaatgaaaactaaaacactggagcaagaaattgaaaaggacacaaaaaactggaaagacattccatattcatgggttggaaractcaatattgttaaaatgcccattctccccaaagcaatctacagatttcatgcaatccctataaaaataccaataatgttcttcacaaaagtagaaaaaacaattctaggccaggcgtgatgcctcatgcctgcaatcccagtgctttgggaggccaaggtgggcagatcacttgaggccaagagttccagaccagcctggccaacatggtaagacatcgtctctactaaaaatacaaaaattagccaggtgaggtggcgactacctgtaatcctagctactcaggaggctgaggcacaagaatcgcttgaacctgggaggcagagrttgtagtgagccaagactgtgccactgcactccagcctgggcgacacagtcagactctgtcccgccccccaacccccccaccaaaaaaaaaagaaaagaagagaaaaaaacaaacctaaaatttacatggaaccacaaaagacccagaatagccaaagctatcctgaggaaaaaaacaaaacgaggaattttattacctgacttcaaattatactacagttagagtaaccaaaacaggatgatactggcataaaaacagacacattagaccagtgaaacagtctaataargaatgcagaaataaatccacacatttacagtgaactcactttagacaaaggtgccgagaacatacaatggagaaaggacagtctcttcagtcaatggtgctgggaaaactggatatctttacgcagaagaatgaaggttgaccccgtatctcttaccatataaaaaaaaaaatcaaatgaaaatgggttaaaaacttaaatttaagacctcaaactatgaaactactaaaagaaaacattggggaacctctccagaacactggagtgggcaaggatttcttgagtaataccccacaagcacaggcaaccaaagcaaaaatggacaaatgggatcacatcaagttaaaaaccttctgcacagcaaaggaaactatcaacaagagacaacccaaagaatgggagaaaatattttgaaactacccatctggcaagggattaatatccaaaatacataaggaagctcatgcaactctacaggaaaaaaaatctaatcatccaatcaaaaatgggcaaaatatctgaatagacatttctcaaaagacatacaaatggcaaacaggtatacgaaaagctgctcaacatcactatcagaggaatgcaaatcaaaactacaatgagatataatctcatcccagttaaaatggcttttatacaaagacaggcaataataaatgctggcaaggatgtggagaaaggggaacccttgtagacagctggtgggaatgtaaattagtacaaccactatggagaacagtttggaggttcctcaaaaaactaaaaatagagctaccatatgatccagtgatcccactcctaggtatatacccaaaataaaggaaatcagtatatcgaagcgatatctgcacttccacgtttattacagcactattcacaatagctaagatttggaagcaacctaagtgtccatcaacagatgaatggataaagaaaatgtggtacttatacataatggagcactattcagccataaaaagaatgagatcctgttgtctgcaacaccgtggattgaactggaagtcattatgttaagtgaaataagccagacacagaaagacaaacttcacatgttttcacttatttgtgggagctaaaaattaaaacaactggtcaggcacattggctcacgcctgtaatcccagcactttgggaggccaaaacgggcagatcacaaggtcaggagttcaagaccagtctggccaatacggtgaaaccctgtctctactaaaaatacaaaaaaattagctgggcgtggtggtgggcacttgtagtcccagctactcaggaggctgaggcaggagaatcacttgaacctgggaggtggaggttgcagtgagccgagatcgcaccactgcactccagcctgggcaacagagcgagactccgtctcaaaaaaaaaaaaaaaaaattaaaacaattgaactcatgaacatagaaagtagaaggatagttaccagaggctgagaagggtagaaggtaggatgggggaaagtgggaatggttaatgggcacaaaaaaacagaatgaataagacctagtatttgctagcacaacagggtgactataggaaaaaaataatgtaattgtacattttaaaataattaagagtataactggattgtttgtaacacaaatgataaatgcttgaggggatggatacctcatcttccatgatgggattattatgcattgaatgcatgtataaaaatatctcatgtaacccataaatatatacatctgctatgtatccacaaaaattaaaattttttaaaaatgggtagggcacggtggctcatgcctgtaatcccaacactttgggaggccaaaacgggtggattctttgagcccaggagtttgagaccagcatgagcaacatagcaaaaccccatctctatgaaaaaatataaaaattacctcagtgtggtggcatgcaactgcagtcccagcaactcaggaagctgaggtggagggtggcttgagcctgggaggtggaagttgcagggagccaagactgtgccaccattactccagcctgggcgacagagccagaccctgtctcaaataagtaaatggtactgaaaaaaatgttgtagtgagacaaaaaaggtttttttggtagacaacacttaaatctctacaaaaaatacaaaaactagccaggcatggtagcccatgcctgtagtcccaactacctgggaggctcagtaggctaaggcaggaggatcccttgactccaggaggttgaggctacagtgagcgttgaccgggccactgcactccagctttggtgacaaagtgagactttgtctcaaaaaacaagagagatttcataccaaatggttcataaagatgcaaaactgctacgtagagtttccatatgttttgtaacagaaaatgttaggagtaagatgatgtgtgtggtatcactccttacactccaagtcattagcttgcttctttgacagtacctgctactaagatctgactttttataaaagtaatttatgctccttgcttgtcagcatagataccttttcaaagtttttataaggtaagtgacttataaaattttatctggaaaaaaacccactaggctgttacggaagtttaagatcaaacatactgtgctaccattttgaaaaaaggtgagaaattagaaaaaggttagtcctattagaaattctcttataacgttatgacaatcatcaaaagtatagcagcatayaaacaagttgctaggaaaaaaagagaaagcccacagacactagtatatgtaattacttagcaygtaataaaaggaaaattagaaaacagaaagggaatgtttattcaataaacacagactggaacatgtggctggtttttgaaaaataatctactcagatccttaccctacagcaaaataaattccaagtatatcacatctctatctactctctatccataagatacaaacaacatataaaaagtgatttaaatttactaaatatggccggcacaatggctcacgcctgtaattccagcactttgggaggccagccagatcacttgaggtcaggagtttgagaccagcctggccaacatggtgaaaacctgtctctactaaaaatacaaaaactagtcaggcatggtggcacaagcctgtattcccagctattcaggaggctgaggcacaagaatcgcttgaacctgagaggcagaagttgcagtgagctgagattgtaccactgcactccagcctgggcaacagagtgagactccatctcaaaattaatgaatgaattaattaaatatgtaataagtaactttaatacacattaaaatacattttaaaagttaattcataaaaaatattttagaagatattatcaatgtcacatttttaattttaatttttatttttgagacagggtttcactctgtcacccatgctgcagtgcagtggcacaagcacagctcactgtagcctcaacctccagggctcaagcaatcctcctgcctcagccttccaagcagatggaattgctggcatgtgcctccacatccagctaatttttattattttatttgtagagacggggtctccctgtattgcccaggctggtctcgaggtcctgggctcaagtgatcctcccacctcagtctcccaaagtgttgggattagaagtgtgaaccaccatgcccagccaataactatcaaatctatgaatatgaatagagtgaaactgaaattacaatgaaataaaaaggaaaatattaattcaactacaaaaaaaatttaaatctcctgtgcatcaaaaggaacaccaccaaaagtggaaaggcaagaataaactaatgaaaatatctacagcttgagacaatcagacattatgccctcctgataggatgcactatgaactatataaaaccactaataaaatatttattctttcccccaaagaatgttgaacctgaatctaattaagactttagaggaaagttcttaagaaatccaggagatagagcaacaagttaaccaccaagaaatagacaataaacaaagaatccaaaatatgggacattctacagggaaaataacctagtttcttgaaaaaatcaaaagcataaaaacaaagggaaggggaatcagtttttagacaatcgcccccaccacagacacacagaagcttctcagtccattcataataaactaaaaagtccttatcagagccagagcctacatccttgggattttatcctgtgaaaaagaatccaaaaaaactaaaaaattcacgtacaaaaagatgatgttagcagcatgttttttcatttcctttcctatttatctatttttatttctttttccaacttttattttagatacagggggtacaggtgcaggtttgctatttgggtatattgtataatgctgaggtttggggtacaaatgttcccacgtcacccaagtattgaatataatacccgtttttcaaccattcccctccttcctttctcctccatctaatagtccccagtttctgttgttgccatctttatgtctatgagtacccaatgtttagcttccacttacaaatgtgaacatgtggtatttgacagcatggttttaacagtgaaaaattataaatgacaaaagaatgttaagcaaattaaggcatacccaraatgtaatattatacagcctctaaaatgtatgtagtaatgaaaaggatatataataatgaaaagtacatatttcaaatgtttagtgaaaaatcaggataaaaggatatatgggccaggcgcggtggctcacacctgtaatcccagcactttgggaggctaagccaggtggatggcttgagcccaagagtttgacaccagcctgggcaacacagtgaaacccatgtctacaaaacaaaataaaacaaacattagccaggtatggtagtacatgcctgtagttccagctactcaagaggctgaggtgggaggatcactcgaggtagaggttgcagtgagtcaggatcacaacactgcactccagtatgggtgagagagtaagacactgtctccaaaaaaaaaaaaaaaaaaaaaaaaaaaaaaaagtgggggaatatgtaaggtaacaagaaaatctacacaaaagctttaaaaatggaaaggaaatacagtgaaatattaacactgtatggctagtgtttgtactttcaagttattttttctttgctttctagttttaataaccaggcattttctgtgattttaaaaattctttctcaaattagaaactatatatatatgctatatatatgacccatataataacaaatctaggtaagttggctttatgttacagcatatttgtttttcccatttcaaaatgttatttattaagcacggtgtcgttctataaccattttctgaacatttccccaaatctttaccaaaacaaagctctcttaaattctttctccattatatttctttycaactcctccctgagtaatacatatttagtgggaataaagtttttattttggccaggtgcggtggctcacacctgtaatcccagcactctggaaggctaaggtgagtggatcacttgaggtcaggagttcgagaccagcctgaccaacatggtgaaaccacatctctactaaaaatacaaaaattagccaggcatggtggtacgcgcctgtaatcccagctcctcaggaggctgaggcaggagaatcgcttgaaccaggaggcagatgttgtagtgagccgagatcacgccactgcactccagcctgggagacagagcgagactccatctcaaamaatttttatttccaagagtataaaattattctgcatttaaaagcaacattataaccccacatctaaaagacccagggaggagtgaaaaacatttgttggaagtgtactttctgtatactaagtttccttgttctataaaaatatggtaatatttgtttgatacattcgacaaccgcaaccaaaatttattttgagtttacagtccgcaacatgaatttctaaaaatatcatactaacattcaagtttaattggcacagacatatctgctatgtttaacagaaacaaagagtcacacatggggaatgacagttctgagtttttctctctttccagcaaatatgcttcattagccattacgcttttttcctctagagtttctctgaggtcactgccatgttgcttcctatcagacaagttaacactgaggaacctgtgcctgtgtgcaatctcagcagatttgcacttattgttgtgttacttttcttttttttacatacacattgttaaacatatatctaaggccagagaaaaagggaaaagtataatgaactcccatgtactcactacccagcttcaataattatcaatagtttactattcttgttttatctactcccctcccaactttttaagacagggagcaggcattgaagtattttaaaagaaatcttagacatgattagatgaaaatttccggctagcaaactaaaaagttttttgttttgtttttgagacagagtctcggtcacccaggctggagtgcagtggcacaatcttggctcactgcaacctctgcctcctgggttcaagcgattctcctgcctcagcctcctgagtagctggaactacagacacatgccaccaagctggctaatttttgtatttttagtagagatggggtttcatcatattggtcaggctggtcttgaaattctgacctcgtgatccactcgccccacctcccaaaatgctgggattacaggcgtaaaccactgcacccggcctcaaactaaaaagtttgttttgttttttgagacggagttttgctctggttgcccaggctggagtgcaatggtgcgatcttggttcactgcaacctctaccaccgggttcaagcaattctcctgcctcagcctcccaagtagctgggattacaggcacctgccaccaagcctggttacttttttgtatttttagtagaggcagggtttcaccatgttggccaggctggtctcaaactcctgacctcaggtgatccaccaacctcggcttcccaaagtgctgggactgaaggtgtgagccaccgcacccagcctctaaaaagttttaaaggcatttgtcttctttcgcttaaaacgtaagatattaaaaatattaaaatattaaacttaacatctaatatagttcacattagaatccagccaggcacagtgggacacatttgtaatcccagtgctttgggaggccgaggcaggaggatcacttgagcgcagaagttcaagaccagcctgggcaacaaagtgaaaccccacctctacaaaaaaagttttaaaaattagccagacatggtggcatatacctatagccccagctattcggaaagctgaggtataggatcacctgagcccaggaggtcaaggctgcmgtgagctgtgatcgctctactgcacagcagcttaggcaacatctgtctcaaaaaacaaaaaaaaaagaagaagaaaaaaaaaagaatttaagcgactctctcaccagaagcagaacccacagtatctaagaccaggttcttttcctggcaagacatactgccactttaaaaacttgactacatcacaagacctcttggactcctgaacctagttcaataaacaaataaatgtttagatcatactcgttttgtcaaacaacaataaataaataaatttcctgtataattttcaactcatgagaacctgacattttctcaaatgttgtgttatacaccagagcagaatctgtaaattaatcaaacctcttcctcctttgggtaaaaggacagacctttcaacaagtgtgctttcaaggagaccaatttaattaattaatggctatgtatttttctaaggtcagaactacagtccccatatgcagagaatatattattgggtacagctgaaaactggttccttttggcataacatcaataaacagagtactactgaaagccaagggttttttttcctttagagactgggtcttgctttgtcaacccaggctggggtgcagtggtacgatcatagctcacagcagccttgaacccctgagctcaagtgatcctcctgccttagcctcctgggtagctcggggtacaggcacctgccactatayctggctaattctttaaaaatttttttagagacacgaagtctcgctttgttgtacacgctgtttctgaaytcctgrcytcaggtgatccttccgagtggacctcccraagtgctgggattacaggcatgagccaccatgcctggccaagttcatttttaaattctgactttagtaagaaagtttagaaatgagagataaaatgtagcatctgcccctatcagcaatgataaccaagtcttcttgttatcgtaaaacggcactgactttttccttaattctaagaaaaggaatcctgattttttaaaaaatgtgcataaaacttaaggttacaatttttaaaattattctgaaacaaatattattattttaattacgctatctatatggctctaattttctattctttagaaaattattactttcttgggtcctatgggtttccataaaaggccattctttttttttaatgtgactattttttttaatttttatttttattttaagttccagggtacaggtgcaggatatgcaggtttgttacacaggtaaatgtgtgccatggtggtttgctgcacctatcaacccatcacctaggtattaagcccagtatgcactaaatatatttttcctaatgctctcttcccccatcccaacctccaacagaccccagtgtgtgttgttcccctccctgtgtccatgtgttctcactattcacctcccatttgtaagtgagaatatgcagtgtttggttttctgctcctgtgttagtttgctgaggataatggctcccaggtcccagtctatcattgatgggcatttgggttgattccacgtctttgctactgcagatagtgcttcartgaacatacgcatgcatgcatctttgtaacaggatgatttatattcctttgggtatatacccagtaatgggattgttgggtcaaatggtatttctggttctagatctctgaggaatcataaaaggccattctttttttcttttttttttaaattttattattattatactttaagttttagggtacatgtgcacaatgtgcaagtttcttacatatgtatacatgtgccatgctggtgtgctgcacccattaactcatcatttagcattaggtatatctcctaatgctatccctcccccctccccccaccccacaacagtccccagtgtgtgatgttccccttcctgtgtccatgtgttctcaytgttcaattcccacctatgagtgagaacatgtggtgtttggtttttggtccttgcaatagtttgctgagaatgatggtttccagtttcatccatgtccctacaaaggacatgaactcatcattttttatggctgcatagtattccatggtgtatatgtgccacattttcttaatacagtctatcgttcttggacatttaggttggttccaagtctttgctattgtgaatagtgccactataaacatacgtgtgcatgtgtctttatagcagcatgatttataatcctttgggtatayasccagtaatgggatgkctgggtcaaatggtatttctagttctagatccctgaggaattgccacactgacttccacaatggttgaactagtttacagtcccaagaacagtgtaaaagtgttcctatttctccacatcctctccagcacctgttgtttcctgactttttaatgatygccattccaactggtgtgagatggtatctcattgyggttttgatttgcatttctctgatggccagtgatgatgagcattttttcatgtgtttttttggctgcataaatgtcttcttttgagaagtgtctgttcatatccttcgcccacttgttgatggggttgtttttttcttgtaaatttgtttgagttcattgtagattctggatattagccctttgtcagatgagtaggttgcaaaaattttctcccattttgtaggttgcctgttcactctgatggtagtttcttttgctgtacagaagctctttagtttcattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtaaaaggtgtaaggaagggatccagtttcagctttccacatatggctagccagttttcccagcaccatttattaaatagggaatcctttccccattgcttgtttttctcaggtttgtcaaagatcagatagttgtagatatgcggcattatttctgagggctctgctctgttccattgatctatatctctgttttggtacccgtaccatgctgctttggttactgtagccttgtagtatagtttgaagtcaggtagcgtgatgcctccagctttgttcttttggcttaggattgactcggcgatgcaggctctttttctggttccatataaactttaaagtagttttttccaattctgtgaagaaagtcattggttgcttgatggggatggcattgaatctataaattaccttgggcagtatggccattttcacgatattgattcttcctacccatgagcatggaatgttcttccatttgtttgtatcttcttttatttcattgagcagtggtttgtagttctccttgaagaggcccttcacatcccttgtaagttggattcctaggtattttattctctttgaagcaattgtgaatgggagttcactcatgatttggctttctgtttgtctgttattggtgtaaaagaatgcttgtgatttttgcacatcgattttgtatcctgagactttgctgaagttgcttatcagcttaaggagattttgggctgagaygatggggttttctagatagacaatcatgttgtctgcaaacagggacaatttgacttcctcttttcctaattgaataccctttatttccttctcctgcctgattgccctggccagaacttccaacactatgttgaataggagtcgtgagagagggcatccctgtcttgtgcctgttttcaaagggaatgcttccagtttttgcccattcagtatgatattggctgtgggttgtcatagatagctcttattattttgagatacgtcccatcaacacctaatttatagagagtttttggcatgaagggctgctgaattttgtcaaaggccttttctgcatctattgagataatcatgtggtttttgtctttggttctgtttatgttggattacatttattgatttgtgtatgttgaaccagccttgcatcccagggatgaagcccacttgatcatagtggataagctttttgacgtgctgctggatttggtttgccagtattttattgaggatttttgcatcgatgttcatcaaggatattggtctaaaattctctttttttggttgtgtctctgccaggctttggtatcaggatgatgctggcctcataaaaagagttagggaggataccctctttttctactgattggaatagtttcagaaggaatggtaccagctcctccttgtacctacctctggtagaatttggctgtgaatccatctggtcctggactttttttggttagtaagctattgattattgcctcaatttcagagcctgttattggtctattcagagattcaacttcttcctggtttagtcttgggaggatgtatgtgtcaaggaatttatccgtttcttctagattttctagtttatttgcgtagaggtgtttatagtatctctgatggtagtttgtatttctgtgggatcggtggtgatatcccctttatcattttttattgcgcctatttgattcttcttttcttctttactagtcttgctagcggtctgtcaattttgttgatcttttcaaaaaaccaggtcctggattcattaattttttgaagggtttttttggtctctatttcctccagttctgctctgatcttagttatttcttgccttctgctagcttttgaatgtgtttgctcttgcttttctagttcttttaattgtgaygttagggtgtcaattttagatctttcctgctttctcttgtggacatttagtgctataaatttccctgtacacactgctttgaatgtgtcccagagattctggtatgttgtgtctttgttctccttggtttcaaggaacatctttatttctgccttcatttcattatttacccagtagtcattcaggagcaggttgttcagtttccatgtagttgagtgtttttgagtgagtctcttaatcctgagtcctagtttgattgcactgtggtctgagagacagtttgttataatttctgttcttttacatttgttgaggagtgctttacttccaactatgtagtcaattttggagtaggtgtggtgtggtgctgcaaagaatgtatattctgttgatttggggtggagagttctgtagatgtctattaggtccacttggtgcagagctgagttcaattcctgggtatccttgttaactttctgtgtcattgatctgtctaatgttgacagtgrggtgttaaagtctcccattattattgtgtgggagtctaagtcactttgtaggtcactaaggacttgctttatgaatctgggtgctcctgtattgggtgcatatatatttaggatagttaactcttcttgttgaattgatccctttaccattatgtaatggccttctttgtctcttttgatctttgttggtttaaagtttgttttatcagagactaggattgcaacccctgcctttttttgttttccatttgcttggtagatcttcctccatccctttattttgagcctatgtatgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagatggttattttgcttgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttacttgtctgtaaagtattttatttctccttcacttatgaagcttagtttggctggatatgatattctgggttgaaaattcttttctttaagaatgttgaatattggcccccactctcttctggcttgtagaatttctgccaagagatcygctgttagtctgatgggcttccctttgtgggtaacccgacctttctctctggctgcccttaacattttttccttcatttcaactttggtgaatctgacaattatgtgtcttggagttgctctctcgaggagtatctttgtcgcgtcctctgtatttcctgaatttgaatgttggcctgccttgctagattggggaagttttcctatatcctgcagagtgttttccaacttggttccattctccccgtcactttcasgtacaccaatcagatgtagatttggtcttttcacatagtcccatatttcttggaggytttgttcacttctttttattctttttgctctaaacttctcttctcgcttcacttcattcatttcgtcttccatcactgataccctttctgccagttgatcacatyggctactgaggcttctgcattcgtcacgtagctctcgtgccttggttttcagctccatcaggtcctttaaggacttctctgcattggttattctagttatccattcatctaattttttttcaaagcttttaacttctttgccattggtttgaacttcctcctgtagctcagagtagtttgatcatctgaagccttcttctctcaactcgtcagtcattctttgtccagctttgttccgttgctggtgaggagctgcgttcctttggaggaggagaggcactctgatttttagagtttccagtttttstgctgtttttttcccatctttgtggttttatctacctttggactttgatgatggtgacgtacagatgggtttttggtgtggatgtcctttctgtttgctagttttccttctwacagacaggaccctcagctgcaggtctgttggagtttgctggaggtccactccagaccctgtttgcctgggtatcagcagcagtggctgcagaacagcggatattggtgaaccrcagatgctgctgcctgatcgttcttctggaagttttgtctcagaggagtacctggccrtgtgaggtgtcagtccacccctactggggggtgcctcccagttaggctactcgggggtcagggacccacttgaggaggcagtctgcccgttctcagatctcaagctgcatgctgggagaaccactactctcttcaaagctgtcagagagggacatttaagtctgyagaggttactgctgtctttttgtctgtgccctgcccccagaggtggcgcctacagatgcaggcaggcctccttgagctgtggtgggctccacccagttcgagcttcctggccgctttgtttacctaatcaaacaactaacttggcaatgacaggtgcccctcccccagcctcactgccaccttgcagtttgatctcggactgctatgctagcaatgagcgagactccctgggagtaggaccctccgagccaggtgcgggatataatctcctggtgtgccattttttaagcccgttggaaaagcacaatattagggtgggagtgagccgattttccaggtgccctctgtcactgctttctttgactaggaaagggaattccctgaccccttgcgcttcccgggtgaggtgatgcctcgccctgcttcggcttgcgygtggtgcgctgcacccactgtcctgcacctactgtctggcactccccagtgagatgaacccggtacctcagttggaaatacagaaatcacccgtcttctgcgttgctcacaatgggagctgtagacyggagctgttcctatttggccatcttggctcctccccccttttttttctttttttaagatgcagtctcactctgtcacccagrctggagtggagcagcatgacctcggctcactgcaacctccgcctcctgggttcaaacagttctgtctcagcctcccaagtagctgggactccaggcacctgccaccatgcccagctaatttttgtatttttagtagagatagggtttcacattgttggtcaggctggtcttgaactcccgacctcagctgattcacttgcctcggcctcccaaagtgctgggattacaggygtgagccaccatgcccagctaaaaggccattcttaattttcaaaagagaactttatgacatctgggaatttcagaggctttgcagaacaatattaagaaaactactgtttgctaggcttgaggtcaggagttcaagaccagcctgggcaacatagcaagaccctatctctattctactttaaataaaaaataaaaatagaaaacaagaaaagaaacctattgtttacagaataaagtgattctaggtctttcagtcaggtctgttttcttaacaaaatacacactgaagtgtaaaaatactgccgaactgtttatattccttcaagaatactagcagatgagtaaattggcaatatgattaaaaaaaagaaatatgcatgcctcttgacccagcagtttccttagaaatgtgacttgaaggaatcattaaaaatgtgtgcaaagattttcccactaggaggttctcctcaatgctgcttaaaataacaaaaaaatcaaaacaacctcagaatctatagtaagagaatctgtaaataaggatatacctgtaaataagggtgtaaagtacatggtattctagataatgtagatataaaatggaattatctccacaatatatcattgggtttaaacaggttaagacagcatccataatgattttactacatatgattagtaagacattaaatacaaatattaaaatcaaacaatatatattaaagttaattatacaggcatagagagtagagagacataatggctactaaatgtattagtagttatctctaaacagttgagktgctgttcatttttactttctttacattttcctgtattgcttaaattttctataaaatgcatatcagaatttaaaaatatagttatattcatattcatttttttcttttttcttttaagacagggtctcgctctgtcacccaggctggagtgcagtggcatgctcatggctccctgcagcctcaacctcctgggctcaactgatcctcctcccacctcagcctcccaagtagctgggattacaggtatgcaccagcacactaggctaatttttgtatttgttgtagaaacagggtttcaccatgtcacccaggctgatctcgaactttgtttttaaaggcaaaaagtaaacgtacaaattcaaggcataaggtgaataggaagtttagcaattgaaaaaaaataacctatctgactactaccctttaggtattttagagagtagggaaaaggagaagagagaaaaagaaagggctgaaasgtgggaacaatatacaacctattaaaaccagagaaactggggagctgtggtggcaaaaaaaaaaaaaaaaaaaaaaagacacagaaatgctcaccactttagccacatcaaaaccaatgcaggcaagaagctgctctgaagtctcccaacccttcagccaggcatggtagtagtcccagctattttggaggctgaggcgagaggactggttaagcccaggagtttgaagctccggtgagctatgatctcaccactgcactaaagcctgggcaaaagagatcccgtctcttagaaaaaaaagtctaaaaaccccaaacaaaagcaatcgcatagactagtcttaggagttcactaccttgataacagcgctagagatactcagacactgagccctttctaaaataatgtagacgtgtatcaaagaccagacagttttattgttcttttcagcaattcctcatagatggtgttcttaatttccttatacatatatgaatcagaacccaccccccaacccccttgttttctttttcctgggcttggagcaagaggcaattgcactggtgactctccacaatgacatgagttctcagttgttccatgaaagattattacagtgcaactacaagaacagcacaataagagaaatggttctcacctctttgatctacagaaacatgtagacctccagggcttaacagaaaaattttcctggaactcctaaactttaggcataagacccaaataacttcattcctagccttttagtttgtacccaggtatcacaaacttatttacaaagtttattctgacctatgcaaataaaattgggcactttattaaaacttctttgaatctattactcatgaataaaacatgaaaaatactcatactgatggataacactttacacaacactgaatcaactcccctttgcttgcctcctcctaaaggactggcttaatttcagtagtagaacccaaacatgaatcaatctcatgactaagcattaactatgcatccatttagcaaatgaaagtttattttagcatttgaaattctgtggttcttcaggaatatagccagataaatgatttttactaacaaatgcaactaacaccatttcatctcctctctaggaatgactgaagactcttgactatcatctattcagcacctggaagcattacctttttgtaatacgaaaagaaaaacagctgaaagaaagaaaatatacttgtcccttcaaatatagatcatataatcaaatacaccttaattcactggtaaatatgtcacttggaacataagttctaaccccagatgaaaaatgaaaagtaaactttctaccatcctcgtactgatagaaaattctcatgggagagtagggaaaaacagtcagtcttcggtctattttagttaaaccttcacattagtggaggaaacgatgaactcatggcaaattaagctaccctccctaagttatttttcctcaacaaatcaaactcaaagacaagcttacaaaactggaaacacagaataaaagaataaaagaggacactgtctcctatgccatattatagtccagaattagttaatctaattcaaagtattggcaaggatgttccatcaactagaccaggtatttatcattcattaccatgtactgcttaagcatgtaaagtagctgaaacacaaatattttggagttatctccagacaaagagtaaaaacacaagaaaaatgttaaaatcctattatgttcaaccgctgatgattttcagaatttacatctttaatttttattaacattaggaawgttttgcctatactgtttagcttaattaaagtgtaatggaaatgtaagaatctgacagcacttattaatatctgtttagcaattatacacttgaagtttaatcatggatttaagaatttcaataaaatagtgaaagaagaaataaaagaaaaaagaaaaacaacagtgaaagaaatagaatcaaggcattaatccaccaagaaaagsgttagctgtgtgttcactctgaccttgagtctattaccacatggaaattttttaggaattttacaacggaaggaaaaaagggaagaaaaaagagatactcttagtgctgctgctgccttccttctttactgttctattctccatatattcaaaaaatacttagtaatttttcccctaaaatgttgtaaatgtgcttactgatccaatcttactgttagaacatccatgaactatccttggccctcttcctcttctctatccacattctctcccttggtgatcttatctaaactcaaggatttaaatattttgcctccataatgtataattccagctcagtcttctctcttaactccagactcatacgtctaactgcctacttgaccagaatatcttacaggtgtctcaaactcagaatgtccaaaaatggattcctgagctgtgccaaccctcctccaacctatgcaacccatactatggtattctccagttaagttgatggtaattccatttttcttcaacttactgaagtttaaaacctttagagtcatctttgattcatcccctttctctcacaccccgccttttgataacaaaatcctattgtttcaatcttccaaatatgtccagaaattgactacatctcactatctccactgctactatgtggcctgagccaccaccatcatcccttacttaaattactgcaggcttcccaacagatcttcctgcttctacccttgaacctccctgcatacacacacacaatttagtcttaatacagcyagctgccaggatgatccttttaaaactaagtcagaggtctctctaccctgttcaaatcaggcaatggctccccccattctcttagagtaaaaaccaaagtcctttcaacaacataaggcccttcatgatggggcctcctgtggcttccccttctattattcattcctcttgttcactcctccagactctttagggttactcgaactcaccaggtgaccgcttgatgtttactttgggatacttttcccaaatatctacttggctaactcccttactttcttaagtctttgttcaaagatcacctctcagtgagggctaccctgaacaccttgtttaatattgcaaccagctcctttactaccaaaaagagagagtaaactatgcttagtgagctcatttcacctagcagagaccgtggaagaaagtactaagatcagagggagtattcttacgagaaaatagaataggagatttgctggaacctttgtcaagatcccagttatgttcagggatttaaaaagagaactccgtatgtaagggatgaagaaaagaggagatcagttaccaaaaaggatctatactcaggatctgtccgagtcacagatacacagctgcaccatactcatgtacgcatctcaagggggcaaagcccgcaatttaaagcacagcaaagcatttccttatccacatatcgcaaaagagaaacagcaagaaaatatatcccagctcaagcatagcatacacaaatacatttcacaataatttcctaagccaagcgtggtggcacacacctataattccagctacttgagaggctgaggaggaaggatcacctgagcccggaagttcaagaacagtctgggcaacatagtgagaccctgtctcaaataataataataacaacaacaacaatttatgctccacatgcctgcaacagttcatctctaggaaaaggggcttacttgagacttgatgcttacgtttaaaatatatatatacatattttgaaacctgattagccaacatctaaccacctcaatttatagtaaagaggactcctaaaactcaaacctgtttagcataacataaagtgacaaatagaaaacattgccwtttccaggaagaacaaaaaatcaataatttattcaaacatacattgagcgcctactatttgtcaggcctgtgacaggagctagtatggcattaagagtgtagtaactacagtcaaaatgaggtataaatatcaaacacatgagcattttttccctttgtaatagattcatcaatcatgctgacaatggctatatattctggaactttctccgtaagtttaagccacatcattcattcaacaaagttgcagtgagcatctattaagtgcaagcactgtagtagatgctgaaggactacaaatataaataaataacaggttacattaattgggtacttcccatataccccagactctgtacattatctcattcatcaacttagccaccattataaattaaatacttccctattttagagatgataaactattatgctaaactgtttccctcaagtagcttcaagtctagaagtcagaaagacatgcttagaaatcatattaatactatctggccagccctacctcattacyacccaaaagtccaataaataaaaatggcaatttatgtacccacaggtaaagagtacacacatttcatactacagaattgctttctaaaggataaatttaaattaaaataaatgggccgggcgcagcagctcatgcctataatcccagcacgttgggaggccgaggcaggcggatcacctgagatcaggagttccaagaccatcctgaccaacatggagaaaccccatctctaatacaaatacaaaattagctgggcgtggtggcgggcacctataattccagctaccaggtagggaggctaaggcaggagaatcagttgaacccgggaggtggaggttgcggtgagccgagatcgcaccattgcgcgccagcctgggcaacaaaggcgaaactctgtctttaaaaaaaaaaatgaaataaaataaaataaaataaaaggcttgtagttgtatacgatctgtgtaatgatagcagttttgtaagaaaaataaaatgaaagcaaataatagataatgaaagcaaccaatgactaatttctagcttcttcctttctaatctaaaaaagctgctctgtaataactttaattacttcagtgacaagacttctaattctgtccaactcatttcttcctmacacatgggaacaaaaccaggtgacttgtacaaaatgaaactatttaagtattcatctataaactgctttcctttttccttttttwttttttttaacaaattctaaatacttacgtagataaggcttcctctgcccctaagcaaactttctgcacaataactgcacctagcttggtgagacagatggagagcctgcaaagtctacaaactttttgtttaaaaggtggcaaatgagttctactgaccatcaaagtcagctaggtttctgggaagcactgaccctggggccatgttttttcaccttgcaaagccaaagcagacaatggagtcaaagctaaaagaagagaagccaaaggaagactggacttaaacatgaaaatccgtatcatacaaatttataacacaaacagcccacctttttcaacaccgccatcacagtgttaatctacaaaaaatggaaagactgatcctactctttctaaaatctaaatctatcactcaactaggtaaaatctcagcattttttaatgaactccaactgctaacctcctttgggggtaaaaacaaaaacaaaaactgaggattccattcctgtgtaaagcagagagttaatgtaagaagatcatactttaattgtaaagacaaagcagcaaagtttcttcctaaaacagaagcaggaacacctaagtgaactcaagttactattcagtgcaaaaagcagtcttacgaactttgagtttgtaagaccaattttcagaaacatttttgaatcctagataaacctactatcaatgatctgaagataatttaatttttaaaaataaaaggattatttactgtctctcttcatctacttcctaaatgatttcaagagatctcttggaaaccaataagaaacatgcaaatgccttttgcaaataaaaaaatttaagtcaacttttaatcatatgctctctaaattwaaaaaaaacttctttaatgaaagtgggccggttgtggtggctcatccttgtaatcccagcactttgggaggctgaggtgagtggatcacttgaagtcaggagttcaagaccagcctggccaatgtggtgaaacaccatctctaccaaaaatataaaaattagctgagcatggtagtgcatgcctgtaatcccagctactagggaggctgaggcaggagaactgcttaagcccagaggggcagaagttgcaatgagccagaatcacaccactgcactccagcctgggcaacagagcaagtctccagctcaaaaaagaaaagaaaatgaatgttactatttaatgactagaatagattcataattcagagataaaatattatatatatacacattaaagcataataaaatgtagtgattagccattatttgtaagtgaatttgagtatccataaactttaccttgagtatctactctttattgattacatcctcagcaacaagaaacaaaacaagagcaacccactgcaacyatagwctggctgccagaaggtaagagtatgtgaggatctagtgcaaacaaggtaggaactgttaagagtccatgaatatttcagaagaataatgaaaaagtgtgccagatgggttcacttgcagctggctaacaacatttctgaccaaagcctaatgcttccttacataatttatcatgcacttttcagttcccttccactaccacccctctcttttcattctattattattattattattattattattattattattattattttgagacagggtctggctctgtcacccagtctggagagcagtggcgagatctctgctcactgcaacctccaactcccaggctcaagtgatcctcccacctcagcctccagagtagctgggactacaggtaggcaccacctccctttgctaatttttgtattttttttagagacagggttttgccatgttgcccaggctggtctcacactcctagcctcaagtgatcctcccacctctgcctccctaagtgctagattacaggtgtgagccaccacaaccagcccatgccatactgcaattctaaagatagcagattgtattatttccttcagcggagatggcatcaaaatcctgcacactactattgctttagtatgctctacttaaaaccactgctgaagattatagatcctaacagatttaatcaatgtggcagtcagcctcaagatgaccctcaatgattcttggttcctggtattcacaaccttgccaattcgactactgcatctattaagggattagctgggcacagtggctcatgcctgtaatcccagcactttcagaggccaaggcaggtggctcacttgagaccagcctgggcaacatggcaaaactctgtctccacaaaaaaataaaaaaaccagctaggtgygccggcacacacctgtagtcccaactacttgggagactaggatagaaagatcgcttgagcccaggaggcagaggttgcagtgagctgagatcatctcacaaaaaaacgaaagaaaagaaaggagtaaatctattgagtccttttacactcacgttgagtcctgttaagcaatttatacatcttgcttatgtggatgcctctggtcgcttacacgtagatagtctactcctaaaacagatgcacaaccaacaaaatctgtaattttcatgcataaaaggcccaaagttagtcttgttttcatttagaatgtgatttaggttaacatataataggtttattaatgttccttttaagtatataaatgccctgctctctatcagatttaaaaggtgggctcttttacacatgagaatgattaagtttctctgagactgttctctatagttaaaggggcctggatttggacccagaagaatctctgttgtggttctaattctgccactagcaatgcaaacttaggtaattcatttaacgtctctaaacatgattgccagctgcaaactagggaccatatttgactggctataaaaactaaaaaatagtggcctggcacagaggttcacacctgtaatcccagcactttgggaggctagggcaggtggattgcttgaacccaggagtttgagaccagcctgggcaacatggtaaagycccatctctagaaaaaaaaatataaaaattagctgggcatggtggcatgcacctgtagtcccaactacttgggagactagggtggaaggatcgcttgaacccagaaggtggagatggcagtgagctgagatcacaccactacagtgaagcctgggtgacagaagtgaaactcttgtctcaaaaaaaattaaaaaatataatttgaagccagtcatggtggtgcacacctgtagttccagcaactcaagagactgaggcaggaggattgcttgagcccaggagttcgaggctatagtgtgctgtaatcacatctgtgaatagctactgcattccggccagggaaacatagtgagaacctctctcttaaaaactgtgtgtgtgtgtgtgtgtgtgtgtgtgtgtgtaattcaagcaatacttttattattgttattaaattaagagattaaaaggcaacatggtaaaacagatatatatatattaaaattaggtgcatattctacgataaaacatgtcataggctgggcccagtagctcatgcctataatcccagcactttgggaggcagaggtgggaggatcacttgaggccaggagttcaagacgagcaagggccacatagcaggaccaggtatctacaataattttttaaaaattttttaaagaaaaaatatctaaaggagagttccaggaataccttaaatttcatcatcaaactgcccaaggtttaaaccaattaattatgatgatgaaaatgtggctaatatttattgtgcaattacatcctgccaggctacatagtaagtactatacaagcattatcaaccaatagcaggcagttcaacatcagattcttctatacagctaattggtaaacatttttctatggtagtaccagatgactggaacattagctgggttcggtggagtgtgcctgttctaccagctacttgggaagctaaggcaggagaactgcttgagcctgggaggcggaggttagaacccagtgcaagcacttgcagacattcaaactggtaagctatacaaattccacaatgttaaagaacacacagtttactatcgcatgtatattcctattgcaacaccttatttcaaaataaaaataattttcttttagagagcctatccytatttgttatttaggttgacaaacccaacatacaataaagttgccaaattcattagctgggtgtggtggcacgtgggtgtagtcccagctatttggaaagctgaggtgggaggatcacctgagcccaggagatggaggctgcagtgagctgtgatagcatcactgcactccagcctgtgtgccagagcaagaccttgtctcaaaaaaaaaaaaagaagttgccaaattcaatttacttgtgtgtcctatctttcctatccatcccccatcttctttactcccaccactactattctaattcagaatgttgccttctaatttgtcttacagaacagcctcctcagaggttgcagtgagccaagatcgtgccactgcactccagcctgggcaacagagcaagactctgtctaaaaaaaaaaaaaaaaaaaaaagcatcctaattggtttccccacttcaaatctcgtcccagtttaattccatgctatatcctccatccagagtgatattcctaaggctacagttttgagcaagccactcctttgttcaaaaccttttagggtggtgcatacctgcagtcccagctacttgggaggctgaggtgggagaactgcttgagcccaggagattaaggctgcagtgagctatgatctcaccactgcactccagcctaggcaaacagagcaagattccacctctttaaaaaacaacaacaacaaaacacctttcagtggctcttttctatttttagggggttgttttgttttgtagagacagggtcttgctttgttgaccaggctagtcatgaactcctgggctcaagccaagccatcctcccacctcggccttccaaagtacgggattacagatgtgagccaccacaactggcctcttttctgtccttcagagggccatctttatagtctagcattcaacaagtagagaatacaggttgagcatccctaatccagaaatatgaaatgctccaaaatctgaaattttttgactgctaatgacaccacaagtggaaaattccatacctgaactaatgtgatgggtacacaaaatcatttaaaatactgtataaaattaccttcaggctacatgaataaggtacatatgaaatataagtgaatttcatgtttagacttaggtcccacccttaagaaatctcattatgtatatgcaaatattccaaaatctgaaaaaacacaaaatcctaaatacttttggtctcaaatattttggataagggatactcaacctgtattgggaatgtttcccagcagccacttccctccctcttctactgtgaactagctatatagttttcatcccaaattagtctcagtaatcagtttaatcccattttacttgccacactgatttgttaaaggacaggccacagcaaacacccatatttttgtttcctgacaggagtgaaggctagaggaggaaagttaaatctcttctaaggaaggtgtgatgtgcgaatacaaactcttaacttctgctgccacttaataactctgagggaagccaccwgaagagaagtcaacagtgcataaaggttgcgcctaaacagctgcagtgaaatgaagctggagccacgttcaaattacaccctgaacacatgcccccaaaaactccttttaaattttgtgaaccagccaaattcctttatctcctctttgacctataaaccacagcattctaactgatagagaactccaaaggctgattcaacctcttttcccaagtcatctcccaccacttcataaaatgttgaagtgggctaatctatattcctctttgtttttgagacaagggtctggtatgttgctcagactggtcttgaactcctgggctcaagcaatcctcccaccttagcctcccaggtagctagggttacaggtacatacatgccaccacacccagcaacatacctttttttttttttttttttttttgagacgagggtcttactgtgtcacccaggctggagtacagtggtgaaatctaggctcaatgaaatctccaccttccaggctcmggtggtcctcccacctcagcctaccgagtagctgggaccacaggcgcatactgccaacacccagctaattttctgtatttttggtagagatggagtttcaccatgctgcgcaggctggtctcgaactcctgagctcaagcaattcacctgcctcccaaagttctgggattacaggtatgagccaccacgcctggcctacatacctcttttatgtgtgtaacatatatatctggctctggaaacaaaaagtaggagcagtgagctgggcataaatagaccttcttttccacaatttgcccccttacattattttgtgactgtgttatattctcctcccaaaaattttaaagagccaatgccagctgggagcgatggctcatgcctataatcccagtgctttgggagccagaggcaggcagatcacttgaggccaggagttcaagaccagcctggccaatgtggtgaaccctgtctctattaaaaacacacaaaaaaattagccgagtatggtggtacatgcctgtgattccagctactcaagaagctgaggcagtaggatagcttgagcccaggaggcagaggttgcagtgagccatgattgtgtcactgcattccarcctgggcaacagagtgagactctgtctcaaaaaataacagttaagagccactgccagtcacagtacacagtacttaggaacaactaaaattcatctcaattcaactcattctaaaaaattaccaaaaaatggcctggtgcggtggctcatgcctgtaatcccaacactttgggaggctgaggcaggcagatcaaaaggtcaggagatcgagaccatcctggctaacacgatgaaaccccatctctactaaaaatacaaaaaattagctgggcatggtggcgggtgcctgtaatcccagctactcaggaggctgaggcaggagaatcactggaacccgggaggtggaggttgcagtgagccaagatcgccaacactgcactccagcctgggtgacacagcaatactccatctcaaaaacaaacaaacaaaaaaaccaagagaaaaaaattataagcaatatatctccagataagaactaatcaaaattctctctctttttttttttttttaagagacggagtctcactctgttgcccaggctggagtgcagtggcacgactttggctcactacaagctccgcctcctgggttcacccaccattctcctgcctcagcctcccgagtggctgagactacaggcgcccgccaccacacccggctaatttttgtatttttagtagagacagggttttaccatgttagccaggatggtctcgatctcctgacctcgtgatccacccgcctcggcctcccaaagtgctgggattacaggcgtgagccactgcacccagccaaaattctctttaaaaaaaaaaaaaaagttttctttttttaggagtttggtttcatttactcaaaaagattttagtaattttttttggcactgtcattattaacaaaaatcatattcattttcagtaaattgataggtttaaagaaaatgagaaatgcacatctgtccttgcagaagttttcccaattactgtgtaactgtcccttcttaggttataccttcttaggttatctcaaggtctttggttggttgattggtctaaacatttgaaaytcacaggtaggttttggcaggaaactcatttacagaaagggtgagaaatgttacctcccttacagcaacacaaactggraattttaaaagcaacaaaagccaaaacataataagacaatcaaaagattgtccctgttatcattctgctgcatgaaaagggaaactgcaagcattctccgcattctcggctgcaagtrccagcactgatcatgaaatgtttacatagcccttactatgggagacaggaaaggagctgtgaaggacaagtgtcagatctgctgctgctgcttcaagactcagcctccctgaaacatcactctttcttagcaacctgcagggagacamccagatttttccatcagaggtttcttataccgtctaaacatattttcattctacgtgacaacacacaaatcggaccagtaagatagagatcaagagtttatcttgtcactgagttgcctcttctgctaactagcttcttcctgtcttcccatcttatttgtcactagtgttttcccctttccatagaaaaaaaaattttaatagattattttagcattaagcaactgagtgagattcaaagctactctttcttttctcatttcactttaattactaattgtagaaaggatttgggtttaaaaaaaaaaagttgcaagaactacggatttaatttctatctctcaaaagtaaacacctgaattagaaaactccattttatccattcactctttcttttttagaaaaataatttaaaagccacaatttttttttttgtttttttgagacggagtttcactcattgcccaggctggagtgccatggcacgttctcggctcactgcaacctccacctctcgggctcaagcgattctcctgcctcaacctcctgagtagctggggagccaccacgcccggctaatttttgtgtatttttagtagagacagggtttcaccatgttggccaggctggtctcaaactcctgacctcaggtgatctgcccgctttgacctcttaaagtgctgggattacaggcgagagccaccgtacccagccaaaagctacaattttttaaaagcacatattgccaggccaggtgcagtggctcatgcctgctatctcagcactttgggaggccagcgcaggtggatcatgtgaggacgggagctcaagaccgcctgtccaacttggaaaacccccttccttcctattaatatcatattatccaggggtggtggccaatgcttaatttacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactctttctcaaaaaaaaaaaaaaaactcacgagttattaacacatagccaatgaaatcagtctccttttctctgtccttgtttctcttcctactctattttaggcatctgaaaaagtatctaaaaggtgttatctaaaaagtgcttattataagaaggttaaagcactgattctctctgaaaaaaatctcctgctcttgtatgacaccctctaattctggattttaacttctcatacctagagacaacaaatagggaataaacagttgaatctctcttggatttccttatcctagaaagctctaattgttagcctctcccgaaatataccattttagaaaacataattaaatagatttgggggacaggaaagcattaaggaagaaaaagactttttaaagaaaaaatatttacgaaactcatgccaattaaatctgaatgttctctttaattctaagagcatcttttaaaggaccttaaagctttatatgttgctgtgtaaggaaacctgagcagactggagaaaagctcaaaggcctatctataatctcatcacaaagtgacagggtcaaaaggcagaggtcagggaacagggtacaaaatagttcccacacttgaaagaaaactgtatctcattagttcagagatattaaaaaatattcaattgtgttactaaaatgacaatttatactttaaatcccaaggcaaatttgaatattatgaaataatatacttttaagagcaaaaaatgtaagmagttacctcttctacatttgaaaaaaacaccaatctctcgctcacacatataccagtgcttcaactgtccctcaaagactgatgttcagataaaagctgtcacctgacctattcaatagagttcaataaggcactgaaataaatactgaatgtgcatacatgtcaacagacatttcatatctgggcctctgccccataatgattcaacaaggtatgtctacttcatggccttatgttcacattcagaaaaagctaaatttttactcttgcttagagrtttcattccagggaaaagtgaatgtaatttcgttcaatattcattaagtaggctcaacacttgtgcaagagactcttataatgactccatgattcttcaatggacaattaaatctacagaagctctggggtctagggcatttgctggctatccctctaccacttctaytctaaccacaaattttgtgttctaagtggcagagarggtgatagaggtatcaaagagataaagagaattctggccaggcaccgtggtgcacgccattagtcccagctatcccaggaggctgaggcaggaagatcccttgagcccaggaggttgaggctgtagtgagctatgatggcctgttaatagccactgtgctccaytctgggcaacaaagggagactctttatctcttaaaaaaaaaaaaaaaggcacagtggctcatgcctgaaatcccaacagtgggaggccaaggtggaagaaccatttgaggcaaggaccatttgagactagcctggacaacacggtgagatcttgtctctacaaaaataaaaaaaaaaattagccaggtgtggtggcatgtgcctgtggtcccagctactcggaaggctgaggcaagagaaccacttgagcccgggagatcgaggctgcagtgagctgtgatcgcgccactgcactccagcatgggtgagagaatgagaccctgtctctaaaaaataataataataataataataataataatttaaaagggaggtggccaggcgcggtggctccctgtaatcccagcactttgggaggccaaggcgggtggagctcttgaagtctggagttcgagaccaacctgggcaacacagcaaaaccctgtctctactaaaaatacaaaagttagctgggcatgctggtgcatgcctgtagtcccagctactcgagaggctgaggcagaagaatcgcttgaacctgggaggcggaggttgcagtgagctgagattgcgtcaccgcactccagcctgggtgacagagcgagactctgcctcaaaataaaaaataaaataataaaagggaggtggagggggaattttggaatcaccagtatggttcttaagtttttgttttctaccaacttctatcctctccatacactcaatactttaattatttccccattggcyccatccaccagaaacaagatgatttacaagtggttcactgtaaacgggtcctgtcagtccttcactatgaagaatatacaagattttacattctagtacacacagctttcacatatttaattaaaatcagattgtagctagagctgccagtgaaaaaatgaagcactgccagacaggagtgagaatgaccaaacaaaataacctattttcacatagtcacctcaagggtaccaatgcctgtgttttaactgtgaaatcacagtcattgttctggtgaacaatggcacaaaacaagttaagtccagtgtgaaagttcattttcctcgagctgagcaagaatattttgaaatcctgacaaaagtttatttattaagaaaatacatacacttgagacaggagataggaaatagttttaaacaatctgttatcttgttaccccagccatttatatttccttaaaagttagagttgaagttgaggataacttaacctaaaaatagaaaacactgtggttctaaaagtaaatcacctacaagctttaaacctataaccagccataaattcctactgctcaatgtattcttattaaagttagtatgtcattctcatagaattccaattgataatgttggtgctgattcttgtaacaaaggaggactacatcagggaattacgtaagagtagattgtgactacccacttcccccttcaaaagcaagtcacatctctgcccaaaggaaacaattcctttttgctgttttagtcctgatctacagcaataaaaaattgatataaatttaatatctagaaagaatatccttagactagcagattgtccctgttttctcaaaggaccacaagagaaggaagaggaagaaaactgaacagatactggaaataaaaggtactaaacccgaaaagatgtgagatataagaaattgcccagtttcaggctggatgtggtggctcacacctgtaattccagcactttgggaggcccaggcaggatagcttgagtccaggagttcgagacagcctgggcaacacagtgtgaccccatgtctacaaaaaaatttaaaaattaaccaggcacatagcagggcacggtggtacatgcctgtaatatcagctacttgggaggctgaggcatgagaattacttgaacacgggaggcggaggttgcagtgagccaagatcacgccactgcactccagcctgggagacagagcaagactgtctcaaaaaacagaaagaaagaaagaaaaaagttaaccaggcatggtggcacatgcctgtagtcccagctactcaagaggctgaagtggaaggactgcttgagccwgggaggttgaggttacagtgagctatgactgtgccactgcactccagcccgtgtgacagagcaaggctctgtctccaaaaaaaaaaaaaaaaaraagaagaatgaggccgcgcgcacaggggctcacacctgtaatcccagcattttaagaggccaaggtgagtggatcatttgaggtcaggagttccagaccagtctggccaacatggtgaaactctgtctctactaaaaaatacaaaaattagccaagcgtagtggcagacgcctgtaatcccagctaatcgggaggctgaggcatcagaatcgcttgaacccgggagacagagtgtgttgcagtgagcygtgatcatgccactgcactccagcctgggagacagagcaacacaccatctcaaaaaaaagtaataataatgaaagataagaaagagmcagagaaaagagagaaagaaaagaaaaaagaaaaaaagaaatttcccagtttctgctagaaatgaaggtaaatggaagattcagacagacatttccaagagttttttcaggtcaggcgtggtggctcacacctataatyccagcacttttgtaggatgaggagggaggattacttgaagtcaggagttcgagaccagcttgagcaataaagcaagaacccatctctacaaaaaaaaaatgttttttttaattagctggtcatggtggcgcacagccgtggtctcagcttctcaggaggttgaggcaggaggatcacttgagcccaggagtttgggagatcaagcctgcagtgagctatgatcacaccactgcactccagcctgggcagcagagtgagaccttatttctaaaaaaaaaaagagcgagctttttcactatgaggttttacataatgatacaagaacttttttgtcaaaagaatatttcttcttctacaggtttttctcaaaaagggacaaccaaaagagcaataagaggtggcatcatgaggaccaaggtgaaaataagggtgatctttgaagaagggattagagaaaaaaagtacaaaagcctggtctatgagcaatcttgtgtcaagctgtactgaggaattaagatgatcagaaatttacttaatttacattatcacttctacattgatgttttctcaaactataggataatttcctgtttaaataaatgacagagtatgttgtactagaaaagaggaagagaagggaggggcaagaaaatatagtctacaaagcagaaacctggattctccaggcatggacaggaaaaaattaagcaaaattaagtggattttcatcagaaggtctctgggaatctataaaaatagatttaaacttaaaaatatttaaacttaaaaatatctttaggccgggcacggtggctcacgcctgtaatcccagcactttgggaggccgaggcaggcagatcacgaggtcaggagatcgagaccttcctggctaacatggtgaaaccccgtctctactaaaaaatacaaaaaattagccaggcgtggtggcgggcgcctgtagtcccagctactcaggaggctgagacaggagaacggcgtgaacctgggaggcagagcttgcagtgagctgagattgcgccactgtactccagcctgggcgacagaamgagactctgtctcaaaaaaaaaaaaaaaaaaaaaaaaaatctttaaactgggtttcacagtttaaaatctagaggtccacaaactatatttaargattcagcacttcagtcttcacagcagaactgaatgaaaaaattctacagggtccagtgcagtggctcacgcctgtaaacctaagcactttaggaggcygaggcagactgatagcttgagctctggagttcgagaccagcttcggcaacatagtgaaaccccatctctacaaaaaatacaaaaattagccaggcgtggtagcacacacacctatagtcccagctatttgggggactgaggcaggagtactgcgtaagcccagaaagtggagactgaagtgagccaagatcatgccactgcactccagcctgggggacaaagtggkacgctgtctcaaaaaaaaaaaaaaaaaaaaaaaactacaaccctaacattattaactccatcacatttttgtttgttcgtctttagctcagatcaccttttggatcattttttattgtaatttataaatactctttccaaaacactgtcacattgtataattgagaaaagtatctagaaacaatccagatcagcaaaagtgttgagacacacactcccatgggtgtcctcagataatgcacaaaatagttttctagaggaaagtaaagcaaacagactgactacttctgcagtgatattcctaaaaggctttattaatatgtggaaactattcatagctcatcagtaacggtagcttaccagtagcataaaatagatttcccattatgtatggggctatgcacaattactggtttgatgcatataatgccacctttctctcccacccagtaaaagcatacaggaatggaactgaataaaaataatatcattagagggaagaccttgaatccattccacttattttaaaatatatatcataacctcagtatgtctactactgttaataattacttgtgacctagctcatgaacagtaggcccattaatgtgtcaccacccagcagttgaggacagctggtctgaaggactcagaggggcagcagggcgtaggaaaaaaggctagtttgcagccagacagcctgggatggaatccaagctatggcctttcctgtctttgggcaactcactgaatgtcatccttctcatctatcaaatgagaaaagtcatattttcaagttattgtgagaattagcgtttataaatcaccaaccacagttcatgcctcataaatgttagctattttcatagcatcatagaataagggtgacttcctgggattacttctgacttaataatgctagcacatatctttgaaagtcatttaaataaagcattatttcaaaattagctttctgcatgagtgatatacacaagtttctaacagaaaaataaaaggtaacccaagaaacccatgttagtaaaaatagttacaagagttaatttcaaataaagttagtaaagtcatagattcttggaaaaggtgcagaacatctgagaaagctaatcttgcggcctcttctatcctcaggatgtgctgtctcagcagcagataaaatactaatactttcattcctagaattctgagttcttacctcctcacactcaaccagtcatcgctgcattttgtttgaaaagtaatggaggccaggcgcagtggctcatgcctgtaatcccagcactttgggtagccgaggggggtgatcacctgaagccaggagtttgaagccagcctggccaacaagctgaaaccccttctctactaaaaatacaaaaatgagccaggcttggtggcgagtgcctgtagtcccagctacttgggaggctgaggcaggagaatcacttgaacccaggaggcagatactgcaatgaggcgagattgcgccactgcactctagcctgggtttatttatttatttatttatttttttgagacacagcgagattctgagaaagaaaaggagaaagagagaaagagtgagagaaagagggaaggggaggggaggggagggaagggagagagggaggaagggagkaagkaaggaaggagggagggagggagggaggagagaagagagaagagagaagagtaatggggaaagacagtcccatatcaaaaatttttggaatctctggccaagaggaccttacatggtgccatcttaaaaagtcaagccttaggtagaacagtgcattgtaaagcacaataggagagtataaacagaaaaaaatatatataaaaaaatatatatataggattaaactttattgaaacaaagagaactgtactgactgactgtgcccaaagctgatgtaggtgccatgaagaacaaatctgtaaatgcagtttcctaagatattcctttaaaaccacaactgaagctacaagtgctctttagtacaaccactttctgaaatttcataaatactgcccatcatttacatgctcatcacttggcactagyttataaataaataagacatgtttgcttaaaaaaaaatcaaagccttgttggtacctgcatgcttgcttgcatatacctggtaaaaatggttaattttatttaccgtatcttatttgaagaggaaaggaataggctaatacattttatagttgaaagaaattttattagcccttcacaaagctgttagatacctttttttagaaatcatttatccattatcttgctttttcatcaatctcaagcttctcatttttaagaaaactctagcttccattttactgtttttatttattttattttatttttaatttttgagacagggtctcactctgttaaccaggctggagtgcagcagcgcaatctcagctcactgcaaccttgacatcctgggttcaagcgattctcgtgcctcagcctcccgagtagctgggattacaggcaaacaccaccacgcccagctaatttttgtatttctagtasagacagagttccgccatgttggtgagcatgctcacaaactcctgacttcaagtgatccacccgtctcggccacccaaagtgctgggattatagggctaagccaccgcgcctggtccattttagagtttttaaaatccacacataggccaggcatagtggctcacccctgtaatcccagcactttgagaggccaagatgggcggatcccttgagcccaggagttcaagaccaccctgggcaacacagaccccatctctacaaaaaaaatttttttaatcagtcaggcatagtggtgcacacctacagtccaagctacttgggaggctgaggtaggaggatcacttgagcctaggaggttgaggctgcagtgagctgtgattgaagtattgcactccagcctggacaacagagcaagaccctgtctcactcttgttataaataaacaaataaatgtaatatttatttgttataaacaaatacctaaaagtttgaatcttattctaaatacaaaggaagttattagagaattttaagtagaaaaaaattattctaagatctcaatgactatatttgggaactggcagtatcatccatactacagtaataatctagagattagtacagtaatttcaaacaggaacccctgggtccttaaaagtccatgtagataataattgggagtccattaattgacattaagatttcaaaatgcttcttaaaaattgtagctttcggccaggcacagtggcctgtaatccyagcactttgggaggccgaggcgggcagatcacctgaggtcgggagcccgagaccagcctgaccaacatggtgaaactccgtctctactaaaaatacaaaaaaaaattagagggacatggtggcacatgcctgtaatcccagctattcgggaagctgaggcaggtgaatcgcttgaacctgggaggcgctggctgcggtgagccgagatcacaccattgccctccagcctgggcaacaacagggaaactctgtctcaaaaaaaaaaaaaaaaaaagtagcttttctggaaagggaactgtataaactaattgaktttctccctttcctggtggctgattttctaattacttaatcgctcctcatgtggtatagttatccctcagtatctgtgtgggattggttccaagactcccaggatgctcaagccccttacataaaatcgtgtagtacgtacagataacatacgcacattctcccgtacactttaagtcacctcctggttagttataatactcagtacgatgcaaattccatgtaaatggttgttatgctgtattgtttagggaacaatagcgagaacaaaaaacacgtacatgcaaccacaatttttggtttttattttttttggaacactgtattttcaatttgatgatggtttaatccacagatgtggaacccacacacatggagggctgactatacatgtggtgtgtactcgtcctcttgttctatgacatttaggattaatttttttttaacagataaacttagtttttttactcaaaaacaatttcaggccccaagggtggtagttagaaatcattcatctcatttaacccttttcaagacagacgagaacactgatgcctgcggctgtcataagtgacaggccaggaatggaatctcagcttctgactgtgcattcagctctaactgctgtactcactgccctgccagctatggtttcacaagcattcatacattcctttaaaaaactataaactcacctaatgacaaattatttatgctaagaaatgataaaacccagtaagaagagcaaagaggttttttaaaaagttaaaagtggtatatttcatagtaaaagcctttatacagtaacaccttatctttaaaaatattcattgacaaaagcaaaaatatcattaaatatataatcttctaaatctaaatctgtgatgaatgaatgaggaaatgcatgcaagagaaattactagtgctgaccaaagaagaaacaagctaggtcaggtcataaaggcctgcccgatagtgtcgcctttaatatctttcccatatagaggaataagaagataatttcacttgacgataaggttacccatttgggatctatattctggtagattttacaatctgtatgatacagcatatgttactagggagacagcaaatatagtggttatgggtatggatgttatgggtatggatgaattatgtcagacagatcttcaatccaggcttcttacttattataggaactgaagtaaagtattcattctctagactcagtttcctcctgtgtacaaaagagaaaacaggccaggcgtggtggctcacgcctgtaatcccagcactttgggaggccaaggtgggtggatcacaaggtcaggagttttagataagcgtgatcaacatggtgaaaccccatctctactaaaaatacaaaaagtagccaggtgtggtggcgtgtgcctgtaatcccagctactcaggaggctgaggcaggagaatcgcttgaacccgggaggcggagattgcagtgaggagagatagcgccactgcgctccagcctgggcgacagagtgagactcagtcttttaaaaaaaaaaaaaaaagagagagagagagaaaagaatgcctatttcctaaggttgttgtccagactgaatgaggtactgactataaagaatttagcacagtggttgggtggggtggctcacaactgtaatcctagcactttgggaggccgaggcaggaggatcacctgaggtcaggagttcaagaccagcctggccaacatgatgaaactccgtctctaccaaaaaatacaaaaattagccaggcatggtggcacgcacctgtagtcccagctacttgggaggctgaggcacgagaatcacttaaacctgggaggcagaggttgcagtgagccgagatcacgctactgcactccagcccgggcaacagagcaagactgtgtctgggaaaaaacaaaaacaaaaacaaaaacaaacaacaacaacaacamgaatttagcacagtgtctggcatgtggaaagcactctataaatgttagctattttactatttcatcayagattcttataggacagtggccaccrcttacgtatgtactccagaatctgacacactgtaagcatttaacattaaataatccaaaatataatagctagttatggttttaccaaaaacaaaatttaggtcattattaaacaaaaatgctaaggatcaggcatatggcacgtttcctaaagcatcctgtatagaaccatctctaccattcagtaaattatagaagaggaaattgttttcttccgtatgaagctttatggaaatcatgactaacaatgcattgtattctagatatttacttttattactctgagagtatctgtgaccaacagtggaaatacaagcaaaaggatgtgcacaggaattttagracagtctgtcttaacaccttagcagcaaacagaacttgtactcctccagcctcctttctctctccctgtccccttttctttccctttctctcctccctcaaagacactatgtctcaccctcttcccctcccttgtcttcccagttgtctatgctggtgtgtcctgtattaacaaaatgggccataagcctgagccttggggttatcacagagaatttagcttcactcactcttgggccaatttcactataaagagttttatttccagtagatttccaaaattaaatgatcattataccacagtgtcttagtctgttttcgtgttgctataaagaaaatacctgaggctgggtagtctataaagaaatggcgcagccaggcatggtggctcactgcctgtaatcccagcactttgggaggccaaggatgggtggactgcttgagctcagkagtttgagatcagcttaggcaacatctttgtagagatggcaaaaccccatctctacaaaaaatacaaaaattagccaggcatggtggcacatgcctgtggtctcagctactagggagactgaggtgaaggactgcttgagcccaaggagattgaggctgcaataagccaacattgcaccactgcactccagcctgggtaacagagactctgtcccacaccccccacccaccctccccgaaaaaaaagaaagaaaaagaaaagaaatagttggcggctatactacgcaagaggcatggcgccagcatctacttctggtgagagcttcaggctgcttcctctcatggcagaaggctagccaattagagatcacatagcaagagagaggaacgaagagggtaggggagtggtgccagactctttttaacaactagctcttgtgggaactcataragggagaactcacccattacctctaggagggcaccaagccattaacgagggatctgcccccataacccaaatatctcccaataagccccacctccaacattaggaatcaaatttcaacatgaggtttggggacaaagagccaaactagcacacagcaaccagatcttgaatcttctttggcctcattaaaatgaaggctgatccctgtactactccttccccagcccctgagctacccggggcagaccttccaaactcccaagaacctattgtgagccaaggatgtcaacaaagctaacaattgacacagtatcaatggtatttggatcacggcagcttctatcccaattaagcctatacacccggccactgtttttaaaaaacacacttcagcacagtcttgactatgacattcagtctggaataagggcaatcctgaaatgcttgttgaatgagtcaagctcatcttttttctgagtttaaatagaataactatggagcatagtggactggaaccaccaggcactagtcaggtgtctactgctgatcaaatgtaatctgagagggcccttaatctctgagcctcagtctctttaccataaatatgtctaaggtcccttcaakaactaacgtgacatgatattctgtcagtcttgactaaatgttctgcttatttgaattcagatcatggtctccaccgtctctacgctcttttgaaaaccacacccaacacaaccaaagctaaaaatagctagagagagacactaaggaaaagatctaaacaaagttctatggcagagatctcatccatcagacttcgacaactattaggagggctgaatccaggctaccaagggaacactttaagaatattctggtcatcacataatttgtagactcatgtaaacttatattcattcccttattaaacactgtgtactgtatataaggtactacgaaagaggcaaagtcccttctctcttagagggcttgtatatttattttacttaatcaaggccttatcatgtccttcattttcccattgctcaaaagattgactgctgtaaattaagccatgtgtactcctacagccaggtcttaaaggaaataaaagctataaaataagatttcaaaatgatgtctgccttccctgacatcaactaattgcatgatttacctccatttatacctcctttcttctacatgcaataaagaatctcgttttgaaaccttttccttatctttaatatttaaagggaatttaaacatttctcccaaaggacgttttgttcatgggcaaagtacctcttgaaaatatacagtgggtaggagaagcacaagaacttcgatgtggtacagaaaggacgacaggtaatatgagtatatcagtatatacatgtggacatcaccataaagtttctaagtcctccattttaaaatatatttttatgtatatagttaaattattttcagctattaagagttctacgtatttgagatgaaagaagtctcttccattgctgtttaagcttggttttactaggagggtctaaaaaccatttgaagccttgataagttttattataaggtcttagtctatttaactgttgttgtctttgatttcaatgtcccaccacctgcagagtgtgaattctaggaatatgcgtatgttaagaaagtctatgaagcaactggtagaatttatgtttaatagaagtcaattaagaccttctagaggcacggtgacaacttgctaagaaagtgtgataaagacagatcagctccagcaaggcaaaatagaaacttgactatcattaactttgaaattaatgcagcaaaacagaaactaccttctggctaatttgcctaacacagtttcatgatccccaaatgttgctctacrgaaatagtcaagaaaattcttagttgagaacatgatatgacattctcctgttttcctgccatgtcactatccacactccttaatctcctcggttgcctcctcctcctcatcctccccacctatgcatgctagaatggccccagggctcaatcatttgcgtgtcctcctctcttttctatctatactcaacccttaagtaatttcatggctttaaatttatacctacagtccagatcttcccccaagagatgtcttgtctatgtgacatctccatttgaatgtctaatggacacatcaaacttaatacatccaaaactgaactgatttccagtctgattctccatcagtcttcctatttcaggagagaagtttataattgttcagccccaaaatcttggagtcatctttgatcacttctttgaatatgactaccatattcatagaattcatacatattcatataaatcatcagcaaatctcgttgggcctaccttcaacatctatctagaatctgagtccttcctgctgsttcaccaagccaacaacttctctcaccacaaatacctttttttttttttttttttttttttttttgagacagagtctccctctgttgcccaggctggagtgcagtgrcacgatctcagctcactgcaacctccacctcctgggttcaagcgattctcctgcctcagcctccagagtaactgggatattacaggcatgtgccaccacgcccagctttttgtattttcaggtgagatgtggtttcaccatattggccaggctggtcttgaactcctgacctcaagtgatccacctgcctcggccttccaaagtgctaggattataggcgtgagccacagcatccagcctctcacctcaaatactgaaagagctccctaactggtctcytgcctctacccctgccctratatagtctacccaacatggcagccacaacagtcattttagaaggcacatcagatcttgtcattactctgctcaaaaccttccaatactttcccatctcagagttaaaagcctaaaaactgcatgaggccctatacaatctcccctgccctttctctttgatcttacctactactctccctctccctcagctccagccatactggactccttgctgttaccagcacaaactagkgactgtcccactcagggtcttcgcacttgctgtttcttctgcgtgcaatgctgtgcccccaggtgatccatctggcctgcttcctcatgtccttcaaggctctgttcaaatgtcaccctccctgtgaggccttccctaaccatcttatttaaaatcacaaccccaccatcccaccactctgctggcatgtccctaaatccactcccctgctttatttttcctcatagcacttattaacatctggagaactatatacagtcggcacttcacgtggactccgcatccacagattcaaccaagcacagattgaaaatgtagttaggcctacaatggttgcatctgtactgaacatgtacagacttcttttcttgtcattattccctaaacaatacagtataacaactatttacataacattacaacgtaacaggtattgtaagtaatctagagatgacaaagtgtacaggaaaatgttcataggttatatacaaatgctacaacattttattataagagacttcagcatccgaggattttggtgtgggggacactctagaatccatcccccatggttayggagagatgattgtattttcattatctctttacactngaacgtatgctccatgatggcagggatttctgactgctttcttcacagctgtccccagtgcctaaaaaaccgactacagatagatgctttcaaaactgttggatgaatgatactgaaatattacaaggcaaaatacattattacctgaatacattaaatattatgagaagcagaaatcccaatcacccacactcacacagttttgcaaaaagagacatcatagtttgtttcttaaaaatgcattaaagtctaattgatggttttgttaacatcattctctctgtgcctaaagagtcctaggtcacacctaaaaggtacagttttagcttcagtaggcaaacggaaaagaaaaatacaggcttttttcctttcattagtcatcactgacagaaggcctccaagtgaccctggtgccacaaatgtttaggatctttagggaagaaaggagtctagaaaaataacaatattccttcaccaatctcgagaagaatctctccaaatctctctgcagacattttttcttcatatcctttaacaaagccattcttaacatgtacatgaaatcttagttgaagaaacaatgtgattacataattacacatacggaaaaacttggtattctattatctctccaaatttttttttaactaaaactagacttacagtttttgttgaaaatgttttgtgtttctacctccgaagaatatgaaaaaaagaaaatgttttgctctgaagctgagttaagaagaagatagccaagacgtgggttgatggggrctgtattttaaggctgaacagttttgtttactattgtttattatttaatatattcttcccagtctccccacccccaccaaaggaaaagcgaaaaatttacgttagtgcaatcaataaggaattatttgtccaaaggaagttgttctgaaaggctatgacctaagtctttaacacaaagttcaggcggtagatgtcacttctctcacccatttaacaacaacaacaaatcaagattcagatcccgcggaggcaagcagaaaggaacaggcgtgaaaaatgaaatcagttgtttctccccggcctcctctcgacactgcgcactccgctgccctgcccccgcccatcgccctttagcggccccttttaacggcgtcgtttgcccagcacagccccgcactgcgccatcaaatgagtcaagcggaaggaccggtacccctccgggaaaaccaggcactaacacacggtgcacccaactgaatttaaactcgggaacagtgtaggcagtgtcaacaaagcgcggtgctgggtcccgagcgtccaaaggtccctgccagctcccagacgcggccaaatccacaggattccaaaaggtgacttggccggcaccgcagagcggcaggcggcgcagagggcagagtccgaccggtccccgccccgcgctcgctccgcacggccaccggctcctccgcggacgctaccccggcgggagccgagctgagtccgactccccstctcccgaagaggcccgaaagccgcgtcacgtgcggggccgaaacttcgcggccggggccgggtggctggcgggtgggaggcaggcacggcggtcggggggcagccygcgcgcccggtgactcaccggccgcctccgagtgcggctgcargcgaaggggccggcgcgccaggcggggtccgtgcccttggggccacccccgcgcctgttattaataacccagcgcctggaggcgaaagccccggtgggcgcagccgcaaagcccgcacgcggaataaataacaatgtcattaaatcgcgcccgagcgccagttcggccagaaagcggcgggagggcgccaccgggagctgactttgtctggagcctgcaccccgcctcccgcgcgtccccacagcgtcccccgcgcccctgagggggctcagcgccgccgcagccctggccttacccgccagctcgtcaggctccagcccgctgtccgcgtcgatcccgcacagcacgaagtagtgcgcgaagcggcaggcggccggggaggagcccgagcccgggccgggcgccgcgcagctcccgctcatcccggccgcgctgctccaggggccgccgccgccgccgcccgggaaggctttctgcggaggctgccaccaccgctccggctgtggtctgtgcgcccgccctagggcgacactggcgcgcccatggccgcgcagccgcctctcgccgccgcagcctgcctcctcgctcggcgcgggggaagcggccgcgggctcgcgcgcggcgggtccggagcccggccgggtgggggaggggcgcggggggagtgtcggcctgagaggccctcgcagccgcagctgcgctcgcgagctgagagccgccgcgtctggcgcccgcgggtcagctgagcggcgctcgggctgtgggagcgcggggcgggcgggggcgccggggctcggcgcgtgcgacggagaggggtggggggcgcgctcgcgagggacggaggcgcgcgcttctaccgtgcgcgcgcgcctagcgggttcggaggccaagcctggcgtggggccgcattcgtgcccactggccccggctgcggcatcgagggcgaccctgcacacacccctcctcgccctggccagccgataagagggctagcctcagtgtgggggtctgtcttctaaaggggttgtcacccatccttatttcttttaatgcagctttggggaaggtgaacagccgctctgagatcatttcgcataacggtctgaaccatcgtcttttaaactgtgacctgtgtgggggtgcctgtctcactttaaggtcctcccttcccccagccgtcaccccatttacaggccatccttagtgacttagtgacaagtcaaccgtgagggggaaaaaacacaactcaatacccacaaagcgttgagacttctagaaggagtgcagtcaccaacccccgccttctgtcatttatcctgacattttccaggtcagtgtaaatagccaaggcgctccagttccgcagccctgtacccatccgatgttatcggctctccccgcaagtaacaatcggaggctaaagcaacaggaattagaccatgaactctgctcctcccaaaggcacggctttcttgccctgctcagctgtcttttgccttctcggaaggaactcgacaaccagttctttttcctttgaaagaaaactggctgggctcagtggctcacacctgtaatttactcaacactttgggaagcccaggtaggaagatcacatgagaccaggagttcaagaccagcctgggcaatagagggagactctgtctccatctaagtaaaaaaataacatttatttatttaaaaaataattttttaagagacagggtctcactgtattgaccaggctgctctcaaactcctgggttcaagtgatcctcccrccttggcccccaaatgtgctaggattacaggcataataagccactgtgcccggccatgtaagtaaaaataaaacttaaaagatagaaaactgaatgcaattcatctccacatggcaaccccttccacaccactccctgctttcttctttggggatttggggcatctaccactagacatacaagcaaaccttccagagaggttgcctgagagaacctcgattatttgactgaataatgttcttcctagaagatacatgtgcgtgcataccatcatttaatgtagcttgtatcttcactttctttcttcaattttgaaatgaaagaggctggccatggtggctcaggcctgtaatcccagcactttgagaggccaaggcaggaggagcatttgagtccaggaattcaagaccaacctgggcaaaatagtgagagaccctgtctctataaaaataaaatgaggccgggtgcagtggctcaagcctgtmatcccagtcctttcggaggccaaggcgagaggctcacttgaggtcaggagtttgagacaagcctggccaacatggtgaaactccgtctctactaaaaaaaaaaaaaaaaaaaaaaaaaatcaataaaataataattagtaaaatataagaagaattggccgggtgcagtggctcatgtctgtaatcccagcactttgggaggccaaggcgggcggatcacgaggtcaggagaccgagaccatcttggccaacatggtgaagccctgtctctactaaaaatacaaaaaattagccagtgtggtggcacgcacgtgtggtcccagctactcgggaggctgaggcaggagaatcacttgaacctgggaggcggagattagagtgagccgagatcgcgccactgcactccagcctgggcaacagagtaagactgtctcaaaaaaaataagaaaagaaaagaaaatacaagaagaatcaagaaatcagggtgagccacagtctgggtaattgacctttaggtcatgttgcaccctgtacttcttcaaaaacacttgtaatggcttttctgtgtcttcttagctgtgttgtaaactccacagagcaagagttggactctgtggttcttcacttttctggtatctagcagaactctggtcctatttagcccctcaatttatatttgagtgttgaaagaagagcagttatctaggtgataacaggttgttgattctaccagaaaaatatacaaactttaatatctgtaacattttttaaaaaataagtcctgggctgggcatggtggctcacacctgtaatccgagcactttgggaggccgaggcaggtggatcacatgaggtcgggagttcgagaccagcctgatccacatggtgaagccccgtctgtactaaaaatacaaaaattagccaggtgtggtggtgcacacctgtaatcccagctctacttgggaggctgaggcacgagaatcacttgaacccgggaggcagaggttgcagtgagccaagatcatgccactgcactccaggtgacagagtgagactctgtctcaaaaaataataataaaataaagattaaaaaataaataaaaataaaaataagctccacatatgcaaggcctcaaaacttggtcaggccaggtacggtggctcacgcctgtaatcccagcactttgggaggccgaagggggcagatcacctgaggtcaggagttcaagaccagactggccaacgtggtgaaaccctgtctctattaaaaatacaaaaattagcctggcatggtggtgagtgcctgtagtcccaactacttggggggctgagacagaagaatggcttgaacccaagaggcagaggttgcagtgagccaagatcgcaccactgcactccagcctgggcaacagagcaaaactccgtctcaaacaaaacaaaacaaaacttagtcaaaaactcagaattgttcccttccacggaaatctttagtaaaagacaaaagacgtatacgatctgaagagaaaccagagtatggacctaattgtgaacactttaattactcttatgcaatattgcttttcctcacgtagaaagtactgaaatgcataacatttcattagtaaggaaggaagtgccaggtatctgtttctcctgtcttcggtggtaacttcttacagaatgtttgttagattccaagcgaatcaaacaaacacagtaaaaaaactgatttactgtttgcactagccaaggcacgtcattttttttttaaatttgaccagtaactgatttatgagtttgtaagccccacattaatatttttaaggtgaaaaaaattgaatcaccaacaaacaatgcatgcaattaaaatatactaatctcataaaaatagaattcctaaaatctttcctaaagcttttaggaaaatagtcacacattacaaaattaaacactaatttgaaaatatccgtatacttttttaattatcacttcaggatgacactgtgtaagtatattctgcattaagctacaatgaaacgaagttgaaaggatactcaagaattagstatgtatcattatatgcagattgtcctctgaaataatgacagagaagtaaattagctcagtgaacaaaaatctgagcaatgatctgctgtctccaaaggacttactggtaaagcctcaaatggacggcatggcatgcttgggatagctgagtcctgccacggtctgcggaagtggaggaatgagagattgatagcactgctaagctggtggcacatggtgactctgactaccagtaaaatgtggtccaatgaatgttttgggctctaaatagttacattagcaatcaatcccttctttcttggttgtttatatgtggctggagtgtggtggtgaagaacggtgttgacaaggattgtcatagcatcaaaagagaaaaataacctctcctctccttaacacgacttaaatattttggagagtccattctcctcatcgtatttgctacttctcgatcccttacagccctcttttttgggggggtggcgggtcactcacccaggctggagggcagtggcacaatctcgactcactgcagcctccacctccctggctcaagcaatcctcccacctcagcctcccaaagagctgggaccacccacaggcatgtgcaatcacacccagctagttttttgtatttttggtagagacagggtttcaccctgttgcccaggcgggtctcaaacccctgggctcaaacgatccacctgcytcagtctcccaaagtgctgggattamaggtttgagccaccttagaaccctcttttaccccttgttgttgttaaccactttttactagctaacaattataataaattttcgtgttcaaattactggtttctatctcctgactaatccataagccaaatgtccatcaccagatgaatggagaattaaattggtatcctcatacaagggaacactacttagtagtaaagaggaatgaaccactgatacatgccacaaggtgcatggctgtcaaaaatatgctaagcaaaagatgccaggcacagaggagtccatagtgtatccctctactcatatgaaattctagactgggcaggaagcagatcagtggttgcctggggccagaggtgatgtggtgggaaattgactgcaaaagggcaggagggagctttccggagcaatgggaaaatgttgtaccttgattgtggtagtgctttcacagacagatatatttgtcaaaacccaatgtactcttacagcaaatacatttttttttttttgagatggagtctcactctgtcacccaggtaggagtgtagtggctcaatctcggctcactgcaacctttgcctcccgggttcaagcaattctcctgcctcagcctcctgagtagctgggattacaggtgcacgccaccacacccggctaatttttgtatttttagtagagacagggtttcaccgtattggtcaggctggtctcgaactcctgaccttaggtgatctgtccgcctcagcctcccaaagtgctgggattacaggcgtgagccaccgcgcctggctagcaaatacattttaatatatataaattgtacctcttagctgggcatggtgacgtatgcctttggtcccagctacttaggaggctgagatgggaagatcgcttgaacccaggagatggaggttttgatgagctgagattgtgccactgcactccagcctgggcaacagagcaagaccctgtcaaacaaacaaacaaataaataaataaataaataaataaaattgtactcacaaatctatttacaaacaaaaaagagccaaaagatttatgtccagtttttattgcatcctactcattttcaaaaacttttgtaaagtttcaaaactttacatttcctaaaattctactcattttggttgattgacaaggactgatccaaattcttacaaaaattttattcaattttggttttttttcaaccagtatgttttggggtggtttggtgtgctgataaaggggacaacctccagactctcactacctgggttcaaatctcacttcttttagtatctataagacaatctgcttaatgttactctagctttaatttccttatttgtccagtgcagatcaaaattaagttattgtgaagtttgaaggagataatacatgtagagtgcttagcacagtccctagaacatagaaagtattcaatatatgtaactcattgtttctgtgtgccagacactgagctagacattttaacatactctatctcattattttgatttttttttttttgagacagtttctctctctctgttgctcaggctggagtgcagtggtgtgattttctttttttggaaggcagttttataattttatttgatatattcgacaatcagtggttagttctcatccacattgactgtctgtagatttttgaaagcatagggatgccatatgggacattccttaatcctttggtcaagacagctttgttaagcctggtatcagtgtgcacatccgtagttcccatgtccttgatggcaaatttccagatctcgctgagtgcccgaggggcactcttcttgaaaccaactccatgaatgcgcttgtgaatgttgatggtatattctctggtcaccagctcactgatggcagaactgtaattcttctcaccacccttctttgcgggaggcattctgaggggcccaagytggaaaggaagagtgcgagggattgtgggcgaagtgcagtggtgtgattatagctcactgcagcctccatcttccaggctcaagtgatcctctcatctcagcctccctaggagctgcagctacaggcacatgccaccatgcccagctaattctttatttattttattttattttttgagtcaaggtctcactgtgccacycaggctggagtgcagtggcatgatcaaggctcactgcagcctccacctcctgggtgcaaatgatcctcccacctctcagctccctgagtaccgggaccacaggcacaagctatcatgcccggctaatgtttgtattttttgtagagctggggtttcaccatgttagccaggctggtctcctagcctcaagtgctatgcccgcctcagcctcccaaagtgctgggattacaggtgtgagccaccccgcctggccaactttttatttttatttttaatagagatagggtatccttacattgcccaggtgtgcaatgtaagtctcgaactcctaaactcaaatgatcctcctgycttggcctcccaaagtgggcatgagccaccacgcccagtcatgaaaatcagtccaagaggtctagcacttcttgcgtagcacttcagaatacaataggtcatgatcactttaatcagatagggccaatggagatatgcagaccctagttccaggcccactcaatgagacatgataaatactgagaggggtataggggggttggggtcactgagcctgtgctgtgttgacaagagaagttcaatgtggcagtcaaacttagcatccaaagtgggccaccatctctagatggcgtctacacggtcagcaaaaggggccgtaagatttagttgttgcaaatggtgacagaaaggagcatccaaggcatctggcattcggaaatccaggcaagcaaggtggcgggggtgggggggtggtggctcacacctgtaatcccagcactttgggaggctgaggcaggtggaacagctgaggtcaggagttcaagaccagcctggccaacatggcgagaccctgtctctactaaaaatacaaaattagccaggcgtggtggcgcacacctataatcccagctacttggaaggctgaggtaggagaatcgccggaacccaggcaggtgaaggttgcagtgagccgagattgcrccactgtgctccagcctgggagacagagtgagactttgtctccaaaaartaaaataatataatataaaattccaggcaagcagcttcaggaagtctatcatggaatcacaggttctctccagttgtaataagaagtcaagaggatatagtgggttgaattgtgtccccaaaaaggtgtgtccaagtcctaatccctatacctgtgaatgtgatcttattcagaaataaaatatttgcagaygtaattgaggatctcatcttgagatccttaatgcagtgcaattatagctgagtgggccctaaacccaatgactggtgtccttataagaaaagggagatttgagatattgagacacacataggcgaagatcatgtgaagacagagacagagcttggaatgttgttgccacaagctaaggagtgccaagcattgccagcagacaccagaagctaggagagagggatggaatggattctccctgggggtcccccagaaggaatcagccctcctgacaccttggttttagccttgtggcatctaaaactgtgagaaaattaacttctgttatttaaaccaccaagtttgtggtaattggttgcagcagccctaggaaattaatgtagaggggaacctgcaagggcccagcctgaaaaaggaactagagacctaggtaggttaccagagcggaacccaagatactaggaccgagggctcctggagagagacacttgcatataaggcagaagctaaattctaaggacctacgtacaatgacaaagtctaaatacaaaagacggtgacaggacttggtagaaggtccaagcagaacccatttgtagcagaaaatggggcagggataggcctgaaaatccacatcaagtgtcctcatctatgggaaggaaaagctctaaatagaccagaaactgaaacagggtagtggtgttgttgttgttgttgttgttgttgttttgttgttgttgttgttttaaaagcagagacaaagtctcgctatattgcccaggctggtctcaaactcatgggctcaagcaatcctaccacctcagcctcccaaagtgctgggattacaggcatgagccactatacccagcaggatttgggttttaaaaggtcaatcaacaacttcatctttcttccctaagattggaaccaattgagaaataagatataggatgccaacagatggagaacagtttctattattaaatgtagcctctgttaatgctaaagccggctgggcacggtggctcacacctgtaatcccagcactttgggaggctgaggtgggcagatcacctgaagtcaggagttcaagaccagactggccaacatggcaaaaccccatctctactgaaaatacaaaaattagccaggtgcaatggcgcacacctgtaatcccagctactcgggaggctgaggcagaagaatcacttgaacctgggaagcggaggttgtggtgagtgcagatagcaccactgcactccagcctgggtgacagagtggactctgtctttaaaaaaaaaaaaaaaaaaaaaaaaaggtaaagctgatctgaagaaagagcaggtctgtggcagagatttgctacattactttccatcccttcaatcttttcttcccrctgaccaaaccctggctcaggccaccgaaggggatatttgaatctgtagagcatctacatttagttcagtattgctgtcccatgtaagccccaggtgggaaggaaatagaagactctccaatgcttgctaactttaattagattagcgccatccaatggagaaatgaagaccatgaactactttgcaaacctagcaggcaggggaggggtgaagtgggggccaacagtgttactgtagtagaagttcctctacatggaaacgtgaggcaagaggaaaggaagttcctccctaataggtggctgtttaatcagaatccatcccctcctccttcgttgtgtagtgttcatgtccttcacatggtattgggtttacacctagctctaggatgtctttgtgaacctatattccttttaagagttactgactcagggatgaacagttatcctaagctggcctaattaggatgaggttcagaacttttgtttgatagttggagaaaggaacatcctcttcttaccttgggtgtaaatatgatatataccgtcccaaaattaccagtagccttacaaggaaagccaggccaaggatgaagccaatatacagaatggagcagagccaagaatatcactgaaaagtagactatattataaactctggctcaaatcatacaggaagcctactcaatatctggaatttgtcagttaatgtgagccaatgaattccttttattgtttcagccagtttgagttattttctttaactttcaactgaatgtttactctcaaaataaggggaatagtctctaagatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgagcctccggcgaccggccagaactagctcttcttaaggatgtgacagtgatctgcactagagcttcaggcagctaaggtaggctttcctggaaatcagcccataagatgagaaagaaatcttttttttktttttttgagaaggagagtctcgctgtgtcacccaggctggagtgcagtggcgcaatctcggctcactgcaacctctgcctcccgggttcaagcgattctcctgcctcagcctcctgagcagctgggattacaggcgtgtgccaccacgcccagctaattttcgtgtttttaatagagacgaggtttcaccatcttggccaggctggtcttgaactcctgactttgtgatctaaccacctcggcctcccaaagtgctgggattacaggcatgagccactgcgcctggcccaagatgaggaagaaattttagcagccttctgcagaaggtattttcctgggttggctgggttccttccatcaaaccaaaatcaagagtatatgagtagaaattaaaatgcagattttctatcaaaagttagaatactcataccctctgattcatcaattctgcatctcagactttctcctacagaaatatgcaagtaaagaatatgtgtacaacgtcccctgaaacattgctcattatatttaaaagtggaaacaatcttattcctaccaataggaaataggaagcagttagctgggtgtggtggctcacatctgtaatcccagcactctgggaggcaggaggttcctttgagcctaggagttcaagaccagtctgggcaacatgatggaactctgcctatattaaaaataaaaagtaaaaaatataaaaaaaaattttaaataaaaataaaaaagacaaaaaatgaagtggttaaatagattctggtatatctgatacaatgcatgctaagaatgaggttacactgatggaaaaaatatctaatatatggctgaatataaaaggcaagaaaagacagctgggtgtggtggctcacacccataatcccaacactttgggaggctgaggtgggcggatcacttgaggtcaggagttcaagaccagcctggccaatatggtgaaacctcgtctctattaaaattacaaaaaattagccaggcttggtggtgcgcacttatagtcccagctacttgggaggctgagtcagaagaatcacttgaatctgggagatggagggttgcagtgagctgagatcgtgacactgcactccagcctgggcaacagaatgagactccatctcaaaaaaaaaaaaagcaagaaaagaaaaatatatagttcctatttttgtgttaaaaataaactgtatacatgtttgtgcatgaaaacatctgaacagcttccatttgttatttttcatatttctatattgttaaaaattgacaacaggcatctattgctttttgtamttcaaagcctttctttcttaagtccgtgtgtgtttctgtgagaaaagatgatcagcattgtgaatcatggctattcttatataaatcactcaaatttgtaactattataatgacttattagtgagactaatttgaataactatacatatatgcatatgtatacatggatgcatgaacattcattaattactcaacaattcttataatgcctactatatgccaggtaatgttccagggatatatcaatgaataaaatcctagagatatataatgctgtacatatatacattcaaaatagtctgaagagtataaataactatgaaattgaaaggattagccaggtgtgatggcatgtgcctataaccccagctaccrgggagactgaggtgggaggattgcttcagcccagagttgcaggtggaagtgagctatgatcgcaccactgcactccagcctgagtgacagaacagagactttgtttyttaaaaaaaaaagtaaaaaaagagaaatgaaacaaagtttgcataattttcaatcatcaaaaaaaccaatttggctactcagtgattaacttgattttatgttacaaatttgtaatctttctcaattccatctaaaaaccttaaggttgaaaacactccagtagccaacggaataacactatcagtcttgatctgagtatattttggatccagcatctttaaactctggccacatgccagactttgaacctgagttctctgttacagacttcacatgtgatttctctctctcgctctctttttcttttttcttttctttttttttttttttttgagatggagtctcactctgtcacccaggctggagtgyagtggtgcgatctcrgctcactgcaacctccacttcccgagctcaagtgattctcctgcctcaacctcccatgtagctaggattatgggtgcctgccaccatgccccctgctacatacaatttctcttgktcttttttttttttttttttttttgagattaggtctcactccgtcatctaggctagagtacaggcacaatcatggctcactgaagcctccacctcccaggttcaagtgatcctcccactcagcctcccragtagctggatcacaggcatataccagcacacttggctaatgtttctttgtttgtttgtttgtttgtttgtttgtagagactgagttttgctgtgttgctcatgctggtcttgaactcccagacttaaatgatctgcccacctcagccttgtgaagtgttgggattataggcatgagctatggagcctggccttcacatgcaatttctaacacctcttttaaatcacagaaatctcactcatctattctttcccactttgaattcagaggcacttgtaactggtcccacaccttttagtattgcaatattattctaagtgtattaattgttttagtctgtttggcctgctgtgacaaaatgccataaactgagtggcttataaacaacagaaatttatttactgcagtctggaggctgggtagtccaaggtaccagcaaattcattgtctggtgaaggctagtttcctggatgatagatggcaccttctcactgtgtcctcaggtggtaaaaagaaaagaactagttctcctggggtctcttttataaaggcactaatcccactgataaggtacccgccttcatgacctaatcatctcccaaaggctctacctcccaacgcctcacattgggggttaggatttcaacatgtgaatttggggaagacacaaacattcagacaataacattaatgttttcttccctacttgtgcagctaagagcttccggaggtagggagctgttttctctcacctcacatccacacatcacacagtttatactttcagaagattgattgattaaatgcatccctcagcctccccaacaaaggccgtatatctactctaaaaatagaacacaaatcctctgtcctttttagtcataatcaatgtgactgttcataaggcaattattttaagtttagcaatttagccataatcccattattgaattaggcttgaaatcttagaaacttcaggatgtttatttgccatggctcccttctaagcaaacatcatcctccaagtctatatcccctccacaggcatcatttctaaggagcaatgttagcttacataatagtttttggaaaatgttttggaaagtatctattctgtttgaggaaaagtatggactcattctcctctctctctcttaagaattcttctcctgtgactatttcctttaacttcagactcaaacagtaattaaagatggcaagaaaaatgccaggagaaaagcccatttaattgtactgttggaataattgttcctgacttctagcttgcccattgtaattttgtgggttggggggaggaaaaaaattagtatcagactgcagcaatctccaaacgagccaaaattataatctggtgagtgcctatttaaagtaacagaatccaaggcaacataagaggcttaattttggctatgcatgttattacctaagagtaggagagagcattatctagtagcaaaaagccaggagcatgaatcaaccactttagatttatactcccctttagagtttacgatggataaaataactttatgtccctgtgtttagcttctctgtccttaatatataagcaaactctctatcattcagcgaaattgttgtctatataagctgaaaaaaacatcaagctcctcaaacaggttgactagtaaataaatggcccaacacaaaaagggtaatctcagttttaatttttttttraattgacagataaaattatatgtatttactgtgtataacaatattttgaagtatatatacatggtataatgactaaatctagctaacatatgcattacctctaatctcaatttaaattggggaaatcatacttttcttttactttttttttttttttttttgaaatagagtctccctctgttgctcaggctggagtgcagtgggactacaggcgtgtgccaccatgtccagctaattttttttgtatttttagtagagacaaggtttcaccatgttggccagactggtctcaaactctagacctcaggtgatctgccaaattcagcctcccaaagtgttgggattacaggcgtaagccacctcacctggccatatttttctttttctattttcaattttaaaaaatgtattattaagtagagacaggacctcaccatattgtccaggctggtctccagctcctgggctcagacaatcttccrgcctctgcctaccaaagtcctggaataacagacggcagacatgagccattgaacttgccccatatttttcaaaagtgaaattttgcaggcacctgtagtcccagctactcagaaggctgaggtgggaagatcccttgagcccaggagttcaaatccagcctgacaacacagcaaaatcccatctcaaaaagaaaaaaaaaggccgggtgcggtacggtggctcatgcctgtaatcccagcactttgggaggccaaggcaggcagatcacctgaggtcaggagttcaagaccagcctggccaaggtggtgaaaccctgtctctactaaaaatacaaaaattagccaggcgtggtggtgggcacctataatcccagctacttgggaggctgaggtgggagaattgcttgaacccaggaggcagaggttgcagtgagctgagatcacgccattgcactccagcctgggaaacaggagggaaacttcgtctcaaaaaaaaaaaaagaaagaaaaaaaaagtgaaattttttctctaaggtagattatacagccgatcctgaacaacactggtttgaactgtgtgggtctgcttatatgccaattttcttctgcctttgctgcccctgagacagcctgttcttcctcctcctcctcagcctactcaatatgaagatgatgaggatggagacttttatgaagagctacttccacttaataaacagtaaacatactttcwcttccttatgattttcttcacattttcttttacttagcttastttaagaatacaatacataacacatataacatacaaaatatgtgttaatcaactgtttatattatccataaggcttgtgctgtacagtaggttattagtagttaaattctgggggagtcaaaagttaaatgcaaattttctacttgaggaagtgtcggtgcccctaacrcctatgttcaagagtcaactgtaattcaagttatacattttaatttttttcttacactagtaaataccagactgagaggattgaaggtttgactcatttcacacatctttgcttgatctccttagctcttataaacattattaaatgtacggtcctttgtgattaaattattatcatacgtgtgatatgaaatagacttctgagttgggcatggtggctcatgcatgtaatcccagcaactcaggagkctgaggccagagcatcacttggggccaggagtttcagagcagcctggcaacatagcaaactccatttctaaaaattatttaattaattcaataagaaaaatttttaaatgactactaaaaaatcacaaaaataatarcatattttagcctttaaaaattagtagagattgggtgcaggggctcatgcctataatcccagcactttgggaggctgatgtgagaggatcacttgaggctaggagtttgagaccagcctgggcaacatagtgagaacctgtctcaacaaaaaatacaaaatccagccagatttggtgccatgtgcctgtagtcccagctgcttgggaggctgagatgggatgtgtagaaagtaaaaagttttctcttcaaaatttcccttcttgttaaagaataaatcataagtgttagaagtaatagtttcttttaaagagtaacttccctcaagcctccttgctttatgctaataactcttggttaagccctatcctatgtagctkctagatataagggaatgagtacattctatgtctttgtactttaaccaagatatttgtttcctttcataagcaacttcctctttttctttgttctcctttgcttttacctatttaggaaagttttaagttattagccagtcaggtttaatttagattgtgaggtccagctccagccaatggagacaggacacattagcagggacaagctgtgtaaggaataaaattgcttccctcctttgttcrggtgtggtctcaccattgttccatctgtgaggagcaccctttctgcagaaggtaaaattgccttgctgagaaaactttttgtctaaatgctgatttttccttgtggtaccaaggaacaagcattctatttctaaataaacatttttggcggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaaaaataaaaaaaaacacaacattttacttctaacaggagggttgcttgagcctggaagatcaaagctgcagtgagccatgattgttccactgcactccagcctgggtgtcacagttagactttgtctcaaaaaaaaaaaaatgaaaatacataaaaatgaaaaatagaaatgaatagagaaaataataggtaaccctcagacatcagttttgaaattttaagttattaagaacataaaattaaaaaaagaacataaaattcaagcttacaatacccacttaagcctttttataaattccctttctacaaatctattatagttatctataaactgaatccattataaataccagtgaaaagagtgagtgaagaatatcttacttagggatatatactatataaggtatagctagaaattttaaaatatggtggagccaccttgtcaacattgttgggtaaaaagtgagttctggagatgcctctaagataacatacggccagattataataaagaaataagacaataacagaatttaaaatgtttaacttttaaaaagttaccaaaaaatggaaagcttataaggttaatatctgaatttaggcactaaaatattgtccatcttgtaatgtattttaaaatgttatcactggctacaggcaggcattagctacacaaacgtagcaattaatgtgacagcagttgagtgttgaggccaaattagagggaattatttattcttgttgctaagattggaagtgtataggaggcacccagaagctactataaaagaggttatggttaaatacacactactttttatattcgtattaaaacatacaatttcacaaaatcctttcaagaaaagcaaccctaaagcaagtgaaaggtagaaaacaattgcaatctcatgtctgttttgaacaaatctcgaataactattgagcttttttcttaaactttttgttatagaaatttccaaacacacacaaaatagaaagaatagaataatgagcacccatgtatctattacccagattcaacatttatcaacatatggcaacatttatcaacatatggccaatctatttcatttacaacccctctgctctcaccccctgcacactagattatttaaaatcaactgttggtcagggcatggtggctcatgcctgtaatcccaggactttgggaggtcaaggcagggggatcacttaaggtcaagagttggagaccagcctggccaacatggtgaaaccctgtctctactaaaatacaaaaattcaccaggcatggtggtgtgcacctctaatcccagcttctcaggaggctgaggcaggagaattgcttgaacccaagaggcagaggttgcagtgggccaagattgtgccactacattccaacctggactatagaacgagactccgtttcaaaaaaataaaaaataataaaaaaattaaaaataggctgggcacagtggctcatgcctgtaatcccagcactttgggaggccaaggcgggcagatcatgaggtcaggagatcgagaccatcctggctaacacagtgaaaccccatctctactaaaaatgcaaaaaattagccgggcgtggtggctggaacctgtggtcccagctactcaggaggctgaggcaggagaatggtgtgaacccaggaggcggagcttgcagtgagctgagattgtgccactgccctccagcctgggcgacagagcaagactccgtctcaaaaataaataaataaataataaattaaaattttaaaaattaaattagaaaaataaattaaaaaatcaactgtcaggccaggcatgatggctcatgcttgtactcccagcgctttgggagcccaaggtgggcagatcacttgaggtcaggagttcaagaccagcctggccaatatggtgaaaccctgtttctactaaaaatacaaaaattagctgggcatggtggcaggcaactgtaatcccagctactcggaaggctgaggcaggagaatcacttgaacctgggaggtagaggttgcagtgagccaggatggtgccactgaactccagcctggggaacagagcaagactctgtctcaaaaaaaaaaaaaaaaaaatcaactgtcagatatcacatcaggtcattccatgagaaaatactgtaatacgtatatctaggagataaaactctttttgtcttttcaaggcacaatcagaattccagtgtcacatctacaaaaaatgaaccccttaatatcacataacatacagtcggtaatattaaaagtcttactggtcaggcacggtgggtcatgcatgtaatcccagcactttaggaggcctaggtgggaggttcacttgagcccaggagttcaagaccagcttgggtgaccctatccctacaaaaaaaatttttttaataaaaataaaaaaataggtcttacttatagtcacatagcttagataatatttagtagtaatataaaatgttttcaaattgaactatataggaatctaaatttttgagattatttccatgtaatacttgaattgtttgttgtattaaaattaccctaaactgaacatataaaccacattcccatgtttaacagataggttggttaattttatccaaggtctaggaatatagcaagttgattacaggacaagaaacagcaaaactgaaatccaacttctctgcttttgaaaataacctctctgaattcagaaaaggagtaatatcttgatagcctacttgctaaagccatggctacttttcaactggtttgtactgctattgttgcactcaatgttaaaatattaaaattcttctgaaaaggttggtaaccagctactaccctgtactcccaacccgaacctaccagattctcttcccccattcctcaaaccctgacttctctgcccctgggaagagcaggcctgggctccccgctccacatccctcttcacatggcatctgcatgtggtctgtacagcaaggtagttggacttcttaagtgcaggtcagggttcccaagagcaaaatgtggaagataccagtctttccaatacttaagcctggacttagcacagcatcacttctgccatattttattggttaatagagtcacaaggccagcctagattcaaggaactatactggggcctgcataccaggagtgtttcatggggtcaagggaggtggaggtaatcaatgaaactggcaagcacaccatgccaaggttcagtatattttacctattgtatgactatctggcagctgagaaaaaagaaatactctaaatggctcagctgtattgcaaactatagcatctttcctaatgcagagttgtacaaactagagtagagagggcttatgaactattttgagtataggagtctttgcagcaacttgatcaaaaagcatacacctagatatggaaatattttgttatacaaactctttgtagatatatgtgttataatgaaatttccaagctgggtaaggtggctcacacctgtaatcccagcactttgggaggccaaggtggccagattgcttgagtccagaagtttaagaccaacctgggcaacatggcaagaccccatctctggccgggcgtggtggctcacgcctgtgatcccagcactttgggaggctgaggtgggcagatcacgagatgaggagatcgaggccatcctggctaacacggtgaaaccccatctctactaaaaatacaaaaaattagccgggcatggtggtaggcacctatagtcccagatactcaggaggctgaggcaggagaatggtgtgaacccaggaggcagagcttgcagtgagccgagattgcaccactgcactccagcctgggtgacagagcgacactccgtctcaaaaaaataaagaaaagaaaagaaaaaaaaaagaccccatctctacaaaaaagaaaaaaaagagactacttctctacaaaaaaattttttcaaattagtcgggtgtggtagcgtatgcctgtactcccagctactttggaggctgaggcagtaagattgctggagcccaggaattcaaagctacagtgaactatgaacaccatgcactccagctagggtgacagcgttagacactgtcaaaagaaagaaagaaaagagagagagagagaaaggaaagaaaagaaagagggaaagaaagaaaaagaaagaaaggaaagaaagagagaaagaaaagaaaagaaaagaaggaaagacggaaggaaggagagaaagagggaaagaagaaagaaagagaaagaaagaaagaaaagaaaagaaagaaagagaaagaaagaaagaaagatctattctcttaaccagacagcatagtatagcagttaagtacaggactctggaggctgcctgtctgggtttgagtcctacctgggctgcttactcactagtggtcttgatttcttttttttttttgtccctttaattttacttttgtcaaaacattttcaagattactttaatttttacaatatcatttaagggaaaactagtgagtttgttgaagaaaacaagaaacagatttttttaaagccattgaccacgaaataagcattatgtttcaaagaccatgaaaaagttatttgtctctttttggtctcaactagcgagggaggtgagaccaaactgctcaactgctggacaatctcagcaaacacacccactgttgagacttattgagtgactcaatgttggctagaattgtccatttagctggaggggaaragggagggaaggatggatggaggagtgaagtatggaagcaggcatcaggccacttcccrtacctctcccaaactccaaaggcaatgatcacattggagggtcagctaaacacaaagggaagtgaagaaagaagtttgaagattttcctgtttccaaaaatcacatactttcctcttttgagtattctatagaataactctctacatttcctagtttgtggaaattttctctayggcataactactctaaattgtgcaattttcctcatatcagacttatttttctctatacctggttccctagcaaacctgagctttatttatatatctgatatgcaccccatctccacagctggcattcaattgcaactctaaattctaaagtgctcagrgtcaatataatgcaytgacgattcagacctgactgggcattttcactgcataaatctaaaaagtaaacaatctcattatgtttgagaggatggatggggagaagactgatctatatttccactaaggtagccaagaaatattcacatgaagggacaatgggagaggagctggcaagrgtttgggcagtacttggaagatgcattccttatcatatagattacatatggcagtgaattgacagaggattcactgggacatcttcagaaagtaagtaatgtgtttcaacaccactaaagtgttaaaataggcytcttttcttctcgccagtatgaaaagttagacaggagtcactcccaagaatagtaaaggacactcactggggacagtcatgatgggtgaagaagggatacatatttttaaggcagcaggaataaatttcatcatccttcccagaagacagcaagaattattcaaggtggccaccaagtctggaaaccaggcaaatcttttaacaaatggtttattgatatgttataatgaatgacaaaatattagtatctaattctagactttatggccaccccataggatgaatctttggaacagaaaaaaaaataaagaatttgttttctcataatcataaagctgttatactcagtccaggcacagctagtacaacattctgctcaaccccacaggctccattccctttaccacatatttataatatgtttgggtcactcataggagtgaaacactgtcagcatcaatagttagcagcactttcaaaatacattttattgtcccgaatagaaaccttaactattcaattagtccagtaattccaaatggtcttattacttctatacataagatatgatcttacaacatttatgtagctaaatacttaacttcccatgctttttgaggattcccaaaagactttagggggttcccaagactttcagggttttttttttttttcacaataaaagaaakgaacagtgtcaatccataaagtcagaccagcagtttaataagatcctcttcatagctcagttctcagtgcatacagagattcaatatagccccatcactctcagttattagaatctgagagggataagagcaataactattgtttaaaagcctaagagtgaaaacagatgtcaaaaaaaaaaaaaaaaaaaagccaaattctttcatcccaggatrtctgaaaaggagagactctatggagtgtggatgtagaaaaggagttattcctaccggaaaaaaatgaactgtggacacagtcactcaagaccagagaaacaaccactatgagtaagtagcttcaatttcactgttaccaggagggcacacaccagaaagcctgggacaaagcctgggctagagccctcaggattcattctcaggcttcctggtgctgtggttcaacagcctttgtggggatggggagaaccagagactatcaccatcacatgtaaaaaatattaccacagcaacagctgtcaaaaaccagctggagctgaagttacacaccatttgaaatccacactgtacttgctttcttgtgatgggcttgagacatgtgcagagacaccttaaacatgtgtaggtgaccacccttttgaaaggcagaggagggcctcttcatgaactctttctactcatttgttttcctatcagttcaccatttcaactagaaaagatgctgcaagctacctcagctagcttctaatttggacacagcaccaatactacacacactattgaatgaatgaccacatcttcctggttcttccwttgggcagggtcaatatgcttctttggactgaataggtgtgatcttgtttgagaaaagtgtgtaaacgtagggccagattttgttcgtctcygttccggaaaattggtggagcactcctyggctcttgtataattcaatgactggctttgccgcgtctttgtactgtcttagcctggcagcaactgcttcgggtttatcatcctcctgctggactaayggttcaccagtgacrtcatcaataccatgtacatgaggtggattgaagtccaggttatatacccttccgctaggagggtgaatccaacggcggctgagacgatctttaagtgtttcaaatggaatattcaaactgatcactagatccacttcacagattttgtccagggcytcggcttgtcctaatgtcctaggaaaaccatcaaggagccagtgctgkccacgcctattctccaactcrgacatcattaggcgtgtgatcacatggtctggaaccaaaagacttttctctatatactgctttgccayctcaccaacttcggtgctggccttgatgttctcccgcaagaagtggccgctggagagatgctggagaccaaagttctgggcgatcctctggcacacggtgcccttgcccgagccgggcggcccgaggatgaccgcgcgcaggagtttggaagccattgccttcgcgaggaggggggcggtcaaacgcgcagccccgaccgcggccccggagggagccccrggaactttgtttctcggccccctacctctggcaccctccgctctcactgggactcgccggccgsccctacagggggaaggcggtcttgatttcttaatctcatgcttcagtctcctcacctgcaaaatgagaatggtgataataggacctacattagggatgtgatattgtgaaatatttatttggtcttcctaccatctcctggcataaaatctttggaatctcccaagtgataagtgtctttttgtaacctaatgagttgactgatggctggcagcccctaggtggcttcaggatggaggttgggcacgtgaaagaccaagacaaaatcagagagttatgattttcagccctatccaacttctgggaaggggaaggggctgaaggttaagttaatcctgacggccagtgatttaatcaatcatgcctacataatgaagcctccataaaaaccccaaaggtctggctgggggagcttctggatagctgaacacatggaggttcctggagggtgcctctcaccccacatagggcatggaagctctatgccccttcccataccttgccctatgcatcctttcaagtatcctttacaatatatatatatttttgagacggagtcttgctctatcaccaagctggagcgcagtggcrcgatcttggctcactgcaacctccagctccctggttcaaacggttctcctgcctcagcctcctgagtaactgggactacaggcacgtgccaccatgcccagctaatttttgtattttttgtagagatggggtttcaccatgttggccaggatggtctygatctcttgacctcatgatccgcccaccttggcctctcaaagttctgggtttacagacgtgagccaccgtgcccrgcctttttactttactttattttattttatacagagcctcactctgtcatccaggctggagtgcaatggcacaatcttggctcactgcaacctctgcctccctgttcaagcgtttctcctgtctcagcctcctgagtaactgggatcacaggcacctgccaataatattctttataatraactgataaatgtagatatgtatttccctgagctctgtgagcagctctagcaaataaatcccccaagaagggggtcatggaaccstgatttatagttggtaggtcagaagcacagacaaaacaacctggggcttgcaattgcaytggaagtgggactgagtcctcarcctatggcatctgacactacccaagtagatagtatgagaatcggattgaattagaggacctgccccccccaccccctgctgccaccaccaccacccagctagtgtccattgcagaatttttcttagacagggtcttgctctgtcacccaggctggagtgcagtggcatgatcaaggcttactgcagcctatcaacctctcaggctcaagaggtaatcccacctcagcatccctagctgggaccataggtgcacccccttgcccttccccctaattttttttatttcttgctggtggagagaaactcccacacatttggtcacagaagtcttctgtgagactggtgtgagagcagaggaaaaactgttttttctactcaatgggttattgataactaaattagttaatgtctgtaaagtacaggataatgccaccgagtaactactaggtaagcatttattaaatgaaacaccaatttcaggttaaaaaagaaacctgaaatgttgattctgttgaataaaaagtataggagrttgtttttttggattargtttctgtactakgctccaacagacaaaaccaaaaatcaaaatggagtcacccatgctaaagttctgtcaccaaacttcaataagttgttatctgatcttcagagtgagaccagtgggctgggggaagttcccaaacactgatgaaaccctgacccaggccagtgtgcaggttcttgataccatgatgagaaggaattcaaggatgagtcagaaaatcgtgaaagtacggagatttattgcaaagtaaaaatacacactcaagaaaggggagcatgggcatactcatgagagagctgcacaaaggggcttggggtttcttatatgrgtttctttacccaaggggtggactattcatgaagattcctggaaaaaggtgaagatttctcagaactgtgatgctgcccattttaacaccaaatacagtgttcttgtcacagtgtaggtgggtgtgcgatttgtttattaatgrgtgaataatgaggtcctaggagaaacctaggtcaaatcctgctctctgttgggtccagttggttttagccagcttggcccacatcctgtttttcatggtcttatcagtccccagtttatggagctatttcaacagtttcattttgctaggcatgtgaaactgctgcctggaattttctgttctcttgcaaccaccctgtattattcctgtctcaagagaaagcaggagagagagatagccaaattcccaaacaggtcacttaatcttcaagagtcacgataatgagtttccctctgctttaatcctttcacacacagaaaaagtagccccaagaarcctgatgttaactaatcagttatttttctgttgttctatctccttgtctcatcttacaagaaaagtcactttgaaacaatggacataatctttgcttcttcttttttttttttttttcctgagacagagkctcgctctgtcrtccaggcaggagtacagtggtgccatctsagttcactgcaacctccacctcatgggctggtccaccatgatcctcccacctcagcttcccgggtagctgggattacaggcatgggycaccacacccggctaatttttgtattttttagtagagatggagtttcagcatgttgcccaggctgrtcttgaactcrtgacctcaagtgatccacccttctgggcctcctaaagtgctgggattacaggtgtgagccactgcacccagcctgcttctttcttcattccttcttgctctgtgaagccaatgccttctgctcagctcatgattctgttttgtggaacaaagtgttacctgtttctagaattgcaaataaagccaattgagatttttttttttttttttttttggcagaktcacactctgttgcccaggctatagtgtagtggtgagatctcagctcactgcaacctccaactcctgggttcaagggattcttccacctcagcctgccaagtagctagaactacaggtgcacaccacyatgcccggctaatttttgtatttttagtagagacaggatttcaccatgttggccaggctggtattgaactcctaacctcaagtgatttacccgcctcagcctcccaaagtgctgggattacaggcatgagccaccgcacccagcccaactgagatatttaaactaaacttgttgtaactttgtcttttgacaagtctaagaatatcagtaatttttttggcaaccagtagatagccccttccctttttttaacttcccaaaaggcaattgaaccaaatcaaaataatttaccaagatgtaatctaaacacttccctcattcaggttttccccagttattaactatgttaacataattagtggctatgccaactcatgatatgttctttttttaaaaaaacrtttctgtagccaggcatggtggcagatgcctgtaatcccagctactcaggagtctgaggcaggagaatcgcttgaacctgggaggcggaggttgtagtgagccgagatcatgccacttcactccagcctgggcaacaragcaagactttgcctcaaaaaaaaaaaattgtttttgcrattatttaatcagactttcttaagactttgacctttatgcacttttaccttccttaataactcttcaaaagaggccttgaaaaaaatgcaatgactagcaagttatgggagtactggaatgmaatgactgttcaaaggttggtttcacccatagccatgagtgtcatagtcccaggaagatgggttgaattcagggccactctaggaattttgcttgcrgtttcataagcatagactattccagactccacatcctttttacctacaatgagtcccaaggcaaacagaacactgtgaagtgggagaccagaattaatctagttctcgtcagagtattctaggataaattcccaggccaaattaccactgacaattttagaaaccctggattggataaattcattatgataaagattaaaatatcaccttatgtttatgtgtcgtgggagctttttttttttttttttttttttgrgacggagtctcgttctgtcgcccaggcgggagtgctgtggcgcgatctccgctcactgcaagctccgccttccgggttcacgccgttctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgctgggattacaggcgtgagccaccgcgcccggccgtcgtgggagctttttaaagggttttcagtcttatgaatagtctcagcaatattgaaagactaatatattaatagtaattattgcttcatgttaatcagcattccaaagataaggggtcaaaacaggttattaattataaatatctgtggctcctctggcctggaagtttctctgaatctgagtgaattagagtgtaatgagtgtcccctttgccttccctgcacttagtacatgtacctaccaagtattgagyactgaccattaaaattgtaattctcttcttttcttctcatttttattttttgtgatgctataacaataaagaagaaaatctaaggcttacataatcttaccacctcaatgcaattatctccatttccactgatttccttccagactttgtccagatgcatacaggcttttacataattatcatcacagtgtatgtgcttcttaattttactttttctccatttataccaactttcattcaaattgtttcataatcatcttaattactacagcttcatattcctgttagttggtatgtgataatttacttagctatttatctatcaggagacatgtaggttttttccaaattttttccctactaaagttgagacgaacttttctgttcttatatattccttggattatttctacgtaatacatttataaggatatgattataggttgtggccaggcacggtggctcacacctgtaatttcagcactttgggaggccgaggcrggtggatcacctgaggtcaggagttcgagaccagcctggccaacatagcaaaaccttgtctctactaaaaatacaaaaattagctgggggtggtggcgcatgcctgtagtcccaactacttgggaagctaaggcaggagaattgcttgaacctgggaggcagaggttgcagtgagctgagatcgcaccactgcactccagcctgggcaacagagcgagaccctgtctcaaaaaaataaataaattatagcttgtggyagattgtatgttccaaaagcagccacaatatcctcctgatcctagtgctcttctgcaatgtgatcttgtcactctcctttgaacctgggccctgtgactgctttgaccaatagaatatggtaatagtgacattgcgctttttcaggtgcagcccttgtttggcctggtaacatctacttcccacttcggcgaagtgcaactattctgagagcccccatgctatgagaagtccaagccacatgaaggggccctaggggctccagtgctaggtatagaacaagaaaagctccagagcatttgagagactgtgaggaaagacaccacctgggaagtgcatgttccagatctcattacccgacagaaagccaggcagacaaactgtctagcagagcccttcccaaatttcatactcacaaaactgcatgcaaaataaatggttatataggttgaacatccttaatctgaaaattcaaaatcgtaaatgttccagaatccaaaacttttttgagtattaacatgatgccacaagagaaaaattccacacatgacctcatgtgatgagttgaagtcaaaacaaaggctgacagcacacagtttacttagcattctcagaggaaaaaagaccctcccagtcctcttcagctgtgatatcttttctgcatctgttcagattccttcgtgcaagcgcatccacaaagcataataaaataaaaactttgtttcatatacaaaattatttaagatattgtatgggctgggcgcagtggcttacacctgtaatctcagcactctggggggctgaagtgggcagatagcttgagcccaggagttcgagaccagcctgggcaatacagcaaaaccctgtctctaccaaaacaataataataataatacaaaaatttggctgggcacagtggttcacacctgtaaccccagcactttgggaggctgcagtgggtgaatcatctgaggccaggagttcgagaccagcctggccaacatggtgaaaccccatctctactgaaaaaacaaaaatgagctgggcatagtgctatgcaccttaatcccagctactcgagaagctgaggcacgagaatggcttgaatctgggaggtggagttttcagtgagctgagatggcaccactgcactccagcctgggcaacagagtggcaccctgtctcaattaaagaaaaaaatacaaaaattagctgggcaggatggcatgggtctttagtcccggctacttgggaggccgaggtgggaggatcactcaaacctgggaagttgaggttgcagtgagctgagatyacacccttatactccaactggagtgacagagcaagaacctgtctcaaaataaataaataaatgattaaaaataaaatattatataaaaccaccttcggtctatgtgcataaggtatatatgaaacataaatgaatttcatatttagacctgggctccattcccaacagatctccttatgtatatgcaaatattccaaaatctgaaacagttctggtcccaaacattttgcattaaggatactcaacttgtattaagccgtcaagtctgtcagtagttacctaatataaaggtacttgaracacaggtcaaaagataaattttcttttcccacacactggcaagagtttctaatagattgatcctgtttatacaatttgcagtgcccttaaagagtctgtgcttttcagggtgcaagccttagaagactgttctctgccctgagtctgagtttcttcatttaaggtgccatagtgtccagctttttagagggcatttaaattttgcctcttttctgagtaggtaaccccttactctggaagtcctccactaattttcttatcttcaccagctctagttttcttccttcttgttctccctaattctctctcatcttctgctctgctcatcttcaaacaaaagtaaatgctactcagctgggtacagcggctcatgcctgtaatcccagcactttgggaggccaaggcaggcagatcaattgaggtcaggagttcgagaccagcctgtccaacatggtgaaaccccgcctctactataaatacaaaaaaatgagccaggtgtggtgacagacccctgtaatcccagctgttcaggaggctgtggcaggagaatcgcttgaacctgggaggcggaggttgcagtgagccaaggtcgcaccactgcactccagcctgggtaacagagcgagactccatctcaaaataaataaataaaataatasctactggtgggaatggttattcatgcctgtaatccagctttttgggaggcagaggcagggggatcgcttgggcccaagagttcgagtgagctatgattgcgccactgcactccagcctgagcaacagaataagaccccatgtcaaataaacaaacaaaaactgccacaaagattataaaataataatcacaatcacagtaatacctaccatttatctaccttaatttttttttctttgagacagagtttcgctcctgttgcccaggctggagtgcaatggcaagatctcggctcactgtaacttccgcctcccaggttcaagtgattttcctgcctcagcctcccaaacagctgggattacaggcgcccaccaccacgccctgctaatttttgtagttttaatagagatagggtttcaccatgttggccaggctggttttgaactcctgacctcaggtgatccacctgcctcagcctcccaaagtgctgggattacaggcatgagccaccgagcctggcctctctaccttaaatttaaacacatgaagttttttttaactcacttggcgaaaggaaccaggaaggaagctgaaatatctgtgtataacttaatggtacattaagataaaagcttgattcacgaattcattcaaaaaaactttttgaggccgggcatggtggctcaagcctataatcccagcactttgggaggcaggaggatggcttgaggccagaagttggaaataagcctgggcaacagagtcagaccccatctctacaaaaaagcagacaacaacaacaaaaacaaaaaccttttgaacacctattatgggttaagcatactgattctctcaggtaggactctgagtatgcagtatagaaaactagctcaaattggattaaggcaaatgggaatttattggctcgtggaatggaggaccagtttcaggagaggcctaactcagggctcaacaatgtgaaggggaaatggatttttctgtttcttggctgactgctcttctctgtgtgctggtttctttctcaggctccgagcagttggtcgaagtagcagctctcgactcagcctctgaggctcaagttcaatgagagggagcgagagagaaatcgttctagggagctgcagcaagacctaggatccaacgagtggaccatcttagatggccccatttctgaggtgcccatttctgaaccagtcccagtggccaggggtataagcatgttctgattggcttaggcttggacacatgttccacctctagagctgagttggctttatctggagtacagggactgaaagtggggaacagaagtctccccagagcaaaataggagtactctaagatgtggttgcaaatcagcacaccccacctatctctgtttgactactatttatgcrttctcagcagacataaatgtgttaagagtagtagatcggccgggtgcagtggctcacgcctgtaatcccagcactttgggaggccgaggcaggtggatcacctgaggtcaggagttcaagaccagcctgaccaatrtggtgaaaccctgtctctactaaaaatacaaaaattagccrggcaatgtggcatggacttgtaatcccagctactctggaggctgaggcaagagaattgcttgaaaccgggaggcagaggttgcagtgagcccagatcatgccattgcactccagcccagacgacagagcaaccctccgtctcaaaaaaaaaaaaggtagatcacaaccttctttgactaatactctatccacacccactcccctatttaaccagtgtgtcccctctaagaatctttatcctcatggttcacatggtgtattagtctgttctcacrctgctaataaagacatacccgagaccgggtaatttataaaagaagtttaattgactcacagttctacatgactagggaggcctcacaatcatggcagaaggtgaatgaagagcaaagtcaagtcttacacggcagcaggcaagagagtatgcccaggggaactcccctttataaaaccatcagatcttgtgagacttactcaccaccacaagaacagtatgggggaaaccacccccatggttcaagtatcttcacctggctccacccttgacacgtggggcttattacaactcgaggtgagatctgggtgggacacaccatatcacgtggccacaccatatcacatggctttggaacccttcagggtactgggtgcatggatatgtgtaatgttttattgcttctcttttgaggtgccacaaaatacccttctctgcttggagaygcaggctccaggaaaaggaaggagaccaacagatgagaagtgacttcttttcttccacttctaggaaaatacataattagaaccttccaagatgtaaggaaaaagggccagatttagatttccaaatgtggagtgacaagtattttacaaaatgagggagttggattagataactcactaaaggccctcctagttatcgaaggattctattattcacatcctttcttttagaacagcagtgtttgttttggtttcaataaggggagagggcatgggctcctgaagtggcagggaggaggggaagagatggagcagcgcaggcaggggcaagcggggactgtgagacaaataacacccatttcccagttttagttgtcaggcggctgctcttcactccccacttggattttgagcattttcacaaatcttcagaattagttcaaatcatcaactcgtacttggtagctttattcccttggctcttgaaagggaaagtaaatcaaagcttgtctgcccagaacctggcaggagcatttaataaagatgttcagcttggcgcagtggctcatgcctgtaatcccagcactttgggaggccgaggcgggyggatcacttgaggtcaggagtttcagaccagcctgaccaacatggtgaaaccccatctytactaaaactacaaaaattagccgggcatggtggcgggcacgtgtaatcccagctactcaggaggctgaggcaagagaattgcatgaacctgggaggtggaggttgcagtgagcccagatcatgccactgcactccagcctgggtgacaagagggagactgtytcaaaaaaaaaaaaaaaaaaaaaaaaaaagatggtcatggtcatcccagggtgggggcaggcttgaggactctgcggtggtctctcaggatctactccagatccaggctggcttccagaaatactgcaagtggtaagaatgccaagatttcccagctctgttgcagaatgaattagtggccctcaagtgaagtcactgcagaacaaaaggctataaaaagagagaaaagaatgagggggagatgttataggtgcaaactggcatggaaagccctgcaacgcaagcaagcaagatgtttgaattctcccaagagaggcagacaaagcaacacaggaaaacatttagacatccatgaaggcagagagaatcctgaagcggaagtctgtcagtgagcagcatttcagtgctgagccaaagacagggaattggccaaagcaccaggaaagagagctgcaggccctcagtagctggtcaaccaatatgggttgaaacgaagtctggtttcagcatttgtgctgatgttgcctcattttacgttttttagtttttgttttgagacagagttttgctcttgtggcccaggctggagtgcaatggtgcaatctcagctcactgcaacctccacactgccccgccgccaggttcaagtgattctcctgcctcagcctccctagtagctgggattatagacacgcaccaccatgcccggctaattttgtatttttagtagagacggggttttaccacgttggccaggctggtcttgaactcctgacctcaggtgatccagccgcctcggcctcccaaagtgctaggattacaggtatgagccaccgcgcctggcccattttacattttatttctcattgatcacttgcaggtcagagagtcacacaagctacagtcccaagcacctatgttctaaacggtgcagcttggcaagggagtcacaaataaacatgcccctttccccagtttcctcttccaaatagtcctgaccctctatgtaaggacccagaagtgcctcaagtcgtgttaaagcctacatttcactcttttatctgaaatacaatttgagaaataggaaatgcatgatttgtaacctgacaaagttgaattttacctgagccttgtgggcctggtgaacagtgaaggttaagaaatcccccacccagatcacaaggtcgggagatcaagaccatcctggctaacacagtgaaaacccgtctctactaacaatacaaaaaaaaattagccgggcgtggtggcgggaacctgtagtcccagctactcgggaggctgaggcaggagaatggcgtgaacccgggaggcggagcttgcagcgagccgagatcgcgccactgcactccagcctgggtgacagagcgagactccatctcaaaaaaaaaaaaaagaaaaatcccctacccgggctgggcatggtggctcacgcctgtaatcccagcactttgggaggccgaggtgagaggatcacctgaggtcaggagttcgagaccagccatgaccaacatggtgaaaccctgtctctactaaaaatacaaaaaaaattagccgktgtggtggcaggcacctgtagtcccagctactcaggatactgagacagaagaatcgttggaacccagaaggcggaggttgcagtgagccgagatcaggccactgcactctagcctggcaacagagcaagactcagtctcaaaaaaaaaaaaaaaaaaagaaaaagaaagaaagaaagaaagaaagaaagaaagaaagaaagaaagaaaatcccccacccttcatgttctgcaaaagggcttactgcaaagaccaccccccaacccttccasatgtcacttcagtaagactcacagatgctcttcttctttacctatgttaagaccagacacagaccctcaaaatttcctttctttgcctcacagatgattagctgaactgcttgtcctcactgaagaactagagcaaaatacatgttacccaaactttggttaggcttctctccttcctcagagcctcagaactttgtttacccttggcctgagccccttcagagaacagggtggcttcagggccaaacattccaatttgctcgatttgttactctttcatctgcttcccayatctggttcatcctagccttgtttcctcctaccatagagaaaccctttgcaacctttgagatgtttacagaccttccagtcccagcattcccctccctccattgcaggagtacccccgcaaygccctggcaataattccttcgaatgaaggtctctcttttaccacatccagaattttttttatttgacaaaccagaaatggaagacaacccatcagctcgtcttctgagctccttctagcgccaggaattccatagaaaccrcatattgtttgattcctcagcccccrgatgggttgccagagtgcagtgggacttgccaagagaatgtgacctctgacaaacaatgatatgggtagagagcctaagttaaatgcttatcatgtgctaggtactattttatgtgttttatgtttgttrtcacatttaattttcccaatttccataagaggaaagtattatttttagccctgtcttataagacaggaaacagaggctctcagttaaattagtcaaggtcacacagccagtgagtgacagagctgggacgcaaatgcaggtcagtctgaggccatggttgggcttgtaatcaccatgctatgggctttcctaagaggcggcttcttggaaatgctcctttcggtgtctggtatctctggatagaagcgtgtgaaaaagaaactgtcagctgggaattagccaagcacaacagccagagtatggtgtccacctgccgaacactgagggaaaccaaaatatttctccccaaaatattgaggattgttagttgaagacactaaaccgcaggggaccgctgtgcctcagcctctgtgtgcctgatggcggggcataaatccttccttattggagacagcacttgctttttggcccagagaaggcaccagcaggcaccagcggaaactgggaacagattttactctcttcccacatgtattagtcaggattctcttagagggacagaactaataggaaagagatagatagatagatagatagatagatagatagatagatagatagatagatagatgcatacatacatacatacatacgtagatagatacatagatacatggatagatagagataaagggaagtttattaagtattaagttacacagtcacaaactcccacaataggctgtctgcaagctgaggagcaaggagagccagtccaagtcccaaaaatgaagaacttggagtctgatgttcaaaggcaggaagcatccagcacggaagaaagatgtaggctgggaggccaggcctgtcacacctcttcatggtttctgcctgctttatattcattggcagctgattagattgtgcccactagattaagggtggatctgccttccccagcccagactcaaatgttaatctcttttggcaacacctacacggacacacccaggatcaatactttgtatccttcaatccaagcaagttgacactcagtattaaccatcacaccatatttttccgcctttgaaaagactggaactgctctctctttcatcttgtcactatgtaggatttatggctctttgttaaactatgatttaagcaaagcccctaagccactgccttgagagagaaatacttttgaactgaggcctctcccgtgtgatgggtactgcatgcattaataaatttctgctttttttttttttttgttaatctaacttttgttttcaggagagtatctcaactaaaaacctaaaaaagaaaaggaaaaaatatgttttctcccccacaatgtgcacctgccaaacagaccatttcacagcaaagcaatgcgtaacacaatggagtgaaacaaagaagagaccagtgtgtaatcatgcccatgccctcagcacagacagaaacaagtgcacgtactgtgtaaactacagaagcgaccaaacacctccctttcctggctactataagcagctgaggcttctttatcaatgaggttttgagtggggcttggttcctgccactttctaaataaaaatcattaagatactcaatcaccaaattgcccacactatctgactgcacccagtccagagcaggcctcgctcggctsagcccttccccaagtcatctaacataaactcaaatcctactataagcccctcctaatggcctcttacctagaccacacttccctagggtgtgtaaacccaaatcataaagctgactctcgctgcagatgaactaagggactggtgagcttcaacacaagcttggccccatctgcgcacctgaacgcaatgctttcccatgcgtctccccgtggatacatcccgtaatggagggtgctctgacttcagctggttcgggaaaggccactcctgggattgcttcctcttttctgcccagcatttcttcttcttcttyttttttttttttttgagacggagcctcactctgtcgcccacgctggagtgcagtggcgcsatctcagctcactgcaacctctgcctcccgggttcaagattctcctacctcagcctcccgagtagctgggactacaggcatgtgccaccacrcccggctagttttttgtatttagtagacatggggtttcaccatgttggtcaggctggtctcaaactcctgacctcaggtgatccacctgcctcggcctcccaaactgctgagattataggtgtgagccaccacacccagccttytttcttctttactctcccaactcctccactgcaactcccattctacagagaaggcattatctcctttgggctaatgttttaccatactgaaaagacctctctaagttagtcctcttcacctcagtttcccagctgggaaagctcaagcccaggcattgtaggtccctgtggctttacgtacacctgaaagtggcagggacgggtcagcagagaccctgatcctaccattaggttctgaatgggaaaaggaactacagaagcatctccaccaaagctcttcttsccaaagtttacttctgtattgtttaggccttggaggtaaaggataaaattgtccagacagytaattattttcttcaggtggctgaggtaggaggatagcttgagtccaggaagtcraggctgccatgagctatgattgcaccactgccctccagcctgggagacaaagcaagactctttctctaaaaamagaggwaaaaaaaaaaaaaggaacgagattgtgtcctttgcagggacatggatggagttggaagctgttatcctcagcaaactaacacaggaacagaaaaccaaacaccgtatattctcgattataagcgagagctgtacgatgagaacacatggacacatgggggaaacaacacactggggcctgtcgggggatgggaggagggagcgcatcagggagaatagctaatggatgctgggcttcatacctaggtgatgggatgatctgtgcaggaaagcaacatggcacacatttacctatgtaacaaacctgcacatcctgcacatgtaccccagaactttaaagtcgaaaaaaaagaggccgggcgtggctgttcagacctgtaatcctagcactttgggaggccaaggagggcagatcacttgaggtcaggagtttgagaccagcctggccagcatggtgaaaccccatctctattaaaaacacgaaaattagccaggcatggtggcaggcgcctgtaatcccagctactcaggaggctgaggtaggagaattgcttgaacctgggaggtggaggctgcagtgagccaagatcgtgccactgcactccagcctgggcaacagagcaaaattccrtctcaaaacaaaatcaaaaacacataccatcacaccggagattagggcttcaacagagaaattttgaaggaacacaattcagtccatagcaagtagtacagtggtttttaaaaatttttatttttaattcaaatgtaataattgtacatatttatagggtacaatgtgatgttttgatacatgtatatattgcgtaatgacaaaatcagggtaactagtacactcaccacctcaaagattaatttttttttgtggtgggaacatacaaaatcctctcctctagctattttgagatatacaataccttattgttggctacagccaccctactgtgcaatgggatgygagaatttattcttccttgttaattttaactttaaaagtttatttttggccgggcacggtggctcacgcctgtaatcccagcactttgggaggccaaggcaggtggatcacctgagrtcaggagttcgagaacagcctggccaacatggtgaaactccrtctctattaaaaatacaaaaaaattagtcaggcatggtggcaggcacctgtaatcccagctacttgggaggctgaggcatgagaattgcttgaacctgggcggcagagtttggcagtgagccgagatcacgccactgcactgcagccttcacgacagagcgagactctgtctcaataaaaagaaaacaaaaagtttatttttgttgtaacattcttttattatttctagaggcatgtaacaatgtgctatgtaacaattcaagactgtggcccagatgaaataatgatagcagcacatatctggaacttctttggtcacatgaatgcataataaatatatgaagtggaaactcaattctacgtagtatgactacagcagactaaagacaataatcaggccgggtgtggtggctcacacctgtaatcccagcacttcagcactttaggaggccaagaccagcagattgcttgagctcaggagttccagaccagcctgggcaacatggcaaaacccyatctctacaaaaaawacaaaaattagctaggcatgctgatgtgcgcctataatgccagttactttggaggctgaagtgggagggaggtggagaccatagggagcagagatcacgccactacactccagcttgggtgacagagtgagaccatgtctcaaaaaaaaaaaaaatgcaatgaccaccaaaaactactctctgcagtaacatggcaatgaaaatagatgccattgttatgtactttaacttctactatgattatttgacatgagattcctttcctttgctttcctttttttttctttttccttttcctttcctttcttttcctttctttttttggagacagggtgggtctcactctgttgcccaggctggagtgcartggtgcaatcttagctcactgcaacctctgccttcctggctcaaatgatcctcttgtgcctcccgagtagctgggactacaggtgcccactaccatgttcagtgattttttttttcctgcagtttttgtagacagggtttcataatgttccccatgctggagatttctttctttctttttttgaaaaacaaaaaacaaaaaaacaaagtcttgctgtcgcctaggctggagtgcaacggcacaatcttggctcacttcaacctctgcctcccaggttcaagcgattctcctgcctcagcctcccgagtagctgggattacaggcttcgtgccaccccgcctggctgatttttgtatttttagtagagatggggcttcaccatgttggccaggctggtctcaaactcctaacctcaggtgatccacccrcctcggcctcccaaagtgctgggattacaggcatgagccaccatgcccagccttttaaatttattttwaaaataaacgtatttcttacagttctggaggtttgaaagtccacagytgttgggctgcatctggtgagggccttcttaccgcagcataacatgacagagagcatgacagggcaagaggccattttcttgtctgagagtttgatttagtctagaatctgaccccatcttgacataaacaccactggctcagataaatattaagtgcaacagtttacctaatttagttatttatttgtattcttttatttttattttatttattgagaggggttttgtcatgttgcccatgctggtcttgaactcctggactcaagcgatcctctcactttggcctcccaaagtgctgcgatcataggcttgaactaccgcgtccagctagtttatctaatttaaagacatcaaaatctaaagtcagattcttacttagatttggtgtttcagatttcaaagagatgagatgtcaccagataaaaactactaggtggtaaccaggcgtggtggctcacgccgtaatcccagcactttgggaggctgaggcgggcggatcacgaggtcaggagttcaagaccagcctggccaacatggtgaaaccccgtctgtactaaaaatacaaaaaaaatagctgggcatggtggcaggcacctgtaatcccagctactcgggaggctgaggcaggagaatcatttgaacccagtaggtagagattgtagtcagacgagatctcaccattgcaccccagcctgggcgacagggtgagactctatctcaaaaaaaaaaaaaaaaaaaaaaaaaacgaccaggtggctcacgcctgtaatcccagcacttcgggaggccaaggtggaccgattgcttgagctcrgaagttcaagatcagcctgggctacatagtgaaaccctgtctctaaaacaaacaaacaaacaaacaaacaaacaaacaaaaaacaaacaaacaaagcttagctgggcgtgatggcgcatgcctttagccccagctactcaagaggctgaggaggraggatcacttgagcctgggaggcwgaggctkcagtgagctatgatcgtgccactgtaccccagcctgggtgagagagtccctayctcaaaaaaataaaaccaaaaaactactggggccacgtcagaactraaagagttctgcaggcccttcagagaaaggagaagtgagagtcaattaacctcaagattacatttaaaagcattttcctctttagtatagaggtgtgttaaaaaaaaaaaaaaaagcatttatacgaggtatgttagtgaaacagcaaaaacctaattatatcctaaataactggcacgctctaggttacaaatagcaatttgtaaaagacccattgaatgaacacattaaacagcaggttgcttattccttctcaaaccgcactaaaaaattcctctctcgcatgtgtaggtcccagagccagacagttatgagatgatggtgccccctggtggccaatgtggggagccacccggccaggcgtgcttcctggctttgtgccagccatgcctttattctttggttggttggttggttggttggttagttggttggttggttggctggttgagacagagtcttgctctgtcgcccaggctggagtgcagtggcgatttcggctcactgcaacctccgtctccgaggttcaagcaattctcctgcctcagcctccggagtaggtaggactacaggcgcccaccatcaagcccggctaatttttgtatttttggtagagacgaggtttcaccatattggccaggctggtcttgaactccagacttcaagtgatccacccgcctcwgcctcccaaagkgctgggattacaggcatgggccaccgtgcccggccagaccatgmcttkacttttgcacatatgcacagtatttctgaaaatcaagtgaaaaagttggatttatatactctatgtgagtttacatgttatggggatttccatttccagagaattaaaatggataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctcactgcaacctctgcctctcrggttcaagtgattctcctgcctcagcctcctgaatagctgggactacaggcctgtgccaccatgcccagctaatttttgtatttttagtagagacagggtttcactatgttggccaggctggtcttgaacttctgacctcaggtgatccacccatctcagcctcccagagtgctaggattacaggcgtgagccactgtgccggggcagyaggcctttcttgactgcagattttctaatacatgaaaacagccaccaattgcaaaaatatattaattttcgacaggtacaaaaggcactttgtgaatatcagtatgcagttgggtacacttatccggaattaaacctgtctctcctggagctacatgccacaggcatctcacacagggrccgctgttctggaacactcctgtgagccaataaaggatcaacagcttctcttcaggccaggcgcagtggctcacacctgtaatcccagcactttgggaggccgaagggggcggatcacctgaggttaggaattagagaccaacctggccaacatggtgaaaccctgtcwmtactaaaaatacaaaaattagccaggtgtggtggcgggcgcctgtaatcccagctactcaggaagctgaggcaggagaatcacttgaacctgggaggcggaggttgcagtgagctgagatcgcaccactgcactccagcctaggaaacaggagtgagactccatcttaaaaaaaaaaaaaaaaaaaaaaagcttcttttcaagaaaaagccatccagtgaatgggtaccactcacaaaatgaagttactgtttttttttttgtttttcgttttttgagacggagtctctctctgtcgccgaggctggagtgcagcggcgcaatcttagctcactgcaagctccgcctcccgggttcacgccattctcctgcctcagtctcccgagtagctgggactacaggcgcctgccaccacacccggctaattttttttttttttttttttgtatttttagtagagacggggtttcaccatgttagccaggatggtctcgatctgctgacctcgtgatctgcccgtctcggcctcccaaagtgctgggattacaggcgtgagccaccacgcccggccttaatattaagcttgttttgctatagagttgaaactaatttgtttgcagattgggcacaaactctctccccctgcaaaaccaaattgttcggtaagccatgagttacctctttcatcgacctcaggcttattttggcatattcaataggctgatttaagcctttggagccacttctataagtagtctgtaagaaataacacaccttagctgggcgcggtggctcatgcctgtaatcccagcactttgagaggctgaggcaggcggatcatgaggccaggcgtttgagaccagccttaccaacatgaggaaaccccgtctctactaaaaatacaaaaattagccgggcgtgatggcaygtgcctgtaatcccagctactcggratgctgaggcaggagaatcccttgaacccgggaggtggaatttgaagtgagccgagattacgcgccactgcaccccagtctgggggacagagacagactccgtctccaaaaaaaaaaaaccacacacacaaaaaagaaatatcccttctccaatgcaccaaagggataccagtcactattccttttctttctacactgaagctaagaaatgcctttttcagttaatccacaaacaaatgattaacatccctactttttttttttttttgagatggagtttcgctcttgttgcccaggctggagtacagtggcgtgatctcggctcactgcaacctctgcctccccggttcaagygattctcctgcctcagcctcctgagtagctgggattacaggcatgtgccaccacgcctgggtaattttgtatttttagtagagacggggtttctccatgttggtccggcttgtctcaaactcccgacctcaggtgatccacctgccttggcctcccaataacatccctactttaggctacaycatatataatgagtttagttggttaatggctacccaaattcaagtagtaagcaaagtacctttatgccttgagaggcatgaaaacagcagcctccaggctgaaatatataacatggatggctgccacccaaccaacgcaatcaaaccctccccttaactgatcagatgtggataggacagcaaaatacatctctaagattgggtgcccattcctctccttggggatggttatgagcatgtgagtctcacagttgaccatatccaccttacagttggactggacaatacacttgrgactgtccttatctcccaggtgtccttacacatctagattccctccccaccaattgggaaacagtgacagcccgtcatagacagaaaaagtgggcttcttggtgattttattctatggctgtcttctctcctcaagcagtggctatagatgttgaattacaagtagaagccctggcaaaacacacagctgcagcttttatttatttatttttgagagggagtctcgctctgtcacccaggttgaaaagcagtggtgccatctcggctcactgcaaactccacctcccaggttagccttagcctcctgagtcgctggaacaacaagcgtgcgccaccacacctagccaatttttgtttttttagtagagacaggttttcaccacgttggccaggctggtctctaactcctgaactcaagtgatccacctgcctcaacctcccaaagtgctgggattataggtgtgagccaccaggctcagcccactgtagctttcaataatactcatcagggccagcagcggtggctcacgcctgtaatcccagcactttgggaggccgaggtgggcggatcacgaggtcaggagatcaagaccatcctggctaacatggtgaaaccccgtctctactaaaaatacaaaaaattagccaggcatggtggcgggcgcctgtagtcccagctactcgggaggctgaggcaggagaatggtgtgaacctgggaggcagagcttgcagtgggctgagaccacaccactgcactccagcctggggaacagagcgagactccgtctcaaaaaaaaaaaaatacttaccaggctatcacccttctgacagaagagacttaccaaataagacaaatggctctacaaaactgtatggctttagacattttaactgcagcccaagggggaatttttgccctgatcaaaactgaatgttgtatttatattcctgagtattcccataatgtatcccaggctatgagttccttggaaactcacattacagcattaattctctgtctcaaggccccataatggcctggtttgttagctatccagtacttggaaagcatttcttttcagcatgcttggtattgtaatactcgttattataaattgctgtgctttttacttctgttgcacttgtgtaggtttgcaagataaaatagctcagcaacttctttgcccatctatttactcatttcatattttacctttataggaactattgggacattgctcaagcaaggaaccacctggctccctgaggaggctcactgcatgctttcgtgaaaggaccctgtcccagcaatcgatgtccactatcagcaggaagaagttacagaagaatgaccttcrccctcctctcctcttaaaattaagggctctcttagctgggcatagtggcgcatgcttgtaatcccagatacttgggaggmtgaggcacgagaatcgcttgagcccgggaagcagaggctgcagtgagccaagatcgcaccaccacactctagcctgggtggcagagcgagaccctgtctcaaaaaaacaaaacaaaacaaaaagattaagggttccctcaaaattagtgggggtaatgttagggaaccaggagcctakgagggccagagtagcaccattttaagttcagctccatcttgagaaatagtaaagcccattctctgctggtcacgacccacaktcatgggctgtttacagtggaagaaacagcctaaagatacctacaaggacacactcctactacagccaagagtccagatgtccaatacccataacaatctctgttttcaagataataatagttttgctttgatgtatccacacactagaatgtcaaggccagttttctttaaatcagtagtcatacattctgtcatgctgtctgctcacccacacgtggacacagcttagcttagcctttatatagacaagatctctagagaagaaaaacaaaaaacaaagtcgaggcgttcctcctcttgctttctgaggatgccctactctaacagtgtagtttctaataacgttgyttctttcactgcactctgtgactcgttttgaagtccctcctgctcgagatccaagaacgttctcttggggtctggatagagatcccttttccggtaacacgatcattgaaggtatagaggtcccggactgctgggaatattttatatttccttttgaagactctccatcctgcccttatttcttaaagctgagttaattccattgcacataatttatttctccctcctgtatacatatcttccttttgtcctcttctgtcgcttttaataccgtgtggaggtgcaaaaccccttctagtaatggctggggaaaaaaagtcatktaagtcccagggtgaaataagactttctaaaaaaaatacttgagtctcaacctctaaaacctttcaagtaccccgatatttcttttcatcttgtcacaaatttttatattcctcttcatcctgttaaaatctcccctgtttttcttaaattaccacctttcaaggtaaataaaaygctgctggttctctttttatcagkgtgccatttaattttcggttattacaatagaatggtcttaaatttgtctttaaactgaaaacatgcaactctcaagtgataacacggcttagagaaccttttgtttgagagcctggaaactaagtgtctccattacaatgtttccgactcccaaaataaccaagagatgaggtatccttgtgccacctttataaaactcttggttgttacgtctcatgcagagacacaatatttgttgatagtttaaataataattattattaatattaatagaacattttctatgttccaggccttgctttaagaagtttataggcattgactcatttaatcctcaccacaacctatgaagtaggtacttcttgttctctcatttttcaattttattttgttttgtacttttagtagagatggggtgtcgccatgttgcccaggctggtctcraactcttgagctcaagcaatacacccacctcggcctcccaaagkgctgggattacaggtgtgagccaccgtgcccrgccttgttctctcatcttatagacaaattcaccgaagcacagagaggttacggcacttaatcaagctcacagagctagtaagtggtggaacagattgactttagagccactctgttctgccctttaacagaattcattctgtracatatggattattttgagtctcattaggcatattttgaaactactcagattcatattaaaactccatgaaggtaggaccgaagtcktattcatttttgtttctcccacaaatttttttttttttttctgagatggagtctcactctgttgcccaggctggagtgcagtggcgtgatctcagctcactgcaacctctgcctcccgggttcaagcaattctcctgcctcagcctcctgagtagctgggactacaggcacacaccaccacacagggctaatttttgtttttcgtttttgtttgtttgagacggactcttgttctgtcacccaggctggagtgcagtggtgcgatctcagctcactgtaaactctgcctcctgggttcaagcgattctcctgcctcagcctcccatgtagctgggattacaggggcatgccaccacgcccagctaatttttgtatttttagtagagacagggtttcaccattttggccagcctggtcttgaactgctgacctcaagtgatccatccacctcggcctcccaaagtgctgggattataagcgtgagccaccgcacctggacaatttttatattttttctagtagagacggagtttcatcatgttggccaggctggtttcgaactcctgacctcaagtgatccgcctgcgtcggcctcccaaagtgctgagattacaggcatgagacaccgcacctggccccctagcaggttcttgatagttgctgacaatggagctagctggggattctttcctccgatggtcattatgcattatagacaaggttyctgtgttctcawtatgcccccaaggaacatgcttcagcaaacgtgaaaaatgccagagccatacattttttttttttttttttgagacagggtctccctctgtcacccagcctggagtgcagtggcatgatcacagctcactgcacattcatctgcccaagcccaagtgagcctcacacctcagcccccaagtaggtgggattacaggtgcactccaccacaccyrgctaatttttgtatttttttgtagagttggggtttcgctatgttgcycaggctagcctcaaactcctgggctcaagcaatcctcccgcctcggcttcccaaactgctgagattataggcgtgcaccaccatgcccagcccagagccatacatgttggtttaaccaaaagagctgaagggtggcttggagcactggcataaatgatgtccctttagctgtcagggctgaccgggagggaaacaaccctgcaacccgtaatggtccttggcttgatcaaagagcaccttgtacttgaggtaccctctttgtcctggtcccatccattcaccagcagccttcacacatctgtcctaaaaccttagattttacctatctgttgctgcacatacagcggtgccaggggacactgtcgaccacgcccggttaattttttgtatttttagtagagatggggtttcatcatgttggccaggctgttctcaaactcctgaccccaggtgatccacctccttcagcctcccaaagtgttcggattacaggcgtgagacaccacgcccrggctcaratgttcatctctttcagaaataccctcagaggaacacccagaggaatgtttgactaactgtctgaacacattgcaacccagtcaagctgacacatagaattaaccctcacagaaccaataaggaagtggaagaaagtgcttcttttgctacaggatgaggtgggagcaggaattgtgagaggccccctggccaccatctccagtgtattgggttcagctcatttcctccccrgcactgctactaatgttcaaggcattatttgttgaagccaggtgccgtctaagcaggctgtygagggagagcaattttttttttgagacaggatctctttctgttgcccaggctggagtgcagtgacatgatcttggctcaccgcagcctcgacctcccaagtagctggaaccacaagtgatcctcaggtaatcaggtgattctttcacctcagcctcttgagtagctgggaccacaagtgtgtgccaccacacctggctaattttctttctttttaatagagatagggtcaccctatgtggcccaggctggtctcaaactcctgggctcaagtgatcctcttgccttaggatcccgaagtgctggactacaggcgtgagccactgtggctggccttttttttttttttttttttttttaaggagagcaattttggtaactagagactgctgggaaagagaatgtgggcgatcagagagtgcaagggacatagaaggaagtctttagaacttggatgggagtccaagttctgccacttccaggcctttgtgcattcagccagttacttaagctgtttggcctcagtgtccatatattgcattaacaccgggaataacaatttttaccttacaagattgttaagggaattaaatgagatcatgtgaataaagagcctgccatagagttgcactcaataaacactattttacttccccctgaattccctacctgtacttttggcacatgaaaaaataattaggtagaaataggctggagtccagcaggggaagacaaactaatctttcctggactacatttttacatggataaaaatttttgccactgcaactctaagcagcactcagtatctttgagatattagtgatgtttttctctgatgttcttttagctcctggggtcactgtgggctaagagaggtggagacaggctttgtgcaacgctgccttgtccccctgctcagaggcagatgtgacttaataggaagaatcctagaggccttcagatgctgtagagaagattcatgtttgatgagagagagcctggatgacatgaaagttgttgtttttttccagagaaaaggaaagagacataacattccccctacccgcccaagcatcagcttcctcttctgaactggttgctgtggagattaaaaactttgtacacagcacattgcacacaggcgatacgcggttgttagaatctcattaccattgacaatggctaattatagatgtgaacatctaaatgtgtctgaaggggacagagaagtttggtaaggataacttacaatctttccatcttttgttttgttttgttttgttttgttgtgttttagagagggtcttgcaatgtcgcccaggctggagtgcagtggcatgatcttggctcactgcagcctccacctcccgggttcaaataattttcaaatctctgcctccaaagtagctgggattacaggcacatgacaccacgcccagctcatttttgtatttttagtagagatggggtttcaccatgttggccaggctggtcttgacctcctgatgtcacgtggtctgcccaccctgtcctcccaaagtgctgggattacaggcgtgagccacttcgcccagcctttttttgtttcgttttgtttcttagagacagcatcttgctctgtccttcaagctaaagtgcagtggcttgaacatggctactgcagcatcaacctcctgggctcaggtgatcctcctgcctcagcctcctgagtagctgggatgacaggtgtgcaccaccatgctcagctagttcttacaatttttgtagagaccaggtttcattatgttgcccaggctggaattttcgtattttttgtcacaaagcctcgctatgttgcccaggctggtttcaaactcctggcttcaaacagtcctcacaccttagcctcccwaaggatcttgtgctgagattacaggcatgatcctccatctttttatattgtgtaattataatgcagagtagtttgagcttggtgatgagaaagctttcttttcgccttcctgccactcaytgtttgtatactttattttcaaaggccattaacatgtcgacagccactgagctgctgtttttgttttattgttcccttgaccacacaccaaccaaccatgactcccaattaatattcttaatggaatccaagcctctaagcctcacagtccaggccctccaccagcctgcctcaccctatcctcatttcatctcccgcaacctggctccggtgagtgctcttcgtagtcagactgggctgtttattttctgcaatgaacttgtaaatccctgcctttggctcgtgcttgaaatagcttcctctttctcattaccgagtctacgtcctgtgtttaagtgcagctctggaaccagacgacatgtgtgtcatcccaactctactgccagctatttatgagccctcaggcaagttactgaaccttcctgtgacttcacttctttacctctaaaacagaggtcataatagtatacctacatcctatgcttattttgaagcttaaagaggtaatttaggggctgggcgcgtgtaatcccagcactttgtgggactgaggcgggtggatcacctgaggtcaggagttcgagatcagcctggccaacatggcaaaaccccgtctctactaaaaatacaaaaattagccaggtgtggtggcaggtgcctgtaatcccagctactcgggaagctgggacaggagaatcacgtgaacccgggaggcgaaggttgcagtgagccaagatcacgccactgcactccagccttggtgacagagggagactccatctcaaaacaaaaccaaagaaaacaaacaaacaaaaaaaaaacaagtgttgataagaatgtggagaaattggaaccttcataaattgctggtgagaatgtaaaattgtgcagtcactttggaagacagtctggcaattcctaaataatttgagcatagagttactatatcacccagcacttccattcctaggtatatacccaagtgaattgaaagcatatgtctccacataaatgtgtacattaatgtttatagtggcattattcataatagccagaaagtggaaaccaccttaatgtttatcacagatgaatggagaaacacaatatagtactgaatattcacataatggaatattatttagccacaaaaggaatgtagtacaattgtccttcagtatccacaggggattcgtttcaggacccctgaggatatcaaaatccatggatgcttgagttccttatataaaatgatgtagtatttgcataattactttaaatcatctgtagattataatgttgaatatgatgtaaatagtttttttttttttttttgagatggagtctcgctcttttgcccaggctggagtgcaatggcaccatctcagttgactgcaacctccgcctcccaggttcaagcgattctcctgcctcagcctcctgagtagccgggattataggcatggaccaccatgcccagctaatttttatatttttagtagagatgggtttcttttttttttttttttttttttttgagacggagtctcgctgtctcccaggctggagttcagtggcgcaatctcggctcactgcaagctctgcctcccgggttctagccattctcctgcctcagcctcccaggtagctggggctacaggggcccaccaccacgcctggctaagtttttgtatttttagtagagacagggtttcaccatgttagccaggatggtctcgatctcctgaccttgtgatctgcccaccttggcctcccaaagtgctgggattacaggcgtgagccaccacgcccagccctgtgacggggtttcaccatgttggtcaggctggtcctgaactcctgaccttgtgatccgcctgcctcagcctcccaaagtgctgggattacaggcatgagccaccacgcccgaccaatagttgtattttttttggagacggagtctcgctttgtcacctaggctggagtgcagtggcgtgcaattggctcatgccaacctctgcctcagcctcccaagtagctgggattacaggcgcccaccaccatgccgggctaatgttttgtattttagtagagacggggtttcaccgtgttgcccaggctggagatagttgttatatttttaggaaataatgacaagaaaaaaaagtctatacatgctgttyagtacagatacaaatttttttccccaattttttcaatctgcggttggttgaatctacggatgtgaaacctacagatacagaggtctgactgtacttattcattctacaacatgaatgaagaaaacattatgctcaatgaaagagtcagtcacaaaggactgcatatgattccactcacaggcatccctccttttactgtgcttggctttattgtgcctcacagatattgtgaattttacaaattgaacgtttgtggtacccctgtgtcgggctagtctattggtgccatttttttttcaaacagagtgtgcttacttcgtgtttctgtgtcacattttggtaatcctcacagtatttaaatttttttcattaatattaaaagtaatggccaaaacaacaattacttttgcaccaacctaatatgattatctgttctggtgatctgtgatcatagatctttgatgtttctattgtaattgttttggagcacccatgaaagatggtgaacttaatggataaatgtgtgtgttcttttccttttcttttttttttttgagacagaatctctctccgtagcgaagtacaatggcatgatctcagcttactgcaacctccacctcccaagttcaagcaattctcctgcctcagccccctgagtagctgggattacaggcacgtaccaccacacccagctaatttatgtatttttagtagaggtggggttttgccatattggccaggttggtctcgaactcctggcctcaagtgatccacctgcctcccaaagtgctgggattacaggcatgagccactgcactcagccctgctgtcagaggcctttgtaccagagcaactccatctcgaataggggctggttaacctgaggctgaaacctgctgggctacatttccagtaagttaaggtattcttagtcacagaatgagataggaggtcgctgtaaagactttgctgatcaaacaggttgcagtaaggaagccaaccaaaacccaccaaaaccaagatggcaacgagagtgatctccagtcgtcctcactgctacactcccaccagtgccatgacagtttacaaatgctgtggcaacatcaggaagttaccctatatagtctcaaaggggaggcataaataatccacccgttgtttagcatatatcatcaagaaataaccataaaaaatgggcaacaagcaacccttggggctgctctgtctttggagtagccattcttttatttctttactttcttaaacttgctttcactttatggacttgccctgatttctttcttgcgtgagatccaagaaccctctcttgggatctgaatcgtgatccctttccagtaacactaagagggttttgagtggaagattgaaatgacctgacctttttttttttttttaaagaatcactctggcttttctgttgagaagagaccaaaggaagcaaggagggataaggaggttagttcaaagacctttgcaatgaaagagttaaggacgtgccacccccaaatatgccagtttggcatactgattatttcaagctgaaggtacttgagagactgtcattgcaggaagagctagctcactgtttcacagtggacagggtctatgcaaacctgcggccaaggaagctgagaggtggaagaaagaggctgacacatccagtttcttaggaagaaacrtttactagggacttagaacagaagccatgtctgtatctcaggaagcagtgagacaagatggtggatccccgcaccattacccctcaaacccagggcttatataccccaggagaggagtgattcagaagggacgtggagaacaacttaagtatgataacatcaaggccacttgacctaagggcaggatttacagtcagtacgtgctcttacacaaggaacaatagataaactggaagtcttacaagacttcctggaactggcgttaatcagaaaccagcatggattagcatccaggatggagttgctttgccctccccactgacgtgtccattcctacctttaggaagccataaaaattcctttgagaaagatgccttcccttttttttttttttcttttttgagacggagtcttgctctgtcgtccaggctggagtgcagtggcgcaatctcggctcactgcaacctccacctcccgggttgcagtgaggcaacccgggttcaagcaattctctagcctcagcctcccgaatagcagggattacaggtgcgtgccaccacgcatggctaatttttgtatttttagtagagacggggttttaccacgttggccaggctggtctggaactcctgacctcaggtgtgatctagccgcctccgcctcccaaagtgctgagattacagacatgggccaccgcgcccggccgatgccttcctttagtagaaagagaaaataacccttatctccagagactgggaattgatgctacaatggacctatacagataaacttactaaacgaacacttacctttcactagctttgcacttcactgatacaggagtttagaagaaatcacttaggcagatagtaggagtatgggaatcctcagtaaggcttttccttttcatgaaaagcagccccaaatcattttctaacaaagagcattctgtaaagccgagctgcagacacagacaagcaagctgggagcttgcacgagtgaacgcagggaggaacttcggagtacacatgttcaaattggaggctccatcttcccttccctttgtcagccacgtgtactgtaaggagcagacaagatggtgttgatcaactagaaagtctatttccataataagattagggtggggtaaccaggcttcccctgcgcacagtgtaaacgtcatacctgatcaaaccaatctatgagccctatgtaaatcagacaccgtctcctcagacctgactataaacttcggcgcatccactgccggctggtcctttccactcgcagatccatttctctatagagaaagctgtttctctttcccttctcttctgcctattaaacctctgctcctacactccttgtgtgtgtcagtgtcctaaattttcctggcgcctgacgacaaaccccgggtttataccgcagacagtggtatggtcccttcatcaccatatatctcctagtgattcccccgcaatttactgcccctagtccaaatccctttgtcttatcatttcttcataaatttatcatttctttgtccaaaaggtataaaagctttctgttctggccattttcttcaggtcgtcgcccctttcatcttgtgagagtcttcatgtgcaagtaaaaattagtaacacttgtatgcttttctgttaatctggtttatgtccatttaattcttagacttagctttagacgatcccaagggagtagaggagaatttatcctcccatcagcaataatccaggctagagatgatggtgatttatattagaggaaagcaatgcaggtggtgaaaagtggtcagattctgcatagacagtgttttggatttgctagtgggttagttgtggagtgtgcacgtgtgtgtgagagaaagattgagagagaatgtgttatagattataccaaatctttcttaagctttaagcctgaactatttatgaccaatgataagtatttccatcatatcttacaactaaagaaatgtgccaggccgggcgcggtggctcatgcctgtaatcccagcactttgggaggccgaggccggcggattgcctgagctcaggagttcggaaccagcctgggcaacacggtgaaatctcgtctgtactaaaatacaaaaaatcagccggccttggcggcatgcgcctgtagtcccagctactcaggagcctgaggcaggagaatcgcttgaacccaggaggcagaggttgcagtgagctgagatcgtgccactgcactccagcctgggctatgcagcgagactccgtctcaaaaaaaaaaaaaaaaaaaggtaccagtgtgtagtaacattgtgggtgagaatctttgctctttatacataactgtttaagtttcagttttgtttttgcttttactgttttagctgaagcacacttggccgatgttaagctaaattatcagtagatggcaccacagtcttagttagctgaagatttctgggttttgcagggagtgaggattctagtgtcagttgtcggatgtttaggtgtgactcagtgacctatgcttaaaagtttgcccggttactaactgagggagcaacaagtacaaactgcagatagggaattgaaaaaaggaaacacacaaatttacacagacacggtgcccatagatttgttgcaagggcagtttggtagagagaagctagaaggaagctgaagctccagaaaacccaaaactacaaacttccttcaaaagtctagggagaggccgggtgcggtggctcaggcctgtaatcccagcactttgggaggccgaagtgggtggatcacttgaggccagaagtttgagaccagcctggccaacatggcgaaacctgtctctactgaaaatacaaaaaattagctgggtgtggtggcgggtgcctgtaatcccagctattggggaggctgaggtgggagaatcacttgaacctgggaggcagaggttgcagtgagctgagatagcgctactgcactccatcctgggtgacagagtgaaactctgtctcaaaaaaaataaagaagacaaataatagcaagtgttggctaggatgtggagcaattggagatctcatacaatgatggtggaaatgtaaaatgacacaactattttgttttattttatttctgagacagagcctcaccctgtcgtccaggctggagtgtggttgcacgatctcagctcactgcaacctccacctcccgggttcaagtgattcttctgtctcagcctcctgagtaactgggattacaggcacacgccaccatgtccgactaatttttgtatttttagtagagacacggtttcaccatgttggccaggctgttcttgaactcctgacctcaggtgatcctcccaccttggcctcccaaagtgctgggattacaggcatgagccatggtgcccagcaggcacaaccattttagaaaaagtttgcagttaatcatacacctactatatgatctagccactgcactcctaggtatttatgcaaaggaaagaaagcctaagtctgtacaaagacttgtacacaaatgttcaaaacagctttatttgtaatagtaaaagaaagaaagaactcaaatgttcatcaacatgtaaatggataaacatgggagcttatctatatgtacaatgaaacactacttagcaatataaaggaatgaattattgatgcaggaaacatggatgaataaaaataattactaatgaaagaaataagacaaaaaccgtataaactctatacaattgcatgcatatgaaaatctagaaaaagcaaagtaatctgtagcgacagaaagccaagaatggttgtggtagaagggagaaggactggacgggtgccgtggctcatgcctgtaaacccagcacttcgggaggctgaggtgggcagatcacttgaggtcaggaattagagaccagcctggctaacatggtgaaacgctgtctctactaaaaatataaaaattagccaggtgtggtggttcacgcctgtaatcccaggtactcgggaggctgaggcatgagaattgcttgaacccgggaggagaaggttgcagtgagccaagatcgcgccactgcactccagcctgggcgacagagtgagactctgtctcatgaaacaaacaaacaaamaaaaaaacagaacaaaaagataaaaaaaaaaaagtaggggaagaactggagggaggaattacacaggagcactgaatatattcactatcttgattttggtgatggtttcatgagtatatactgtaaaggaacataaaaactctcaaaacccccaaactcattatgccaaagggaaaattaagcctgcttacttcacaaccttgtgtcaaagcgctatacattagccagatccctacaaaaggaaaaggtctcaggcatttccagataactgccctcacaaatcgcgcctaagaaaattctttcctggctcctaaacctttcaaggtgtataataaatcttcccataaacaaggacatgtcaactgtcactttaagtctgtgacttaagtctaactccttgtccaggaacctaaagtctggtaaatttcacaccgactgtgtcaattataagccttatcttcccaagtgcaaaaacaaagatgacatccattattcttctacctatcctgagaagtctgaataatgaattcttcctttactccctattttcgaatgtttgccttatctcatgtatagcatagatgtactgggcactaattaaaatctcacaagaatgtcatcatttgcttcacgcctatctcccttttcctgcatgtcttttctcttaaagaaatgtgtaaataccgagtctcctgaagcctttcccaaggagcacgggccacagactcatgtttctgtgactcagggttttcctgggcacacctttaagctctggctcaataaacctggattgattgagattcttgcctcagtctctcatttgggttgacaatacatatgtcaggacattagactgtactctgtaaacatgcaaagttgccaatgtgaagtcaaatatacctcaataaagctgttaaaagtaaattttttaaatgagatactgatatgtaatgtttgttattttactcatgtatttatttgccttttctttcatttaacagagtttattgagtgtctgtgccagaggctaaaagaggtatgacatggtctgctttcaagtctaggcagtgacggttctgcttgatatgcttgttgtacatgcccataggaagctaagaaaataggaagattagcgtgtaggctggcatgttggggaaggcttttcagaggaccttaacgttgaactgagttctgaaggacgagtaggtggtttggacagtgaggagcggttagcagtggcagctttctgtcttcaacaaggcctagggatgagagaacaaggcgctgtgggaggaaaacaaattgcagcagagaggggagaagaggagtgttttgaaaagaggcaggataggttaagtcgggactgatcagcatgggccaggaaagctgtggtcaggaatccggctgtaccattgaaggtctggggagctagagcaggttttaagcaagggagaacacagatagcctgctgatgaacagcacaggccaatcgagtggagcaagagaaaccatcttgcccttagattggctagcattacggttaaacgagtgtatttaattagtctccaagtcctgctaatagctcatccttaatcattttcaaatgttccaattctttccatccctatcgcagttaccttagttctgtctccattattgtttgcttggattaccataatatcctccaatggcggtttccttgtcttcagtcttgccccgcctttaactctttgctacctgcagcataaaacatttttctaaaattcaagtttgatcctctcacctttaactgaaaacctgatctgctgctcatcaacactatctctgtgtttctaataatgatcatcactgtaatagcatacttagcaagcatttactacatgccaggaactgggctaaacaagatgtgcttttatcttattaaatcttcctaaaacattattactatcatcactattttacagatgaagaaactgattattaagaaggtttagcaatgtgtccaagatcatacagttaataagtgtaattgaataacttgttgaaaaaccaaaaaacccttaaagacaaagttgtgtagggaatagaattttttacttgcacctgcaagagggaccgattattagagaactggctttgtaaacaaaaatgtagggcaggtatttaaagtaaaaaaatcacaaggatagacaacagctcaaattgttatcagttcacaagtctgcttggatgtatgtgggtcaattttgttaaaatctagacggtcctttctattaagacattacaatgcatcaacaccaaacaacagaaaagaaaatccatatatccctgtttttcatgctttgtctgggactaaaggaagggcaggccttttctagactatggaatctaagtttcagaaaaaaatcatttaagctgcaatataaagaataatcttggccggtcgcagtggctcacacctgtaatcccaacactttgggaggccgaggtgggcggatcacgaggtcaaaagttgggcaccagcctgaccaacatggtgaaaccccgtctctactaaaaacacaaaaattagctgggtgtggtggtgtgcgcctataatcccagctactggggaagctgaggcaggagaatggcttgaacccaggaggcagaggttacaatgagccgagatcatgccactgcactccagcctgggcgacagagcaagacttcatctcaaaaaaaaaaaaaaaaaaaaaagaatagttttaaggaaggcagaattagagatagacaagttataggaacccaggcaagccattataatgccaaactaaggcaatggcaggagggatagaaagaactggaccagttttaaatccattatgggacaggaaaggcatgttgcagtcccttcagccaagttgcaagttttgaatgagttatccaaacattattaaatgcatcttcagtgatgactaccaagcttttttccaggaaccaaccctcttttgtaaaaatgttaggttagcctgttcgttctggtttcttgggcagtgactgggatgttcaaactattaattgggatagaacaccgaagctggttaaaaacaatatttcttatagaaattgatcttgaacatggatcaaggttcactgctagcaggagaatcggagagtgtgtggtaatgaaaagttatagttgagaaaacaagcgtttacatcagcaactaattaagaaaaaagcagctcataagtggatgaatgcagttcataaacacattatatcagttattacacaggaaatctaaggcagaatactgtgaaatgcaaggtgtatagcttatcaacaagaatgtagcaaatacaccattcaactaagaaagaaatgataaggctgcatctggggctgttgactggaagcacaaagtttcctttccttgtagtagttcctaaagattccagtttacatggaaagacagaaagctgtcacacccatggcaggagcgcagaacccaagcgacaaattctaattttgaacaggcaggtgccagtgcatttctcaaactgcaaactaaaatgcagaaacacgattttcctgtttcttagttttggaccgttttcccccctctagcacgccagagcaggttttaattgttgtcaggtcagatggtgagttaactttgagtgttgagttgaggggccagtgggatgtgggtccagttgaaaggtggatatatgtagatccagactcgagtgatataggctgcaaataaattgctagtgaatttatgaattattagaaaagaaaggacattcattatgatttaatcgcrgttgaatgtaggcagcacagagggcttatactgtgtcttttttttttttttttttaaatatacggtgtctattttgctcaccactctatgcccggtgcctggaagtgcgactggcacatagtaggtgttgcatagtttcagaatgaactttttaggaatcaaaattctacaaacattgcacacagatttaacgttcccttattttccaggtgaggtcagggcgccctttggtttcgcgcttctgtccctttaagaaagtggaggagaaagaaagcgctgctgggaaaaagggcggggccgcgaggggccgccgtccgtcccgccccctgccgggccgcggcgctctgctagagcgtggctcagttttggtagcgggaccccggaaatgtaaagcatgagcgggaacagtcgccagggcgagtgacaggcgagccctatgctttacttccgagggcggtgtcagcaaagctaggtaaggagacagggaggacggtgcctgcccctttaagatcgactccaccccgcctctggaggaaaatgacgccgccgtctacccgttgtggaacgtaactcttttcatcccatcagctctccttctcattaagagaaataccaagtggtcaccacagtcacatacttcataacccatgcctcatcggtgctgggacgggagagggaagcgccgatctaaatgacatggggtccaaatcccaaataatctctatttgctctgcgttacctttaaacttaggctgcgttgtgtgattcaagtgacagcctagtactgcttaacaattagtctagtgggataccaggccctgagagacccctacgatcccaggacactgatgtggggtaactaacacccactggaagtctacgctgagttcacaggctatgtatgacctgacatgcattttgacctgccctgtgttttgatatttgaatgagttgctgatgtttacaagccgaagctggccgggcgtggtggctcgcgcctgtaatcccagcactttgggaggtcgaggcaggaggatcgcttcaggtcaggagttccagaccagtctggccaacatggcgaaacctcgtctctactaaaaaaaaaaaaaaaaaaaatacaaaaattagccgggcgtggtggcacgcccctgtaatcccaggactcgggaggctgaggtaggagaatcgcttgaacctgggagtcggaggttgcagtgagccgagatcacgccactgcactccagcctgggcaacagagactctgtctcaaaaaaaaaaaaaaaaaaaaaaaaaaaggtggaagctaatgtgtcaatatctagatttttttgatgattttgagaaatcggaggatctggcagcatgtcctgcctagcctttttgaactgtttgaaaacagtctccagcttgccacagcccctctgttattttacagccagcctgcatcactcatttatgatgtccagccccttgtggggatttggatttttgacccctaaatactttagtggatttaagaccatttaaaacatttatgcagaagagatccgaggtccccaaacaactgggtgtataagttgtgtttaagttgttcctcattctcatttattctaatccgggtgtttttctatatatatatatttttaaacaaatcttagtgatcaattgcacaggtgtttttctgttggagcaaatcttttcagtttaggcttggtaaaatcgaaccatcagatacttttacagaaagagatttaggagttgatgttcttttattacaattaaatgcatacagtatttttaaaggaaaaaacctgaatcttgattgcattgttttatgatacaacaatctttaatgaaatagagtagtcaatataatttgtattaatatatctctgcccacagacaattataaattcattaacccccagaactcttggctagacttcataaaggcaaaaactgtgtttgccctgttaactgctttatcccaccactagaatataagcttcctgaagacagaagacttctgttattttgttcacagttaccaagcatgcctactttgttaaatttatgaaagaactttaaaggtacagttggcccacaatataacaatatagcaatataaaattacaacaataaaaataacacaaaaatagtgtaacaactacttatatagcatttacgttgtattaagtattatgagtcatccagagatgatttaaagtaaagtataccacagcatatgcctagtttatatacaaatatgatgccattttatataagggacttgagtatcctctgattgtggtatcctggaagcaggggataccggaaccaatcacttgaggatactgaaggatgactgtatggctgatttcctgtaagaggcattttcttgaggattctttcaaaatcaaatgcttgtatatttgttgtgttaaattactaaaaggattctcttgtgaaaagtatcatttaaaaagattggattttcccaattgatgcaccaaagctttcatctgaaatgaacttgcacatgtgaatcatcagatacagtaatatacactgtaatattttatttcttttttttttttatgagacggagttttgctcttgttgcccaggctggaatgcaatggtgcgatctcggcacactgcaacctccgcctcccgggttcaagcaattctcaagtagtgagattacaggtacccgccaccacgcctggctaattttttgtatttttagtagagacagggtttcaccatgatggccacactggtcttgaacacctgacctcgtgatccacccgccttggcctcccaaagtgcagggattacaggcgtgagccaccgcgcccggccaatattttcttattatgtaataggatctagaaatgttgctcttcctcacaattctcagtattacttttcttttttttttcagagtcagaggttccggttgagatcaagttgggagacacacccttgttcattctccttgagaagcagctatwatcaacagaacattgacagaacctgtgtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgmggcttttgacccccagatgcaaattctggtgggagagagctgacctgtggccccacagtgatccttactggkcaatctactggccaggaggccaagccctgtctaggtactaccctaatgaaacctttaaggcgctayagatctttgctgttttcagttccctccaacctctacaaaaaaccagagcaatgctaggcgtggtggctcatgcctgtagtctcagtactttgggaggctgaggctgtaagctgtgatcctgccactgcactctcgcctggcctgtctcaaaaacaaaacagaaacyggcaaaactcagtcttgttgttttcttttttctttctttctttyttttttttttttttggtagagacaggatcttgctatgttgtccaggctggtcttaaacatctggcctcctcaacctccccaagtgctggtattacagacatgagcctctgagcctagcctcaggttagccatattttttgttgccttgttgcgtaatttcccattctaacccaagcttatcaagctattttcccaagtaactgtctccccaagagaaatcctagagtcagctgtcaagaccctggatagctataagtgatccagaaatctcacctgttaggaggttcatagttcatagcgcatgaccattgcagagttcctagatggaagctaaacacccagtcctttcgctctcctttaattcagtgaatgtcgctccataaacctcacattccttccagagttgcttattttcccataaaacaggagctgtgagtgagtgggctgttcaaagtttccctcttctgttgggtgcagtgcctgtaatcccagtgctttaggaagccagtgcaggaggacagcttgaagtcaagagtttgagaccagcgtaggcaacatagtgatacccctatctctacaaaaaaaaaatttttttttttttgagacagagtctcactctgtcacccaggctggagtgcagtggtgtgatctcggctcactgcaagccccgcctcccgggttcacgccattctcctgcctcaccctcctgagtagctgggactacaggctcatgccaccatgcccggctaatttttgtatttttagtagagatggggtttcaccatgttgatcaggctggtctcgaacttctgacctcgtgatccgccctcctcggcctcccaaagtgctgggattacaggcgtgagccaccgcgcctggcttaattttgtatttttagtagagacagggtttcaccatgttgaccaggctggtctcgaacccctgacctcaagtgatccgccagcctcggcctcccaaagtgctgggattacaggcatgagccatcgtgcctggcagtagcagctatttagacagggcatgtatgcctctactttgccatagtgttaactggttgatgtcaagtcccaggttcttagtgccatcaacaaagaattggacatgacacatacaagtagcaaggcagcaaacagtttgttaagcagaatgcaatcagcaacgratcaggctgacctgcgagtggtatcagccccagtttgttatagttcatggccttttatatgttttttcctcacttgcttaaccttactttgtttttcgtaagtgaattgctcatcctggcctttccctcattgtgcctaaaccrcactttatttctcataagctaattgtgcatccttgcttaaccttattttatcttttctgacaaaattgctcatctttacttttagttcttgtaaccaaattgctactgcaacccctttccacttattttccttatcttgcatgttctaactcattgcttactcccgtatctcttactgcttactgtcttatttcatatgtcctgtttctgctatcttgtatgctttgcttttggtattgcttcagctagcctatgtccaacgggtccccttcacccctgacttcctctgccattctcctgcctcagtagtacccactgttccttattactccaatccgaagatcaagagtcagctgaaatttgttatttcagcgtttctccatccctcttcgcttktttggtaactatttagctccagtccaaattccttggttgaattggactttgagttttaccagagaggtcattatactacatttcaagcagcaggaaaatcactctatgatggagtcaagaggagacagtgactcttggattgagtttactaattttagtctttgttttagcagtattttgtcagtcttaattcgtggtgctcggtagtttctggaacatactaagtattcaatactttgtcagccgaaatgagagactgaggcatgagtctcaaccagtcaaggtttgttaagcccaagaaaaatgcaagtcacagaaaagtttgtggcctgtgctcttctaagaggtttttaggaggcacagtatttatacatttctttttctttctttttttttttttttttgagatggagttttgctcttgttgcccaggctggagtgcaatggcacaatcttggcagactgcagccttcccctcccgggttcaaacaattctctgcctcagcctcccgagtagctgggattacaggcatgtaccaccacgcctggctaattttgtatttttagtagagacggggtttcaccctgttggccaggctggtctcgaactcctgacctcaggtgatccacccaccttgcctcctaaagtgctgggattacaggcgtgagccaccacacctggccatttatacatttcttttctttctttctttttttttttttttgagacagagtcttactctgtcacccaggctggagtgcaatggcttgatctctactcactgcagcctctgcctcctgggttcaagcaattctcctgcctcagcctcccgagtagctgggattgcaggtgcccgccaccacacctggctaatttttgtatttttagtagagatgggatttcaccatgttggccagactggtctcgaactcctgacctcaggtgatccacctgctcagcctcccaaagtgctgggattacaggcaggagccactgtgcccagcctacaacttttttttgaaaaaaattgacttgaatagcataatcagtcagttgtgtggtactgtgcttcacacctgctgaagagaaagaccaaatgactaggtcctttcttctgccacctctgcccagctctggagatggactttttgtgtcactctagtcagaccaaacttgccaaggttggaccaagttctgctacttttcactatttcttttgtccagtcaacctaaagacatctcttttctttcttttccttttcttttcttttttctttttttgcatacctcttatttgctgagaccagctcggctggggagaccctaacccagtgacactagaggaattaaagatacacacacagaaatgtagaggtgtgaagtgggaaatcaggcgtctcacagccttcagacctgagagccccgaacagagatttacccacatgtttattaacagcaagccagtcattagcattgtttctatagatattagattaactaaaagtatcccttatgggaaatgaagggatgggctgaaataaagggatgggttgggttagttatctgcagcaggagcatgtccttaaggcacagatcgcccatgctattgtttgtggtttaagaacgcctttaagcagttctctgccctgggcaggccaggtgttccttgccctcattccggtaaacccacagccttccagcgtgggtgttatggccatcatgaacatgtcacagtgctgcagagattttgtttatagccagttttggggccagtttatggccagattttggggggcctgttcccaacatttatttttcctcatctctctgagacatgtttctcctttttaatttaggtatcttttggataatcctgatgttgtcagaggaaaatctgtattagatcttgggagtggatgtggagctacagctattgctgctaagatgagtggggcatcaaggatcttggccaatgacatagaccctagtaaggattcatattttaaaatatttaaggctcatcttttttttttctctgggataaatatgtacacatgctcagtgtggtagcttatcgttatatgtattttgtgattggacattgtgaatctctgtgcactgggacattatctgtaggaatcccctgaggtctgagtagatggtgcatttttcccaagaggatttgtgtctgccagacatccagagtaagcacttatgttaatttatgggctaggaatttcctgaaatatgtaaatagtgtttatttgaccccaaacccaagtgagtattgacctgtctttgagggttatttttattccattagaacccaggctgagacaggtaagtttttatttgatctgattttcttctggtctaccctttcactgagaatatagtccttgaaaacctttattttattttatttatttatttattttgagacagagtctccctctgtcacccaggctggagtgcagtagcacaatctcagctcactgcaagctccgcctcccgggttcacaccattctcctgcctcagcctcctgagtagctgggactataggtgcctgccaccatgcctggctaatttttttttttttgcatttttagtagagatggggtttcaccgtgttaktcaggatggtctcaatctcctgacctcgtgatctgcccgtcttggcctcccaaagtgctaggattacaggcatgagccaccgcgcctggctgaaaacctttattttataaaggagtctcagttctttttttttctttttttttttttgatacagagtctcactctattgcccaggctggagtgcagtggcacggtcttggctcactgcaacctccacctcgtgggttcaagtgattctcctgcctcagcctcccgagtagctgggattacaggcatgcaccaccatgcccagctaatttttgtatttttattagagacagggtttgaccatgttggccaggctggtcttgaactcctgacctcaggtgatccacccgcctcggcctcccaaagtactgggattataggcgtgagccactgcgcccagccaaggggtctcagttctaatttattgccatgctcaatcaagcccaagtctcgtttccctgtccacagtaaaaaaacaaaatcttttggttaatgaaatcagcaaatattcctaaaagtcccagcatttctaggtgttttgaattgtttgttttcaggatatccagtcatgtatttggaaattgtggtatagcttatattgggataacctttatacttctctactttaaaaaacaactttcatcaaaaaggaagaaaaatatattgttagcagatcttctaaattatttaatcaacatggaattataacagcctagcatataccaattcattttgtgctttttttttttttaagttgcaggaatggctattacactaaattgtgaattgaacagactgaatccttttcctattttaatccaaaacattttgaatttggaacaagataagtgggaccttgttgttcttggcgatatgttttatgatgaagaccttgcagatagtcttcatcagtggctgaagaagtgcttctggacctatagaactcgagtactgattggtgaccctgggcggccccagttcagtggacacagcattcagcatcacctgcacaaagtggtagaatattcacttttggagtctactaggcaggaaaacagtggactgacaacaagcacagtgtggggttttcagccttgagttgtcaaagtgcttccaagtatgaatatagtaatgtttggatctgactctaaaagttttctctataggagatactctccagtttaatgaaygtaattcttgttaaatggaaaatcttgtttttaaaatatgaaggtttagagttttgtttacttttgtcatgtaactggttctgtatttctatgcrtgccaattatacacatctctatctgcatttttttttctattttaaccgctgaaggaatatgattatacaatgccatactcaatggtggcagcatttaatttaagtaatggagaagaattaaacattgtagctggatctgtttctgtagtygaggacaactgtgatgtaactttgaattaaacaaacaaaacaaaacagaagaagactatatatatattttttctttttttagagacagtctcactttgctcccaggmtggaatgcagtggctattcagaggcttaatcattgggcactgcagccttgaactctgggcttttttttttttttgagatggagtctcagctctgtcgtccaggctggagtgcagtgactcatgtctcggctcactgtagcctccacctcccccaatcaagcgattgtcctgtctcagcctccagagtagctgggattttaggtgtgcaccaccatgcctggctaatttttgtatttttagtagagacggggttttgccatgttggccaggccggtctcaaactcctgacctcaggtgatccacccgccttggcctcccaaagtgctaggattacaggtgtgagccaccacgccagcctgacgatgttttttacttctatcacttccttttgattttttcttatagcttctatctctgcttacgtcacccatcattcttgcgtgttgtatgcttttcgcattagagccctttgcatgttaatcagttattttaaatttatgatctggtaattctaaaatgtctgccataactgagtctggttctgatgcttgttttcttttcagactgtttttttgtcttttagcatgccttgtaattttttgttgatagctagacatgatgtattgcataaataaacaagtaaactaaggtagcatgaggttttaaaatctgggtagggctactgtttgctgtagagtagatattacaggctaaattttcctctagtgtcctggctattgtctcctctgttatctttgagtttccctagagattccttcttatatagagtctgaagcttgcagtttttttcacctgtaattccctgttattatacagtagcctaactgatgtgataaggtatgggagaaggtatgttctatagtcctgtgattaagtctcagtcagttaagtcagcctgtgcccctgctgtgaccttcacaagtgctttcagcttttcttttgtcactttggtgagacaggaaggctagaggcagctggagttgggtgcttcctttcccccaggtcaacgaggctctggtaaaatagtttcccttgagaactggcttttgttaaggagaactgaacacttgggcatatttcaaaatggttactttccctatcctcataccagaagaggggatttttctctgatcctcaccctgagaacctggtaggtatcctggaggtaaaactatgaaagtgtggtgtctcccctaggagtgggccccctggagtttgtttgttttaatttaacaaagtttaattgagcaaagaacaatctgtgaattgggcagctcccaaaagcagaataggttcagagtgactgcagggttgccacacctggttagataacgtttatggacagattcctagagcttttgattcttttttttttttttttgaggcagagtttcactcttattgcccaggctggagtgcaatggcgtgatcttggctcactgcaacctccacctcctgggttaaagtgattctcctgcctcagcctcctgagtagctgggattacaggtatacaccaccaaacccagctgggattacaggcatgcaccaccatgcccagctaatttttgtatttttagtaaagacagggcttcgccatgttggccaggctggtctcgaactcctgacctcaggtgatccacctgcctcagcctccccaagtgctgggattacacgtgtgagccactgtgccaggctggagcttttgattcttaagtccatccacatggagcctccagcaactcaggaattacagcataaatgttcctattggtactggctccagcaacaggcttctgctccctgtaagctatggttctttgtatttgcgtttctaatttgtgaggcattctctctttaaccttaattctctaatggatctaagtgttgttgacttttcagtttattgagcttttttcttattgtgaggatgggaatgatgacttccaatctctttatattagaaaatataaatcagactagagactggaaatttttgttgttgttgttgggtgttttgttttgtttgtttttagacaggtcttgctctctcatccaggctggagttcagcaatgcgaccgtgctcactgcagcctcgactttctaggctcaggtaatcctcccacttcagcctccttagtagctaggactgtaggcatgcaccaccatgatgcctggctagtttttttattttgtattttttgtagacatggagtcttgctacattggccaggctgggtattactgggtatttctttctttcctcctttatttctttccatatttacttattcaatgaatatttgagtgcttattatataccaggcactgttctaggcactggggatatggggatacagcaatgaaaaaaaaagataaataytttgtccttatgaaatttgtattctagagtagggagacataatgaacaaatgaaaacaggcatcagatggtgataggtagtaaggagaaaaagaagtaagggtaatagggaatactgggtactggatggggtacagatattttaaacagagtggtgagaaatagttaatacagctagcaacataaaaaaggagaaatatcaaactgcaaactgttttaggaagataaatccttcatagacccaaagaagctcacaatttagatgtcgaaactagtttctgcaaaaaggggaaaatgtgattgacttggttaaatattcagtattaaattttattgaatttgtctttagaaaaatttcatagttagaacaggccttacccattttgcacatatatacatatgcaccacctttgcagtggcaacatatatatccacactataaacataccacatttataaatcttgtaaggacaagaaatggarttgaataagtaccccccaacatatacaagaaagttagcatacttaccccgtttttcactacatcagaggcaaaataagaaatcttttaagaaaatctcaagactggctcatggcaaaatgaatatgctaaatttgggggttggtttaagcgtggtatgtgtcaggtaattttgtgattaccaaaaagtttycacttgaaaactaagacctttgctgtttatttcacaatgtgaaatcaataaacctgaggatacaagtctctgtagtgatattctgtatttactcatttttacmcatttttgaatgcaattttgctaaggaaggaaagcttacagatgcataaaatgtaactgggaagagtagccataaaaatcaatgaatggatgtggctgggcaagagcctctgtaatactaatacgctgaatggctaataagtcacttcatttcggtgaaacaaatacctaaattctttgaagaattaacaggcttgatgttcaggtctgcttttggcaaatgggcatttaaatactccaagaaggtaagagccagaaaataggaaggtaactatgcttttagaaatatgtttacttagattctcccaaggtttatacttacaggtaaacttagaacaatagctcaaatacctacataggagaaggaaatctcaagggaaaacagttaattttaaagttatttaagaaacagaatccaacaccayagatcagagttcatgctaggattatcatttcaaaaataatgactcatccaacagatatagaataatagcactttaaagatgtttaagagtaaagcacaaaccatgtatataccaagacttagctaattctctgagagttataacttaasacaataaaataattaaaaatagtgttaacattaagtagaatgcaaatctctatagatggtttcctgggaaagtagttttgataagctttcctagcattgatcatcttcaaaaaagcatcaataaacagtccatgtcacttgctttagtttgtttgggcctactaattgctccaacacttctcgggaatgatctataaaagaaaayaatgacaatatattaattgacaataaaaaatgtttaatgtttcctcatgtctaactggaggtgatgttaattattatacagttatttaaaggattaaaggaggtgatctataaagcacaatatacaactaactcactaataattaattaatggtagccctcactattattaggtgtagtgcacctatcatggtattacttgtttaaaaaaaaaaaacaggcatttgttgttttctctgtaatttcatcataattccaccaaccagagtaatggtctaatttcaccattaacctgtgttaatggttaataacttttttcaggatcttagccggaaatagatgattcactaaagtggggtgactgaacagcatttaatgaagggaatatttaccaaaaaagtaggattaaagaaagccaataggtacggtaaaccaccttgggaagctgcaacacacccaaagggttaraggaggtagtagtcaccgaacgtgacaagttgacctgtagctgaacatttttccatgtctgtataatactactataaagcatgattttaaatagataaccattatataaatacactgtaatttaaccaatctatattattggacatttagatgttttcagtttttcacaatgtacagtcgtgattttgatatggtttccatcctagttttaggatgtcttttaaaaatctgaattaaagcaaaaatactgataaaattttgttagtttaaatattactcataagtttaataaacttgtttccatagatacaacctatgttttatgtacaacatatctctaacctagtcttggaaatcctgtaatttggtggttcctagacagatttcacagaccagtagaaaaaaaaaaaaagatgggcccaacatatacagtgacaaaattttattttaagtttaacaaaattaagcaaaaataccaaggtttattgccagcaagagaaccagagagtgtatagaaatgaaaagttattatcattgggaaaacaaaggtttacaattttttaaaaaagcagctagtaagataaatgcagttttattcatggtcataaaaatattattggttattgtagaggaaatctcaatcaaagatrggttcaaattatgttgaaagtaaaagaatggacaaagacataccatttaaatggcaaccatgacaaagctgggtggctatagaagaagggggaaacactttccaactctttctgtgaggccagtgttaccctgataccaaagccagacaaagacatcacatgaaaaagaaaactgcagacaaggatcttttattaatgtagactaaaaaatgctcaacaaaacaccagcacaccaaatccagccactagaagaaaggattacataccatgaccaactgagatttatcataggaatgcaaggttactttaacatctgaaaatcaattagtataatatactgtgttaatgtcctattgctgctgtaacaaattaccacaaatttagtggcttaaagcaacaaatttgttattgtacagttttgaaggtcagaattccaaaatgggtctcactgggctaaaatcaggtgtgggcaggtctgcgttactttttagaggaaagtcttatctttttttttttttggaggctctacaggggaatctacttcctttacttttctagcttctagaaactaccacattccttgcattccttcctgcttatttaaagtgaacaacattgggctgggtgcggtggctcacgcctgcaatcccagcactttgggaggctgaggcgggcagatcatgaggtcaggagtttgagaccagcctggccaacatagtgaaacccccatctctactaaaaatacaaaaattagccgagcactgtggcatgcacctgtagtcccagctacctgggaggctgaggtgggagaattgcttgaaccagggaggcggagattgcagtaagccaagaccatgccatcgtactcttgcctgggtgacagagtgagactccatctcaaaaaaaaaaaaaagtgggcatcattgagcacagtccttctcaagctgccatctctatggtcctctctccttctacttttaaggacccttatgattattttgggcctacatagataatacagaatgatctccctacttaaaaatcaactgattagcaactttaattccattggcaaccttatgtaacataacatactcacattttgggcattagaacgtggatatcattgggtgggtgagagcattattcagcttaccacctacaccattctaatagaacaaagaactaaaaccacatgatcatctcaatagacaaagaaacaccaattggctgggtacggtggctcatgcctgtaattccagcactttgggaggctgagggcggatcacctgaggtcaagagttcaagaccagcctggctaagatgggaaaaccccgtctctactaaaaatacaaaaaaaaaaattagccatgcatggtggtgggtgcttgtaatcccagctactcaggagaccgaggcaggggaatcgcttgaatccaggaggcagagattgcagtgagctgagatggtgccactgtactccagcctgggcaacacagcaagacccagtgtcaaaaaaaaaaaaaaagaaacaccagttgacaaaaaccaatgctcattcaaccaactaggaatagaagataacttcctcaacctgataaagggcgtctatgaaaaacccatagatggcaggatgcagtggctcatgtctgtaatcccagcattttgggaggccaaggtgggaggatcacttgagcccaggagttcaagaccagcctgggaaatatagtgagaccctgtctctgcgaaagaaatttaaaaattagctgagtgtggtggcacatgcctgtagtcccaattacttgggaggctgaggtaggaggatccaattgagcctgggaggcagaggttgcagtgagtgtgttcacaccactgcactccagcctgagcaacagagcaagaccctgtctcaaaaacaaacaagaaaaacctatagctaatagtgaaaaattaaatgttttctccctaggatcaagacaaggatatccacacttttttttttttttgagacagagtctcaccctttgcccaggctggagttcaatgatgtgatcttggctcactgcaaccctggcttccaggctcaagtgattctcctgcctcagcctcccgagtagctgggattacaggcgcccgcaaccacgcccagctaattttttgtatttttagtggagacggggtttaaccatgctggccaggctggtcttgaactcctgacctcagcagtttgagacctgatccacctgccttggcctcccaaagtgctggggttacaggcgtgagccaccgttacccgccaggatgtccactcttgccatttctatccaacatagaaatggcatgtaccagaggttccagccatggaaattaggcaagaaaaagaaaaggcattcaggttagaaggaagaagtaaaactatctatttgtagatgttatactgtgtatacaatatcccaaggaattcactaaaaaaatagaataaatgagttcagcaaggtacaagaacaatatataaaaatcaaatgtatttctatacatcaacaatgaataatccaaaaatgaactagaaaataactccatttatgttaccatcaaaaagaatagaatacttaggaataaatcaaatgaaagtgaaaaacttatactctgaaaactataagactttattgaaagaaattaaagacctaaataaagaaatccaaaccagaaggcttaatattattaagatagcaatatttcccaaattacctatagattcaatgaaattcatatcaaaatacaagctggctttttattttttgcagaaatcaataagatggggcctggtaaggtggctcacacctgtaatctcagcactttgggaggccaaggcaggtggatcgcttgagttcaggagtttgagactagcctgggcaacatggcgaaaccccgtctctactaaaaatgcaaaaattagccagaatttggcccccccagctaatttttctgtaatggagtaaaagatggggtttcaccatgttagccaggatggtctcgatctcctgacctcgaaatctgcccgccttggcctcccaaagtgctgcaattacaggtgtgagccaccgcgcctggccaacacttcccaatttcattttagctggtgtgtctacaatcattttggcatttttccaagttgtgaatatgttatcaaacatatataaaatttgtcttctgtctacatttgtcactattctgttttgaattcactattgcacattataggaagatgcttttccctccaatagtaagcatgtaacatttttatgtaattaaaaatttttgatgccagatggcagtgttatattacagtctccttaggcagcttcttcccatgaagatagagtatttaggactgtgggtttaaataagaatattcaatgcctttattatgctacagggaaaaactatggggtcgctaagtatttcataatctcttggcagaacattttatagaaacacatactctcttggccgggcgcggcggctcacacctgtaatcccagcactttgggaggacgagacgggcggatcacgaggtcaggagatcgagactatcctggctaacatggtgaaaccccgcctctactaaaaaatacaaaaaaattagctgggcgtagtggcgtgcacctgtagtcccaactactcgggaggctgaggcaggagaatggcgtgaacctgggaggcggagcttgcagtgagccgagatcgcgccactgcactccagcctgggtgactgagcgagactccgtctcaaaaaaaagaaaaagaaaaagaatcacatactctccagactgaaaaagggctaacgggtcatttatgctaatcacccgactgatgcttgatgtcaccttcctatttgtttctctatcctagtaacagttaagccactttacattaaaggctcaggaaggaattatagattgtggttcagatgacttaggttttacttccagttctatcaactatttctaagatgtggggcaagccacttaaatcaattgtatctctgttcccttatctttaaaatgagggagttgtatagatgaccttgttggggctcagaaaaggattccccaaagtatggcactttggcatgctgagtactttgaactaaaggacattggaaggcctcagaatccacctcagaaccaaggtctctgaccttctcctgccctcctatctcttacccttcattctccgcaagtgagtcacagaaaccaggattcctcttccccaaggtgggtcacagaaactagaacccttttccccaaaggaagacataaaacctacaaatattactctaaacttccccagcctttctgcctaggagctggccataaagaaattctctgatgtacccttgtcagataggagatcataaggccctcattccagagtggccccgccctataccctggaaaaaggaaggtcacacagaaaggccaagaagaatctgaacaggccttgctgggtttctccactcttactattagttcattctcttttccagtcacatctctacatggctgtccatgcttcataagcataaaaacaagcagttttccctgggtgtttggctcttcatttctgaagtctcttataaatctttgaccaaataaacctgttacgcctttctcttattaacctcccttttcgtataggactgtcagccttgacccttatgatgggtgaggaaaggtatacctttctgcctcccaacctctaaggaactgttgaccacctctgtaaaaatctatgacaatatagatggagagcattttttgaaagattcatggcaggagcacttggaacaccaagaagaagaagaaactatgggaaatacaaacttttttttttttttatgttgagacagagtctcactctgtcgcctaggctggagtgcaatggtgtcatctcagctcactgcaacctccgtctcctgggttcaagtgactctcctgcctcagtctcccgagtagctgggactacaggtgcccaccaccacacccggctaatttttgtatttttagtagagatggggtttcaccatattggccaggctggtctcgaactcctgaccttatgatccgcccaccttggcctcccaaagtgctgggattacaggcgtgagccaccaccgtgcccggccaaagaatacaaacttttaacaaagtatttttttcaaatgttcaaaggaaatgtaatttagacatttttagagaacacacagtgaaaaaagtatggctgaacacatttttacaaataatgatcaaagtcctaatgtttcattacagtgatctggcaaaaataaacatgtcatgtaggattagtaatgaatgaatgaataatgaggaaacagaataatacaggaytaagacaaatatgaaataaaaaaatgagttctcctttaagcaaggaaccagctttaattaaagggaaaccctgaagcaaaccacttgggtcttaaaatactgttttggctgggcatggcagctcacgcctgtaatcccagcactttgagaggccaacgtgggtggatctcttgagcccaagagttcgagacagtctgaccaacatggcgaaaccccgtctctatttataaataaataaataaataaaaatttaaaatactgttttggctctttgtggtaaatcctgacatctacattatccagaatctaagtaaagaacttgctggctgggtgtggtggctcacacctgtaatcccagcactttgggaggccgaggcaggtggctcacctgaggtcaggagttcaagaccagcctggtcaacatggtgaaaccctatctctactaaaaaaatacaaaaaaattagccaggcatggtggcacacacctttaatcccagctattcaggaggctgaggcaggagaatcgcttgaacctgggaggcggaggttgcagtaaactgagatggtgccactgcactccagcctgggcaacagagtgagactccatttcaaaaaaaagaacttgcctttaaatcaggttaaaacaaatcctcagataagattaaaattcaagtcgactaaattgaaagtggcagatttcctgttggattctcctgcctctcagggtaaaacataaggactctctaactgctttattgcccttctaaaatcctccatgtctttgaatactgtcaaacatgcttagataactatgagaaacggcaatgcatgtctgctgtaggagattagcaaaggtatgtgaggtgaacttactgataatcattgaagacctaattgaattaaaatgctttagtaagttttaggacaggcttggtggctcacacctgtaatctcagtactttgggaggctgaggtgggcagatcacctgaggtcaggagttcgagactaggctggccaaaatggtgaaaccctgtctctactaaaaatacaaaaaattagccgggtgtggtggcacccgcttgtgatcccaactcaggaggctgagacaggagaatcgcttgaacccgggaggtggaggttgcagtgagccgagatcactgcataccagcctgagtgacaaagtgagactctgtctcaaaaaaaaaaaacaaacaaaaaaaaacatattaaattaaggcattaaaaaaaagaaaatatttctggcagattagggtcttactgaaattgcatactcatagcataacttttatggaaaacaatttaggactgttaaaaaaatattcatacctattaatccatttgttccatttttgggaattcattatagcaacggaaggaaaagtgactgtcccaatnnnnnnnnnnnnnnnnnnnnttttcaaagctcttgtagcaactcattttctttttttttcttttcttttgagatggagttttgctctttgttgcccaggctggagtgtagtggtgtgatcttggctcactgcaacctccgcctcccgggttcaagcaattctcctgtctcagcctcccaaatacctgggattataggcacccgtcaccacgcccgactcatttctgtatttttagtagagacggggtttcaccatgttggccaagctggtctcaaactcctgacctcaggtgatccgcctgcctcggcccccccacagggctgggattacaggcgtgagccaccatacacagccaaaaccataattttcatatttctaatagcagcttagtttttatctcttctgcagaaaccaactcagagtacttctaacagtttcaagtcctaattcataatgtgaagttatgttttattctaactaaggttaagaaattttataaatacttagaaacatagtcgagaaaataggttaattcaggagatctgatgggaaattacagtgagcagtgctaatctgggagtcaggttgctttgagggtaacaatattataattgcacatgcatatgcaagtatagtaaatactttctatataatataaattttatggtcttaaatactcatatgtgagcaaccatatgaatatataagaggaatcatgttatataaggtgtcacgaaagaagaaaggccttccatgtatcaaacaaaaaacccccacaaacacaaccagcatttatcttccttggaaaaagaagaaattaaaaatcaaatataaggtgaacatgttagcccactttacttccattcaatgatgttagcaaaaatatatcattatagaagatttaggggtactgatggttaagtgggaagagtagaagtgatctgggtagttaaaatttcttcagcttttttctctttagtttattaataaaagccattttatatgaactatttaaaaaatttattttttttgatgtgatgactcaaggtagaatatattgtatgaactcttgcattattatttttatttattttttttgagacgaagtttcgctcttgttgctcaggctggagtatagtggcatgaccttggctcactgcaacctctgcctcctgcgttcaagcaattctcctgccttagcctcctgagtagctggaattacaggcatacatcatcatgcctggctaatttttgtatttttagtagagacagggtttcaccatgttggtcaggctggtctcatagtcctgacctcaggtgatccacctgcctcggcctcccaaagttctgggattacaggcgtgagccaccatgcccggcctcttgcattattattaatattagatctctcaatgttatgataattggccattatgcacaaggcaaagtcgagatccataagagttaagtgatttattcgatgttctggagagatggcgtggatgggatcagcgttcgttttactgtatcttaagattttagttttagtcttagcactattattattttattagacagcaagtctcagttaatgttgtgcaggctgatttcaaacccctggggcctcaagcgatcctcccacctcagcctcccgagtagctgggactataggtgtgcaccaccatgcccagctaattaaaacaattttttatagaagcagggtttctctatgttgcccaggctggtgtcaaactcctgcattcaagcgatccacccaccttggcctcccaaagtgctgggattacaggcatgagccaccgcaccctgacacaaataacatttcaatatctcactttcctattctgtgaaatcagggatcagaaaaataacattttaaaatgtgatggagttggctagggtaatcaaaaaagtgttctgtgctagaaatttggaaatgcttggacaaacgaagttaaacagtttcttagctatagtatttctcagagcctttgacaaattaacattcataatagtggcatgttgcccttcacaaactttttggacatataaacactttttgttttatgttatggcacaccatgtaactgcagtgaatctgaaggatttcagggcagaacaaagaaaaagatgtgaccacaaggtggcagtgggacacaacaagctctctttggacagcgctttgacaggtttgtatgccgggaagtccctcacagcatgagaccttccaaaggcagcgacagtgtagggcggccactactcagaagggggagggtaagagaattcctggaggactagagagagggtgtatgtgtcatgacgttgtttagcagcaagatcggcggggcgggtgggggggtgtctctgggttacagagctccaaagggcagcagtgatttggggtcttttatagcctggggtttttatctatggatagtagacgttgagtgtagtttgcagggtatgtaaagcaggtgggctctagatagatggctaataatttggttatttaggctatacttaaacaattggatgtgtaaacatttgatttggtgatgatgggcttttgagctaacagtcctggttgctgtgaagaagtaaacaacacagggccccaaaggtcatttttagatcatgtaacggtaacacctagtccagcatttaccaactgtgatcttccagatcaaaaatatttttattccaaatattttgaactcctgccatttcaatgtctacttccactacttctggcagccacacaaaaatataagaagtgatttgaaaggggtatgctattctttttttttttttttttgagacagtgtctcaccttgtcactcaggctggagtgcagtggcacaatcttggctaattgcaacctctgccccccaggctcaagtgatcctcatgcgtcagccatcagagtagctgggattacaggcgtgcgccaccatgcccagctaatttttgtatttttagtagagagggggtttcaccatattggccaggctggtctcaaactcctaatctcaagtgatctgcctgccttggcctcccaaagtgcaggactacaggcgtgagctaccrcacctggccagaaaatgatatgctattcttgctgcaaatgttgaagttgactgataatttttctttaccataaagcagtggttcccaaagtgtagtctgcatattctgtagtctgagaccctttcagggttgtgaactgaactagttacttttytcatggaacaccatttttactttttaaaagaatgattgatatggtttgactgtgtcrccacccaaatctcatcttgaattgtagctcccacaattcccatgtgtcgtgagagggacccggtgggaggtaattgaatcatgggggcaagtctttcctgtgctgttcttatgatagtaaataagtctcatgagatctgatggttttaaaaggggaaaccccttctcttggctctcattctctcttgcctgccaccctgtaagacgtgcctttcgccttcagccatgattgtgaggcttccccagccacgtggaactgtgagtccattaaacctctttttctttataagttacccagtcttgggtatgtctgtatcagcagtgtgaaaacggactaatacaatgactacagtgtaaggttattcttatttgagtacttggcagactatttcatgaaaatagaagaaatgaggctgtcatttcaaagaaaacaaatgacagaatttgttgtcagtgataaagctttagctttcaagtgaattttggaagcctcgtagctgccactgtgatcttgaaagctatccaggacctttctaatgacatcagttattatrttaacaactgatttttgttttggataataaaatgtgtcaatatttaaaagatctatataactcagagaaccaatattttccgaactgccaatgcatgatgttacaaaatcatgcattggtaaagatcaactcaaaattcaagacagactagtgcatcataacacaaatgtatgaaaagtgcatcataacaaaatgtacgcaaagttcattgatatgttttcaagttccacattgcaacaacccataagaaattaccacttgctgagttttggggtatcaaagaagagtatccacaatgatctgaaaagtgatgatctgaatgaaaatatatctcttttctaggtaatagatttacgatttttaaaaaatgaatgtctattaaaatttatctgttttaatagaaattttaatttaacaaatatacataaacaaaaactctttggggatcctcagtgattttttttttttttttgagatggagtctcactctattgcccaggctggagtgccgttgtgcgatcttggctcactgcaagctcggcctcccaagttcatgccattctcctgcctcagcctcctgaatagctgggactacaggcgcccgccaccatgcccggctaatttttttgtatttttagtacggacagggtttcaccrtgttagccaggatgatctcgatctcctgaccttgtgatccacctgccttggcctcgcaaagtgctgggattaccggcgtgagccaccgcgcccggcctgggatcctcaataatttttaagaatgtaaatgggtcctggggtctatttgaaaaatactaccagaaagtattatttcaattactgaaacctacaaatggttaagtgttttctcatcaccaacataaaaatacgaaggtaaaaccaatagaattgctctgaaacatacggggaatacaaaatctaagatgcttcttaagtgagttacatttatatcacatatcttttagatttttataaattttgttttccataattgttttttttttttttttgagatagagtcctgcccactcttgcccaggctkgagtgcagtgaggagatcttggctcactgtaacctctgccttccaggttcaagctattctcctgcctcagcctcccaagtagctgggattacaggcacccagccccacactcaactaatttttgtatttttagtagacacagggtttcaccatgttggccaggttggtcttgaactcctgacctcaagtggtctgcccacctcagcctcccaaagtgttgggattacaggcgtgagccacttcgcctggcctataatggtattttaatttgtatgttgaacaaagatggctcttaaggttcaacattaacagcaattctacttttgtctcccttggtccctccaaagctgtccattgaaggatcattcttcccacactcttaaatgaaaatttagttaataccatgactttcacattttttccactatagaacgctcaaacagctgggcgtggtagctcacgcttgtaatcccagaactttgggagkccaaggcgggcagatcacctgaggtcaggagttcgacaacagcctggccaacatggtgaaacaccatttctactaaaaatacaaaaattagccagacctggtggcgggcgtctgtaatcccagctacttgggaggctgaggcaggagaatcacttgaacctgggaggcggaggttgcagtgagtcaagattgcaccactgcactccagcctgggcgacagagcaagactcattatcaaaaaaaaaaaaaaaaagaaagaaagaaagaaaaaaggaatgctcaaccgcatttgttattatttttttttttttggaaacggagtttcactcttgttgcccaagctggagtgcaatgacgtgatctcagctcattgcaatcatttagtgtgattaagctcattgcactcattaatcatttagtgtcattaagctttcctggtgtctgaaatcacatcaactaggcatttatcttaaatccatgatctgttaacatatctttggttactagtgatctccataatgacataatttatctcaaaagactccttggtttgaaaatctgattaaccactccagtatattttccagacttgaaaactggtatttaggccaggcatggtgattcatgcctgtaatcccagcactttgggagactgagccaggtggatcacctgaggtcaggagttcaagaccagcctggccaacatggtgaaaccctgtctctactaaaatacaaaaattagctgggtagggtggtgcaagcctgtaatcccagctacttgggaggctgaggcaggagaagcacttgaacccaggaggtggaggttgcagtgagccaagatcatgcctctgcactccagcctgggtgacagagtgagattctgcctcaaaaaaagaaaaaagaaaattggtatttattgcttctctctacagatgcttctcaatttatgatggggttacaccctgacaaactcataagtcgaaaatacacaaagtcgaaaatgtgttcaatatacctaacttactgaacaacatagcttagcctagcctacatgctcagaacacttaaattagcctacagatgggcaaaattttccgacacaaagcctattttttaataaagtgttgactgtctcatgtaatctattgaatattatactgaaagtgaaaaaaatgcttgcacaggttcttgaagtatggcttctactgaatgcatatggcttttgcaccattgtaaagtcgaaaaactgtaaattgatcattttaagtcagggatcatctgtgtgctgacagccaccacgtccaaccaattaatttttaatagtttaaaaataatccacatgatataaaattcaaaagatacaaaagggtatacaatgacattttttttcctactcttgttccttcacaactttctgtgcagctaaccccagttaacagtttctttttttcttttttctttttctttttttgacacagggtctcactctgttacccagactggggtgcagtggggtgatcatggctcactgcagcttcgacctcccaggcttaagtgatccacccaccttagcctcccacagtgctgggattacaggcataaaccactgcacccggccaccagtgtccttactggctctagtttcttaagaaatgtctttgcataaagatctaatcttcactacagatgtcactgatacccagatacaatctatggttacagccttggttaaggctggcaacctaaaaataaaaaagagaagytgtcaaagggacttcctaaaaataaaagagaagttgtcaaagggacttccaggataatagcttaacctacagaataattgtttagactggctgggcatggtggctcacgcctgtgatcccagcactttgggaggctggggtgggtggatcatgaggtcaggagcctggcctgaccagtatggtgataccccgtctctactaaaaatacaaaaattagttggatgtggtggcatgcgcctgtagtcccagctacttgggaggctgaggcaggagaatcacttgaacctggaaggcagaggttgcagtgagccaagattgcaccactgcactccagcctcggcgggtgacagagcgagattctgtcycaaaaaaaaaaaaaagaataattggaataattatttagactgtaataagaaaaatgagctggaaggactgggcataactactgatttacaagttagatccagtttatrttacggtgtggacctattataggggtaatatgaaagggtgccatggtttctagggtaggaggatatataccatggctcttatacaggcaaaatgggctactgctgttttgttctcctccagtgaagagccacattagcctaagagtccaaatttttctgactttttgtttgtttgtttgagacggagtttcgctcttgttgcccaggctggaatgcaatggcgtgatctcagctcactgcaacctccacctcccgagttcaagtgattctccgtcctcaatctcccgagtagctgggattacaggtgcgcaccaccacacctggctaattttgtaattttagtagagatggggtatcttcatgttggtcaggctggtctcgaactcccaacctcaggtgatccacccgccttggcctcccaaagtaatgggattataggcatgagccaccacgcccggctattctgatcctaatgtctacagtttgataatagttaacaagtcatttagtgtatttgatagatgtaatattataaacttgaaattttcttattgtttacataaagcatcatgttcaatatcatgaacacaaccactgctgccatcataatcttcttcataggtaacatttattgagcactggccaccattaccaccttcatttatcgttatcatgactaacatttattgagctcttactatgtgcaaggccaccacataaggaattgtcagaggccgggcgcggcagctaacgtctgtaatcctagcactttgggaggccaaggcaggcggattgcctgagctcaggagttagagaccagcctgggcaacacggggaaatcccgtctctgctaaaaatacaaaaaaaattagcctggcatggtggcgtgcacctgtagtcccagctactcaggaggctgaggcaggagaattgctttaacccaggaggtggaggttgcagtgagctgagattgcaccattgcactccagcttgggtgacagagcaagactccgtctcccaaaaaattwaaataaaataaaataaaataaagaattgtcagataatcatgactaagtctatgaggtaggtactctcattatgcctgttttacagatgaggaaactgaataatgaaatgggttaagtaatgtactcaaggtcacacagtaaaagatgaagccagaatttgaacccaagcaatctattgcactaacctgttatcaaggggcatccatggaagagtaatatacgtatttgaggacagtaagtaaggacagcttcgacagccccatcagtcagatttacacaatgtcccatatgaatctcctatgcaaaaataaagaaaataaagtcaaatgaaaacaaagatctataataacagtatgaacaattttgagaaacattctgatacaaaaagaaccagatatctacttgcaaaaaaaaagtatatagaaaagaccaatataagtctgaagtaatttggaaggagcagcttaaaaagttaaatgcccaaccattttataaagtaatgtgtaatagctattaaagctgaagatgagtatgccccagaactcagcaattccaattgttgatctacagagaatctcttctacatgtgcacaaggaaacaatttataaatatgccctttgcagtattacttgtaatagtaaaaaaagtggagaacgggaaaatcaatgctttatagaaaacagctaaaatgaaaaatatctacttgtattaatagacataaatctcaaacatgttagttcagaccctttggcaaacagtatggtagtatcttataaagctaaacatgtatttgctatatgacccagcaatttcactcgtaggcatttacccaagaaaaataaaaacatatgtctacacagaggtttgtatgcaaatgtctgcagcagtccaaaattggaacccaaatgtccatcaaatgataaaattatttttaaattttttaaaaatttccataggtttttggggaacaggtggtatttggttacataagtaagttctttagtggtcatttgtgagattttggtgcaaccatcaaccaagcagtatacactgaacccgatttttagtcttttacccctcacctccttcccaccctttccccctgagtccccaaagtccattatgtcattcttatgcatttgcatcctcataatttagctcctacttatgagtgagaacgtatgatgtttgcctttccattcctgagttacttcacttagaagaataatctccaatcccatccaggttgctgtgaatgccattaattcattcctttttatggctgagtagtattccattgtatacatataccacagtttctgtatccactcgttgattgatgggcatttgcattggttccacatttttgcaattgcaaattgtgctgctataaacatgtgtgtacaagtatctttttcgtataatgacttttttctctgggtagacacccagtagtgggattgctggatcaaatggtacttctacttttagttatttaaagaatttccacactgttttcaatagtggttgtactagtttacattcccaccagcagtgtagaagtgttccctgttcaccacatccacaccaacatctattatttttttattttttttattatggccattcttgcaggagtcaggtggtatcgcattgtggttttgctttgcatttccgtaatcacaaatgatgttgagcattttttcatgtttgttggccatttgtatatcttcttttgagaattgtctattcatgtccttagcccactgtttgatgggactgtttgcttttttcttgctaatttgtttgagtttgttctagattctggatattagtcctttgtcagatgtatagattgtgaagattttctcccattctgtgggttatctgtttactctgctgactattccttttgctgtgcaaaagctgtttacatttaattcccagctatttatctttgcatcaaatggtaaaattataaataaattatggcatatccatactatggaacactacttagcaataaaaaggggctgagtgtggtggctcatgcctgtaatcccagcactttgggaggccagggtgggtggatcatgaggtcaggagaccgagaccatcctggctaacatggtgaaaccccccgtctctactaaaaatacaaaaaaattagctgggcatggtggaacatgcctgtagtccccactacttgggaggctgaggcaggagaatcacttgaacctgggagatggaggttgcagtgagccgagatcatgccactgcactccagcctgggtgatagagcaagactccgtctcaaaaaaaaaaaaaaaggaatgaaatattaacatatgcaataacatggatcaatctcacaaacactatgctaagtgaaggaagtaaaataaagaaataaaaaccaaaatagtatattatattctgcagaattccattatataaaattatatgtatataaaattgaatttatatacaattatagaaaagccaaaacaatgacaaagtaaatcagtggttgcctaagagagggtcacagaaggggatcaactacaaaggaccagagacaaaaaaacaaaataaaaccacagagaacacagacaactttttagggtgatgaaaatgttctatacatcaattgtggtggtggttatatggctgtataacaattaccaaaatttatccaactatgcacataatatgagtgaattttcttgtatgtaaattatacctcaattatacctgaaaaatttcagaaaacataattttgaataacaaattgtaaagggacatatattatgaagctattatgtaaaatttgaaagcatataaaacaaggctatatcttatttatagatttgtacataatagaaaaagtatccatttctgtctgagcagggtccacaggaagaaaaaaaagaaaaggtatccaaacatgcaaggagagatacataatcatatttaggatagtggttacttctgaaggcagaaagggagaataattgagcagggctttagatgtaacattattttattttattttactttatttatttttttgagacagagtttcattcttgttgcccaggctggagtgcaatggagcagtctcggctcattgcaacctctgcctccagggctcaagtgattcttctgcctcagcctcccaagtagctgggattacaggcatgtgcaaatatgcctggctaatttttgtatttttagtagagacagggtttcaccatgttggtcaggctggcctcaaactctgacctcaagtgatccacccgcctcagcctnnnnnnnnnnnnnnnnnnnntcagcctctcaaagtgttgggattacaggtgtgagccactgcacccagctgtaacattattttagaaaaagaacaaatccagcactttgggaggccaaggcgggcagatcacctgaggtcaggagttcgagaccagcctggccaacatagtgaaaccctgtctctactaaaaatacaaaaattagctgggcgtggtggtgtgcacctgtagtcccagctacttgggaagctgaggcagaagaatcgcttgaacccrggaggtggaggttgcagtgagccgagatcactgcataccagcctgagtgacaaagtgagactctgtctcaaaaaaaaaaacaaacgaaaaaaaacatattaaattaaggcattaaaaaaaagaaaatatttctggcagattagggtcttactgaaattgcatactcatagcataacttttatggaaaacaatttaggactgttaaaaaaatattcatacctattaatccatttgttccatttttgggaattcattatagcaacggaaggaaaagtgactgtcccaatatataattatttctaatagctaaaaaccagaaacaatctgaattaccaacaataaaaaacaagtatgttacattatacggacagtctgttctctgatatgccaggatctagaacagtaaatgcttaataaatatttattaataaatgaaattttatacagcaaattaaattttaattataaggattaaagaaacttatgaaatgactgtaatataaggctaagaatgtgataacatttattgaggtactaccacatatctagaattgtattaaaagctgaggataaaatgaacaaaatgatgaacacaatgatcaacagagatttcagaaacgatcatgatatttgctaaatgctgtaacataagtttgtactaagtgcttgttgatctttttttctttaattttataatttttttgagacacggtctcactctgttccccaagctggagtgcagtagtgcaaacacagttcaccgtagcttcaacctcccaagttgaaggagatcaattgatctccccactccagactcctgagcagctgggagtacaggcatgcaccaccacctctggttaattttttttttgagatggagtttcgctcttgttgcccaggctggagtgcaattgcgtgatcttagctcactgcatcctccacctcccaggttcaagcctcagcctcctgagtagctgggattacaggcatgcaccaccatgcccagctaattttgtatttttagtagagatgaggtttctccatgttggtcaggctcgtctctgaactcccagcttcatgtgatccacctgcctcggcctcccaaagtgctgggattacaggcgtaagccaccatgtccagccaatgtttgtatttttcttttttctttttttttttagatggagttttgctcttgttgcccagggtggagtgcaatggtgtgatctcagctcaccacaacctctgcctcttgggttcaagcaattctcctgcctcagcctcctaagtagttgggattacaggcatgcgccaccacacccagctaattttgtatttttagtagagacggggtttctccatgttggtcaggctggtctcaaactcccaacctcaggtgatctgcccacctcagcctcccaaagtgctgggattacaggtgtgagccaccgcacccagcctgtatttttcatagagacaaggtttcactgtgttgcccaggatgttcttgaaatcctgagctcaagggatccacttgctttagcctcccaaagtgctgaaattacagaagtgagccaccacattcagcctcttgtcaatctttaggaaaggtccttagacctttaatcaaattgatttccaaattataaataatttagcaacattaataatttaatttcccagaatggaayaaattaaaagcaacagattaaaatgtgatgaaaggtaggcctccgcattacctatgagagtagttagtaaaaaaaaaaaaaaattagggctgggtgcggtggctcacacctgtaatcccagcactttggggggccaaggagggtggatcacctgaaatcaggtgtttgagaccagcctggccaacatggtgaaaccctggctctactaaaaatacaaaaattagctgggcatggtggcagctgcctataatcccagctacttgggaggctgaggcagaagaattgcttgtacctgggagacggaggttgcagtgagctgagatcacactattgcactccagcctgggccacaagagcgaaactctgtctcaaaaaaaaaaaaaaaaaaaattaaggccagacatggtggcttatacctgtaattccagcactttgggaagccaaggcaggagaactgcttgagtccaggagttcaagatcatcctgggcaacatggcaagacccatctctacaaaaaataaaaaagtagccaggagtgggggcacatacctgtagccccagctatttaggaagctgaggtgggaggattgcttgagccagggcagtcaaggctgctgtaagccatgatygtgccactgtactccaccctgggtgacagaacaagaccctgtctcaaaaaacaaaatttaagtttgtccttcagtttgagtcagaggatgctataaaccaaaggttaaagtatattcactcaggccaagcatgtggctcacacctatagttctagcactttaggaagtcaagacaggaggatcactgaggccaggagtttgagaccagcctgggcaacataaaaagaccctgtctctacaaaacaaaacaaaacaaaacaatttttttaaaaagtatattcaccctactttgtttaagtaaggcattaagttctaataaattttagagacatttccattaaaatgttttggcactttggaataatctttggaaaactgaaaaaataaaaaatgtaatgatatggcactataatcaccaacacactggttattgcatttttttctcattctacttaggttggtgctcttaattttataatgttgaggtaaataggtcagtatatttactatcatgcataacaactaatttcttggtggttttatttgaaggtgataaactaatttaactgagaactttatttaaaattatagtaattacaagataatgttgtaagcattacataacctagtgaatataaggcagttagtatacagcctggcataacagtaagtgctcgacaaatgtttgcacttaaaataccaaaaattactgctcctgcatttaggatgcaatttggaattcaaaacttggtataataataaatatagtaatttctttctttctttctttcttttttttttttttttgagatggagtttcgctcttgttgcccaggctggaatgcaatagcgcagtctcggctcactgcaacctcccacctcccaggttcaagtgattctcctatctcaggctcccaagtagctgggattacaggtacctgccaccatgcccagctaattttttgtatttttagtagagatggggtttctccatgttggccaggctggtcttgaactcctggcctcaggtgatccacctgtctcggcctcccaaagtgctgggattataggcgtgagccaccatgcccaacctaatatggtaatttcttaataaaatatttaaaaaatatatatgctaccaagacccagatatataaaatcacaaaaaagaatctctttgggcaataactcaaggataaatattttggcaaaaacgtggcattgtcattccattacaatagttggctttttaaaaaatgtatttatggcagggcacggtggctcacacctgcaatcccagcactttgggaggtcgaggggggcggatcacctgaggtcagaagtctgagaccagcctagccaacatggcaaaaccctgtctctaatataaaaattagctggatgtggtggcacatgcctgcagtcccagctactcaggagactgaggctggagaatcgcttgaacttgggacatggaagttgcagtgagctgagatcacaccactgcactccagcctgggcgacagagcaagactccgtctcaaaataaataaatwaattaattaattaaaattaaaataaaaaagtatttatttatttatttatttaagatataagttctcactatgttgccaggctggactccaactcttgggttcaagggatcctcctgcctcagcctccctgagtagctgggactacaggaatgcaccactgtgccctattaaaatagttatttttactaacatttttataattaatttacagcctgcctacttccaaaaaggatttgatgtagcttactgttaaatagcatagttatattaaaccacttgtcaactggggaagacagaaaccaaaatcctgggataaaaggcttcttaatatatttagaaataggttacaagtgcattagtgattcaattcaaaggatgaacacaaatttaagatcttttttaggccgggtgcagtggctcactcctgtaatcccagtactatgagaggccgaggcggtcggatcacctgaggtcgggagttcgagaccagcctggccaacatggtgaaaccccgtctctactaaaaatacaaaaattagtcggtggcacacatctgtaatcctagctgcttgggaggctgaggcacgagaagtgcttgaacctgggaggtggaggttccagtgagccgagattatgccactgcactccagcctgggcaacagtgggagactccgtctcaaaaaaaaaaaaaaacttttttaaatgatcgtacaatgtggctatcaagaaaaataggatgacaggatgtcaagagaattaatactcctggtagaaatatcattaagacctgaaatcctattataaataatatcactttacactgataaacattcataatcttcatccataataagatgattcttaaatctgttagaagctaaaacttctgggaaataaggccttttattggaagtaaaatgagtttttattttaaagcacctttattttatatcctaacaatttttatttactctggcaataaagagatagaacacccaccaacaaagtccctaaaatacgtaattgataaagcattggttatcygstaggttttaaacataatttctaagaatataaaaatttaatcaccaccatctttataattgytttaaaattacctctaatttcttcgcacaaggtccactaacaagtgcaatcacaccactgtcagatacctaagcaaagggaaaaagaaacacagtccatgaatccagacaacggaagtagaattttccaaaatgtattcattatttagatatagtcttaatgcctcccattcatcaaacatgtgttttagccatatatacctttcacccttgctacttaattgagaggaatatgccaatatatatctcaattacttaaccacaaaaagcatgaagtggtcaatagtttcaacaaaaacaaaatgaactccttatgatatgttctcattagtcatgaaaatacatttggtaaacacatagtctatatgtttgtagcctatatgtcatttacctgagtagctgaaaagtcgacacactgcaaaaatgggcagttttttcctaatgcatgtaaggacacatcagtaatacttaagcagccacctaaatcgatgatctttagcagctggcaattgagtgcaagagcaacgactccttcgtcagtgagattgcagcatcttttcaaagaagcttcgtgtaggtatgaacaagatgaagccacagcttttattcctgggggaaaatataattatatatcaatgagctatatgtgtgtatatgtatacatgagaaatgtgactgattttcattttagcaatcaccagttcagtgttagcccttttcaaagtagtccacctgtgaggaaatactgattttccagtgatgctgtcattattcagaactcttttggaatgtttcaggaattctctacacagkctgtagtatctgcaattaatggcaaggctttattgtccacaggttgaattccttttaggaaataggcaaaagtcattcagaacccaattagatagtgaaatagtaggcgattctccttttggttaaaacaaaaattttcaagtaatcaaattacttttctagtggactttggaggcaaaccaaaagttaaactgcccaaatggtttcagtcatgatcttcatgcttgcggttagaaatttatagctatgcctatgtgttctctctcgctccactttgactctgttctcaaaagtgaatttattttctaccaccatgctccttctgttagcctggaccaatcttacattttcctgagggtcaaaaaagagaagtctttaaatccagttaagctgatataagtgcccattggagatgggtgcacataaataaaagagtacttcggggatcctgggccctttggtcataaacaaacatggtagcactgttaaaagatacctttatgggcaaaatacacagaagggaagatggtaaattcatgggtaggtcatttttactgttttccatatcttaagaaagaactttttttttttcttaagaccagttattttatttatcagtgtccagcatggaagttgtgatacaataagaactgtatttgatctttgttcccagtccctgacacagagctccgaaaagccttataatttcctgagtgaccggagtgccttttgttagtcataataagccccttttgatcatacctgagtttaagctaatgaggtgacagcatgtgacccctagatagcctaaggttggggcctgtctccagaaaaatcaagtgagtagagggttagaacattcagctcagtccacagacctttggcgaggtgggggtcagggacggcagggaataggggatggggattaagctctataaaaactcttgggmcgggtgtggtggttcacacctgtaatctcagcactttgggaggccgaggcgggcagattacttgagctcaggagtttgagagcagcctggccaacatggtgaaaccctgtctctactaaaaatacaaaaattagctgggcatggtgttacatgcctgtaatcccagctactccggaggctgaggcaggagaatcagaatcacttgaacccagaggtggaggatgcagtgagccgagatggcaccactacactcaagcctgggcaatatggtgagactctgtctcaaaaaaaaaaaaaaaaaaaaaaaaaaagaaagaaaagaaaagaaaaaggaagaagaaaaaacaaacaaaaaacctcttgaacaagaagacttgatgagcttctgggttggtgaatgcatccacatgctgggagggcagtgtatcccaactccatggggacaggggctcctgcgcttccagacctcaccctatgtactcttcatcttgctgttcatctgtatcctttataatctcttagaataaactggtaaatgtaacaaaagtgtttccctgagttttgtgagccattctgacaaattattgaatggaggaggaggtcatggaaaccctccatttatagttggtcagtcatatgtaccagaggcctggccttgcaattggcatctgaagtggggatagtcttgtgggactgagcccttaacttgtgggatctgaggctaactccaggtagatagtgtcagaattgaattaaattgtagcgcacccagctggtgtccagagagttggagaattgtttggtgtgaaaaaaccccacacatttgctgtcagaagtgtggtgtgagtgtagagaaatgtggttttattggagaagttcttttttgtgagttattatttatgtaaacatattaaaacttatgcgtgtttgcaatattatgaatatcctaactcgctaaccaagatgactgcaaaatatactcaactacccacacagttttccagaattctaagaggccaaaaaagtccctctttcttatatttaaaaaaaaaaaaaaagcctgggcaacctagtgagacctcgtctctactaaaaataaaaaattcgcagtgggtggtggtgcacatctgcggtcccagctacttgggaggctgaggtgggaggatcgcttgagcctgggaggctgaggctacagtgagccaagattgtgccactgcattccagcttgggtgacagatcaagacactgtcttaaataaataaataaaaataagtattaatgcaaaccaaatattgaaaaaaagaggtctatagagaggaaaaaaggtaaagattcactaactcatgtaatagtgacactgaacaatgcagtttgtctagctataaaaagctatgcattacacaaactgataggagagtacctagtaaatttaatctgatgattaattcttttgtaatatggcatcaaaaaagccttaacaaaatatgaactggtcatttcttcttccactataccaggcaaaatatttaaaatacagacgtatgtatccatgttttgttttttttttagttttaattttaattttatttatttttttgagacggagtcttgctctgttgctcaggctggagtgcagtggcgcaatctcggctcactgcaacctccacctccccagttcaagcgattctcctacctcagcctcccgagtagctgggactacaggcacgtgtcaccatgcccggctaattttttgtagttttagtagagacggggtttcaccatgttagccaggatggtctcgatctcctgacctcgtgatccacccgcctaggcctcccaaagtgctgggattacaggcgtgagccaacacgcctggccaattttttgttgttgttgttgtttatttttgagagagttttgctctcattgcccaggctggagtgcaatggcacaatctcagctcaatgcaacctccacctcctaggttcaagcgattctcctacctcagcctcccaagtagctgggattacaggcatgcaccaccacgcctggctaattttgtatttttagtagagacagggtttctccatgttggtcaggctggtctcgaactcctgacctcaggtgatccacctgcctcggcctcccagagtgctgggattacaggcatgagccaccgcacctggccctattttttatttctttctgatagagtctccstatgtcacccaggctggagtagtggtgcaatctcagctcattgcaactgctacctcccaggctcaagggattctcgtgcctccacctcctaagtagctgggactacagggtgcaccaccatgcctggctaacttttgtattttttgtagagatgaggtaggggtcgggggcggttcatcatgctggccaggctggcatcgaactccttggctcaagcagtctgccggcctcccagctaaaaaagtgctggaatgactgtcataagccacctagcctggcccatgtttattttacatatgtttaaaatacaaggtagtgacttacccagtgtctttcttaactttgagcactgattataagcaagaattctaacttggattattttcttagtctgaatgtttttactgataaatataattcatatttctctgacttcttcatactctcttttgacgtattttctcccttactccacaattttaccagatagtgaatagtaatctaccaatgtactcagtgttaataaacataccttctgaagttacagaaactcggttcccttttgaagcatttaaatttaatttcttcagttttctacagttagacaggtgcaggagagcagcatctgatatatcgcagctccgtagatctagagtttggacttcaggatgtaaaatctataacaaataagtgattttgaaaaaattatttctttctataaatacaaatatttattccatattcagtgttttggtggtcataacagacaagtggctgatgtaaaatacagcaaagaatacagaagcatatccatgtgcagacagacacacaaagcaggagaaaaccacttctacttccagcaggaggtgcagctttcagtgctggcaaagtccttcttgggacacaaagcactgttgagatggctaattcaggggaaggatccatagacctgagaagcttaaccaatgtggcagtgagtaataatcttctggtagctgctggcattagagactctccctatgggcctctgtgcttaggaagtatgagtctttaatcacttgtgtaccaagtgcttacagagcactagtactgcttatctagaacatttaccttctatatcattatttttgggagctaataaaataccccagtattattgggtgttttcttgaggttgacaaataatagattaattcctaagcattctgagctctttcctgtatttttstgttctttattttttttccaaaatagaaatggctttacctttctgaaaataaaataaggtattattattgtaaaacactcagacaatttagaaaaattataataagttataagaataatgatttctatttattagatgcttaccaggaagggtactgtcatatacattatattattttttattttattttatttttgagatggaatttcactcttgttgcccaggctggagtgcaatggcgtgatctcggctcactgcaacctccgcctcccgggttcaagcgattctcctgcctcagcctcccagtagctgggattacaggcatgcaccaccacgcctggctaattttgtattttttagtagagatgtggtttctccatgttggtcaggctggtctcaaactcccggcttcaggtgatctgcccgccttggcctcccaaagtgctgggattacaggcgtgagccactgtgcctggcctacattatgttatttaatattctctctctctctctttccactgcccaccaccccmctgcccgcccccaagggattggtcattgccattttacaaatcgggaattaagaccctgagagcttaagtagccaacataaagaacatagccaaaaggagtggagctgggattggaacccaggtccttttaattccaaagcctaaccttttaacctctataactaaaattacccataataccaatacccagagataaaattatattagctttttaaaactgttagattcagggggtacatgtgcaggttagttacagggatatactgcatgatgctgaagtttaggcttcaattgaacccatcacccmaagagtgaacacagtacttgacaggtagtttttcaatccttgcttcccttcctccttcctcccttttgaagtccccagtgtgtatttttcccatctttatgtctgtgtgcacccagcgattggctcccacttataagtgagaacatgcagtatttggttttctgtgtctgcatttattcattaggataacggcctccagctgcatccatgttgctgtaaaggacatgattttatggctgtatatattcattttgatgttttttgagtttaaaaaacgctttgaagaacaacaggatcagatcacatataagatgagcactttttataaaatcaatagattgtggttgtatattattccattttctgcaagtatcataacttattaaatgcatcctacactggcaaacacttgagttgaacatttaggttgctttaggtaggcaatattatgccgtgattaagaacatgtgctttgcaagcagactgcccaacctggaaccctatgattgccatcaagctcagttttctctctgtgctttactagccttattactaaaacaggatatgttgtgagaaataaaggtgtcttgcttataacatatgctatatataactatgcttattatcataaatgatattataatgaatatatgtgtgtacttttctattatcttcctgagatttctacaggaagtaaattgttgaattaataataagcaaatctttagaatttttaataatgccaaactgtccgtctaaaaggtttttttaaatcaatttacactctcactagcaggagataaaagtgacagtttctccacactattgctaacattgggttttgggatttttttaaagtctctgccaaactgaaaggcaaactgtcactttgatgactagtaaggttaaatatcctttgatatgttattggagatttgtattttttcctctgagtatttcctgattcttctggttttttatttggttgttttgttttttcttattggcttggagggattctttatattgtcaagataaaaaagcccctagattttcatacatactgtaaatatttttccaagtttttgactttgtttcttttttttttttcttcttgccataaggaagtctgtatttttatgtaatcaaatccatccaactttttttcttggtttccaactttagtatcatgtttaaaaaggccttctccatccagagagtataaaaagatttatgaaatacttcaaaaacagccatccaaagatgtgtgtcactttgtaatggatgttgtatctggctttttgaataatgtcataagcaagactcttgttaaggatggagactagagggagagtacccagaaaaatcatgtcttgtttttctatctcattcaccctcttcacccctccttttaaattcagctaaaattaggcttaaaaaatggtaaggattgccatcaaacaaaaacctaagtcactgaaggataagctaaagggatagtaagaaatgtggatggtggaaaagtgaagaaaaccaccatttttctacagtgtcattatggttcatctatgagtcacatataacattacatacttcaacagaaccatcaacaataagaacgtggagatattattctacttccacagagccaagcaaactacaccactaaggtatctatgttcaaatgcaagctaacatgaagaaaataaagcattataataaagatatatcaggttaatgcagaagaaacattaaaaacaggttaaagtgcaattccaatgtaaagtcacagggttagtcacatgctctagcatgtaggctgggcactgtggctcacacttataatcctagatctttgggaggccaaggtgggcagattgcttgagcccagaggktcaagaccagcctgggcaacatggtgaaaccctgtctctaaaaaaaatacaaaaattagctggatgtggtagtgggtgcctgtagtcctagctactcaggaggctgaggtgggaggatcacctgagcccaggaggttgaggctgcagtgagccatgattatgcactctaccctgggtgacagagtgagaccctgtctcaaaaaaaaaacaacaaacaagcaaaaaccacagaaaaacatatgctggagtgctatcatcagaccttgcttccttttgattacaggctttaggcagaaggtgaagtgaagtcagagcaattgtggagtcctaattagggaaaaggagtcaggctggcaggacaaggggaaagcaaataagctacaggtctgcctttcttcatggtccagaacatataaacaaaaagaagaagcagataagctataggtctgcctttctttatggcccagaacatatagccctcctgtgcagacaacatacaaaactcataaacctcctgcttatcaccaaacactttgatctatcatcaaacacctcggctgacagaaggatgcaagttagttccctcctaccttggtgctgtcaatcagcccaagttccattctataaaatccccagcaagcctttgtctcctggcagttgggtcctctcttgctggttctgcccgttgctcccttgcaatgtattttcatattttctctaataaatctgcctttcttggccgggcgcggtggctcacgcctgtaatcccagcactttgggaggctgaggcgggcagatcacaaggtcaggagatcgagaccatcctggctaacatggtgaaaccccgtctctactaaaaatacaaaaaattagctgggtgtggtggcgggcgcctgtagtcccagctactcaggaggctgaggcaggagaatggcgtgaacctgggaggcagaggttgcagtgagccaagatcatgccactgcgctccagcctgggtgaaacagcaagactccgtctcaaaaaaaaaaaaaaaaaaaaaaaaatctgcctttctttacctacaactgtcttggtaaattcttttaccaccatcccaccagcctggatagatgccgctcacccccaacagcaattggcagttctagtctctgcagactagatggtgatggctgcagagtggtggtggctgcaaacccaaagacaatatttaaatgtaagtagtgtagaaactactaactagcattttcactttttgaaacacaaatagcaaaaatacaaaagataacacaggagtagtatcgaaggaaattatctactctgctatttaataacctttaaaatcagaggctgaaggttaagccctaatctcacgggctgtttagcagaacaaagagtgattaacyatctttttctagtgcttggggctctctgccttggagctcatcactccagcccctctccaggcctccaccccctatgtcagcttagtagggccgaaacagacttgggtctggcctcctttactcttaccactaccagagagtatacagagatatgttcacaggccaaaacaagacatctagagagcaccactatttcaaaagaaaaacaaagattactgattccatcaggagcagaggaattagaacagagaggccaaatatattaataagcataataatatgctaaaagaaataagaaaagattaataagataaaacaagaaaccataaaaaggtgaattggaaatattaaatatgaaaaatatagcagttgaaaaaagaacagtatagatgagaagagtgattttttaactactggtcattatccatgaatggattacaaaatcagtttagcagactgtgatcaatattttttcagtaaaataagactaaatagaataaaattaaatagaaaagaccaaaatgtactatacattatactgttacacctaagtgtggtttgtgtactacagtcacaatgtaacgtatatttcttattgtgagtcttgatcaaaaagttttaaactttttgaaaacacggaggtcaagggtacaggtaccatgaagacaagtgtgtatggaaggctaatgggagctgaccagaacaacaccattttgttcctgaatgtcattctgcaactgcttgactgtagaacgtacttgctgatgctgcagatgaaattgctgccacttctgaaaagactatgctatgctgatgactgaactttttccaaacccctgaatcaaggacttctgcctagaaacccttattctaactaatgaattgtttgataaccctctcccacctttctctttaaaagacctcatatatctcttaggacatatgaattaaatagttaggacatgatttcagatgcctctggaatctgtgttccttgaattcaattctaaaaccaccaataaacctttttgcttggattttcagtctccacgactctggttgacacaagagaagtaactgagacaatggtagaagatgttttaggaactattacatgttgcgggaagtcagggaccccaaatggagggaccagctggagccatggcagaggaacataaattgtgaagatttcatggacatttatcacttcccaaataatgctttcataatttcttatgcctgtctttattttaatctcttaatcctattatcttcataaactgaggatgtacgtcacctctggaccactgtgatgattgcattaactgtacaaattgattgtaaaacatgtgtttgaacaatatgaaatcagtgcaccttgaaaaagaacagaataacagcaattttagcgaacaagggaagacgaccataaggtctgactgcctgcggggtcaggcaaaaagagccatatttttcttcttgcagagagcctataaacagacgtgcaagtaggagagatattgctaaattcttttcctagcaaggaatattaagaccctagggaaagaattgcattcctggggggaggtctataaatggccactctgggagtgtctgtcctatgggagtgtctgtcctatgcggttgagataaggactgagatacgccctggtctcctgcagtaccctcaggcttactaggattgggaaaccccagccctggtaaatttgaggtcagactggttctctgctctcgaaccgttttctgttaagatgtttatcaagacaatacgtgcactgctgaacatagacccttatcaggagttctgattttgtccttgccctgtttcctcagaagcatgtgatctttgctctgctttttgccctttaaagcatgtgacctactccctgttcgtacattcctccccttttgaaatccttaataaaaacttgctggttttgtggctcaggtgggcatcacagtcctaccgatatgtgatgtcacccccggcggcccagctgtaaaattcctctctttgtactctttctctttatttctcagaccagccgacacttaggaaaaatagaaagaacctacattgaaatattgggggcaggttcctctgataattrcatatggacattttggttatctggagggaaaaaaacaaacccttatactttataatattctaaaatgtgggccaggcatggtggctcacacctgtaatcccagcattttgagaggctgaggcggatggatcacttgagctccggagttcgagaccagcctgggcaacatggtgaaaccctgtctctacaaaaaatgcaaaaattagccaggcatggtggtgtacacctatagtcccaactactcaggaggctgaagagggatcacctaagtccaggcagcggaggttgcagtgagctgagattgcaccactgtactccagcctgggcaacggagcatgaccctgtataaaaaaaaaaaaattaaaaatgattaccagtcttaccatataccattgttccaaaaatctaaaaccatatctaaacagaaaatataatatgcttgctttacagttattcatactcttacctcacttatatttgaatctgttatctgtccctgcatactcattattttaatcagtctgtcttttatgttgggaggcaaaggcttaatgtctgtgagatatctggaaatattcttcatgaagcaccaaaggcatctgaaatacaaatacaatatagtaaatcacactgggcctgtactgattcctaacacttgtcttaatgctatttgttagcacttagccctttcataaaagtgtgtacattttggctgggtgtggtggctcacgcctgtaatcccaacactttgggaagcccaggcaggaggatggcttgagctcaggagtttgagaccagcctgaacaacatagtgaaaccctgtctctacaaaaaaagaaaaaaaatacaaaaattagctgagcatggtgatgtgagcctgtagtcccagctacttgggaggctgaggtgggaggatcgcttgggcccagaaggtcgagactgcagtgagctgtgattgtgccactacgctccagcctgggcaacagagcaagatcctgtctcaaaaaaaagtatatacattttatattaatactatatttacaactttagctctgtaagcttcaaaaacctagtctgtgttaaattacggacaagatgctcttcctctacaatttttttctatgcatacctcatttatcaaaatgcattttaaatgaccaacaagaatgtttttcctaagtgtctaatttctaagacacatactcctaaataagctttatattgggacccactaattgaaaagttttatctgttaatccagcaaacttgtttttactatttttcttgaaaactatgtggataatgaaatcactagagaaagaaccataaccacaaagattcagcaaatattacaaatcacagagatatcaaactcagtgccagggttgtataggcagaaagtagagttatcaggcaacaaccaagaatcttatgaccaacatatcttatctgtgtcctgaaattccaaccatctgaaaaactcatactttaaagaaacaaatacaaatcttattaatttctgtctacaaatatccccatatatacaaaattttacattcatgagtgaatgtgatcatatacctgtgattaattttttagtgcaatgttaattttttctttttcctcttttggtttcctacacagtttcctctcttgtccttccccctccattagctctctacaccaatgtagcatatattctttcttatttttctctgttcttgtmcacacacacacacacacacacacacacacacacacatttaaaggcttgtgtgggggaggggtcattgtttcctaaaacggcaccacagtacacttacttttatacactgtctttcattcagtatcttatgaaatcccttcaaggcatccgacacagtactgattctcccttaatggtcacatcatatttcacagtacggatgatctatttagtgacttgtatgctgacaagcattaccactatttctaggatatgttgtcagattatttttcagaaagtctggaaaacacttcatatttctattagtagtgtcagaaagctcctttccctctacatccttccagcaatagatatcatggctagtttatttattttttgagacagagtctcactctgtcacccaggctggagtgcagtggcatgatctcagctcactgcaacctctgcctcccaggttcaagcaattcttctgcctcagcctcccaagtagctgagactataggcgtgtgccaccatgcctggctaatttttgtatttttaatagagatggggtttcaccatattggccaggatggtccaaactcctcacttgggattacaggcatgagccaccgcacccagccctatttatttattttatatttaattttaattttatttattctttccatttctttgttatctccatttcccactcccattccccacccctctaggaaaccattctcatgtttaatgtgtatcctttcattgtatattkccttttaacatgtttattgtatgcatgcatttctaatttataaacatgggacttgtcatagatttgtttagtttttcactcagcactgttttcaagatcacctactcttaaatgttggaaggcctaacaggtgaaaatgatgtctcactattactttaacttgtatttctctaattaccaataaacaacatccttgcatgagcttgctggctatctggatatgcttttccataaacaatctatacatatcctttgcctgttttgttatttttaaaaactgatacataatagatgtacatattttcagggtacatgtgataatttgatacattcatataatgtgtaaagatcaaatcagggtaactgggttatccatcaccttaaatatttatcttttgtttatgctaggaacattcaaattattctcttctaaccattttgaagtgtataatagattattattaactatagtcaccctacccatctattgaacactattttttatttgtgtatttatacccattaatcaacctctctctatgccgccatcccctgcccttcccagcctctgttagccacccatctactctctatcttcatgatatccacttttttttagttcccacatatgaatgagaacatgtgacatttgtctttctgtgtctggcttacttaacaaaatgacctccagttccatccatgttgctgcatatgacagaattcattcattcccccctccctcccttcctccctccctccctccttccctacctccctctctcccgagatggggtcttgctctgttgcctaggttggggtgcaatggtgcaatcacagctcactgcagccttaacctcctaggctcaagagatcctcctgcctcagcttctagaggcatgcttaccacacttgactaagatttcattattattttattttattattattttttttcaagatggagtcttgctctgtcgcccaggctagagtgcagtggtgcaatgtcggctcactgcaacctctgccacccaggttcaagcaattctccttccttggcctcccaaatagctgggattacaggcacatgccaccatgcccggctaatttttgtattcttagtagagacagggtttcaccatgttggccagactggtcttgaactcttgacctcgtgatctgcctgccttggcctcccaaagtgttgggaatacaggcatgagccaccgtacccagcagatttcattattttttaatggctgaataatattccatcatatatatgtattataycacattttctttattcattcatccattgatgggcacttaggttgattccatattttggttatttttatttttttgagacagagtcttgctctgttgccaggctggagtgcagtggcacaatctcagctcactgcaacctctgccttccgggttcaagcaattcccctgcctcagcctcccaagtagctgggactacaggtgcatgccaccacactcagctaattttttcttttttagtagagacggggtttcaccatgttagccaggatggtctcaaactcctgacctcgtgatccacacgcctcggcctcccaaagtgttgggattacaggtgtgagccaccatgctcggcccatattttggttattacaaatagtgctgcaataaacatgggagtgcagatatctcttttatatatttatttattttcttttggatatttacccagtggtgaaattgctgaatcatagggtagttccatttttagttttttgaggaccattttgttatttgttgacaaatttgtaagagctctttgttgtggccaaatacatgctctatatattcagagaatgtatattatctacgtgagagatgtaatgttctctctgtgtgttatatatatatgtatgtataagtatctctctccatgtatgtatatgtgtttgcacataaatatgtttaatgtatatatgtttatttacagtattatctaattctactatattcttatttttctactaaatgtggaatttctagtttatgatatttgtaatttaaaatcaagtcttcttttcatttctgcaagtttttgcttgttgtyttataataaaaaatttcaaaaatacagaaatataaaacagggtgatatayatctatgtacctcaaacctagaattttgttactcttttatcatatttgtgtcagacatctcaagacataaaacatttctgattaaggctgagcatggtggcttatgtctataatcccagcactttgggagactgagacaggaggctcacttgagcccaggagttcaagaccagcctgggaaacatggcaaaaccctgtctctacaaataatacaaaaattagctgggtgtagtggcattcacttgtagtcccagctacctggggtgcgggggtgctgaggtgggaggattgtttgagtccaggaggtgaggctgcagtaagctgtgattgtaccactgcactccagcctgggtgagagagctagaccttgtctcaaaaaaagaaaaaaaaaattttctgataaaattaaagccacttttatatacgcgactggtttactctatgtatctctgtttgtagagacaattactaccataaagttttaaaaatagttcctgtccattatttaattatacttttaatactaatacatatatctataaataaattattgatttttaaaatataaataaagttcccttaaatcatttcacaggagttgctacagcagcatggaaagcttttttaatattattatattctcaaagctgtactatgagtcgggggtaaagaaaaaagcccmaaaaattttccaattctcaaattatagcttttacggcaggaaagcattagaatacacctccacctgtaacataaagcaagcaaaccaccagatatctccaactaggatcttaagattccctctaaattgttctctagaaacaccatttgtgcctttaatctgcctttaaaatttttatttatttatcttgagacaaggtctcactctgttgcccaggctggagtacagtggcacaatcacagctcactgcagcctcaacctccaaggctcaagtgatcctcttacctcagcctcccaagtagttgggactacagacatgcaccaccacaatcagctaattttctgtatttcttgtagagatggggtctctatatgttgcccaggccggtcttgaactcctgggctgaagtgagcctcycaccttggcctcccaaactgctgggattacaggcatgagccttgtgctcggccttaatctgctttttaaacaggaacacagaacaaaaaagattgtttgcaaataaacatttgaaagaatatagcaacagctgatcagggtccaggcattgaaacaaagcaatgattgtagaagacaatacaaacaactctggagcaagaaactcaaaagcagagactttgcagtaatgtgtatgctggttatttccattgacctaaaagctctacctgaaacaaatataaactaggaggatctttttaacttattacctgaacagaaagaagtcactgccaccaacaacattgtgcaattttattaaccattcaagtccagtagcatctggtaaaattaggacagaattgggattaaaaaatgaacaaatattccgtatcaaacagttcaaaagaagccactacatactcttttcacaaatatgtttcacaaagccagtacagtactagccattaacccaagtgtactgaagtagcaaagatgcaacaagaaaaatagctatgttagaaagaccaacattttagaaaaagagtaaaactctttcagtttcttccctttagctcctaaaacaacattgtacaggctggatttacctatctagtcctacatcagcttctagaatatttgtcaggagcaaaaaataaaatgacactggccagtatagtctgaatatctaggaagaagagcggggagaaagtcagttcttagaacaaattagtcagcttcagcctcatcaccaggatctctggattctttgctcttccgcatttcttcaacgtgcttatctttctctgcaaacactccagtgtggtagtcatttgcgccttcctgttctctttgttagcttccattttgtgggtcagtttctcttctgctatttcactgaagctgttcttttattgatttctgaagcacttctttctcctgctctcatttttcagcaagctgcttcaagacctcagcttcgcagggcttgtgtctttcttctgaagcttctgatttattctgaatttcctccagggaaagatctttcttctttggaggggaaataaggaactctgggatggattcttttgatggtatctgagaatcagttcaaaagcctagcctgaggcacacttctccagtgctttcacctggatatcagaagtagccatgatgaatgaaagacaagagactggcagtgtattctacaaaatccactgggataaggaaaactctgctagatctgagccacctgaccacactctgagctgttttctgtatttataaaatgtaagagtagtttattaagtttcctaacgtgactaaatttgactaaactacatgacaggtttcctttttgtaagactggtgtcagttgcaaattcatgatattttcttgtggaatattccttttatcattaagtaatgtctctctttatccgtattcatgtttttcactttagagactattctgtttgatttcagtattgctccatcatttttccatggtttcttttgctcaacattatgtttgtgaaatttatctgtatcgttacatgtagctatagattattcatttccattttcacgttgttcatgtccattttcactaacgtataatattctgttgtttgaccaatttattctacagtgaatatacagttgggtcatttgtaactctttattattatgaatatcaatatgaatattcttagacatgtcttttggtacacacgtatctgtgtttcaactgagtgtatatatctagtagtggaactgctggctcatagggtaggcatatgtttagcttaatgccagtttttcaaagtggttgtacccaatcacaatcctaccattggtgaatgagcattcttgtggtccatatccttgccaacacttggcattgttaatcttttaaattttagtcattttagtgggtatataatagcaatgcaatgtggcattaaattgcaatctctgattaatatgggtacacattcatctttttattgtctggttggatatcctcttttgtggagtatctactcaagtattttgccctctttcattttgggttaattatgtttcttactgatatataggaattcctgttatatgctggatatgaaccttctgtttgttatatacgttgcaaatatattcccccattccgtggattgcctttccactttcttaatcatgtcttttgctgaagagaagtacattctaatacagtccaatttatcagtgttttccattacagcaggtgattttttgtcctgttcataaactttccctgtcctaagttcatgaagatattctcctatgttttcttctacaagaattcactaagtttattgtttcacctttcctttttgacttacaaaccaccaggaactgatttttttttttacatttttatttaagttccgggatatacacctaggtattaagccccacatgcattgtctatttgtcctgatgctatcctttcccttgctccccccaaccacaggccccggtgtgtgttgttcccctccctgtgtccatgtgttctcatcattcagctccacttatgacatgcggtgtttggttttctgttcctgtgttagtttgctgaggatgatgtcttccagctttatccatgtccctgcaaaggacgtgatttcatttctttttatggctgcatagtattccatggtttatatgtaccacactttctttatccagtctatcactgatgagcatttgagttggttccatgtctttgctattgtgaatagtgctgcaataaacatatgtgtgcaataagcaaacattcattgtaatagaatcatttatattcctttgggtatatacccagtaatgggattgctgggtcaaatggtattcctggataaacacattcgttatgaagaaagattaaataaattcttctctagtgtcaagctactttaaacttgttttaattcaagactcttccgtggtgccttctaatctgtctacagacagtctaatttaattcagtcttatttaattcacaagaggcagtatcagaaactgggatttcttggtaactaagatttatagttaactttttttttttaattttactttaagttctgagatacatgtgcagaacattcaggtttgttacataggtatacatgtgccatggtggtttgctgcccctatcaacctgtcatctaggttttaagccctgcatgcactaggtatttgtcctaatgctctccctccccttgtccccaaccccccgacaggccccagtgtgtgatgttcccctccctgtgtccatgtgttctcattgttcaacctgaatttgaatgttggcctgtcttgctaggttggggaagttctcctgcataatatcctgaagtgtgttttccaacgtggttccattctctcaatcactttcaggtacaccaatcaatcgtaggtttggtcttttcacatagtcccatatttcttggaggctttgttcgttttcattcctttttctctaatcttgtctttgcctcttatttcagtaagttgatcttcaatctctgctattctttcttctgcttgatcaatttggctattgatattgtatatgcttcatgaagttctcatgctgtgtttttcagctccatcaggtcatttatgttcttctctaaactggttattctagttagcagttcctgtaaccttttatcaaggttcttagcttccttgtgttgggttagaacatgcttctttagcttggagagtttgttattaccaaccttctgaagcctacttctgtcaactcgtcaaactcattctctgtccagttttgttcccttgctggcaaggagttgtgttcctctggagaataggcattctggtttttggaattttcaggctttctgctctagtttctccccatctttgtggttttatctacctttggtctttgatgttggtgacctatggatggggttttggtgtggatgtcctttttgttaatgttgatgctattcctttctgtttgttagttttccttctaacagacaggcccctcagctgcaggtctgttggagtttactggaggtccactccagaccctgtttgcctgggtctatagacctgtctgctgccttttgttcagatatgccctgccccagaggtggaatctagagaggcagtaggccttgctgagctgtagtgggctccgcccagtgtgagcttccttgccactttgtttacactgtgagcatagaaccgcctactcaagcctcagcaatggcagacgcccctccccccgccaagctcccacatcccaggtcgatctcagactgctgcgctagcagcgagcaaggctccgtgggtatgggacctgccaagccaggcacaggaggcagtctcctggtctgctgattgggaagaccgtgggaaaagcgcagtatttgggcaggagtgtacagtcactcagagcttcccttgactaggaaagggaaatcccccgaccccttgcacccaggtgaggcgacgccctgccctgcttcagctcgccctccgtgggctgcagtcactgttcaaccagtcccagtgagatgaaccaggtacctcagttggaaatgcagaaatcgcccatcttctgcgtcaatcttgctgggagctgcagactggagctgttcccatttagccatcttggaagtgacctcccaatttctttttaatgatataaaatctttcctaagcatcactaggatcagaaaagcaaatttttcagaaatttcaaaaatgtagagaaaaggttagacattttgttagggaagtaaaaatatatacaattatacacatataaaattatatttgttctggaatatacaatatgttatttgtattgctcactgtagatctagtgattgtaagaacttatgtagcattttatcaagcctccctatctctttagagacttcaaagacttcagaaaggtatggagaacatcaaatgttggtcaagatggtagtcaacaggaactctcaaacattgagagtaggcatgtaatttggtacaagcatctgagaaaactgtttggccttatctagtaaagctaaagatgtatagatcctaagatctagcaattccagttggaggtatcaaccctggaaaaccttgcacttttgagtcagaagatgtagacaacaaaactcacagcagcattgtttgtaacagagagaactaaaaacaactcaaattaccatccacagtaaatagaatgaattacaatatagttatacaatggaaccttttgtttgtgcaatttattcaagtggttgcatgcggccacagttcatttcgttctcaatatatgttataatatatagatgatacatgtatgtgtgtatatatatatttcattgtgtgaatatactacatttaatttttccattccgttgtcatttgacattgtcaacatacattgctttacttttttcttttaaaaagttgagatgaaagataatatgaaattaatcattttacagtgtgcacttcagtggcattttgtacatttacaatgttgtgcaactaccacctgtatctagttctaaaacattttcaccagcccaaaagaaaacttatctctattaagaagtcagtccctgccgggtgtggtggctcccacctgtaatcccagtactttgggaagctgaggcatgtggatcatctgaggtcaggagttcgagaccagcctgaccaacatggtataaccccatctctaccaaaaatacaaaattagccgggtgtggtggcaggtgcctgtaatcccagctacttgggaggctgaggcaggaaaatcgcttgaaccatggaggaagaggtttcagtgagctgagatcgtgccactgcactccagcctggacaacatgagtgaaactctgtctcaaaaaaaaaaaaaaaagtcaatccccattcctcctttttctcacaaataccaattatgggttgtaatacctcagaactaccaatttgcttcctgtcactattgatttatctggatttatacaatatgtggcctctgtgtctggctgccttcaattagcatcatgttttcaaggtttatccacattgtagtatgtatcagtatttcattcctttttacagctgaataacattcaactatacaaatataccacattttgtttattgattcatcaattgatggacatctgtctgggtttttctacctttggctaatgtgaataatgctgctatgaacattcatgtacaagtatttgrgtacccagtttcaattcaaytgggtatagacttagaagtcaaattgtagcagaattgtaggccaagtgtagtggctcatatctataatcccagcactttggaagccaaygtgggaatatctcttgagtccaggagtttgagaccagcctcatttatttggttgagccacaggtgagcagtctctcaaaacaaaagtgaatgcagagccttgcctaacagtgcaaagccagctgcttatatatctggctcctgcgacagtctgatttgattggtgaggatgatggggtgctgggcatatgggtggccgaaattatcaaggaccgtggagtaaaatgtagcggtttccactggggaagaaaaagaaggacttccgggtttggatgctcaatgggaggtacccaggggaggaagctgggtatctgatgctcaggtatcaatactggggtggcatcaatacaggagtggacagcaagagggaaatatcatcctcaacaccctcagcattccctgtgagccaacctccctgccactctgcattccccacacttccagctggtgaacagcagtctcctgttggctgttgctataattcataacttgggcacacattaagctccttggtctctgatcccttaggggaaaaaggcaaccaaatgcaactgatgaggtctgggtaaagtcttcagtggggaagagaggctaaagtgacactgcaggtggagcctacaaagtttgccaatatctgccttagtcaacaaacaacacgtccttggtcaaggcatattatatttttactgactcttgggctgttgacaatgttacctggtctgccacttggaagaaaacaaactagcggattacagacactcctctttaggactgtgaactgtgaaaacaaatcacagcagagaatcagacagatgtccatggtaatggytcattctctaatggaatagactgcaatgatgctgctaatcaagtatacaccatccagactgctgccactgctgccaggatcagcagtctgcacactgtaacaacacactgcacatagcaacattatctgccatcatggcctaggaacagagtaaagattacatgtatctgacgctaccattgcatgctggtcttgtgcttcctttcaaaagtcagcctgttttgtctcagtgaaatagaccgtattttatggtgtgtggtccctcttacttctgacaagttgactatatcaggcctttgacacacacacacacacacacacacacacacacacacacctggggctattgttaatgtgttacagttgttgacattttttcgggttatggtttcattgttccagtctgttcaaccaacgccagtcacactgatcaaaatgtgttatgtttttggttttccagaccactttcactctgacaatgatatgtcttttactgcgcagaggttgctcaacaatgagccaataagtcaaggtattcaacggatatttcacaccccttatcatccttagggtgttggctccaacaagaagtaaaacggacttttaaaaaatccactaaaagaaatttctgactctacctccttcacactctcctggtccatgcatcttagtaaggtagtttggtcacaaaaaaggcaccctgaaagggttcatagtctcctagccacctcctatataatgatcaggatgaaaaggggagggtttgctagacttagtctgatattctgggattccactctgacaattcctgggcatgatatgcagctttctttctccaaacaatgactccaagtcagcctggttggtacactctctgggtggcagtctggcaaaagggaacttaggaaattcaaacttaattctggttcagccacctggattctcttgttgtactgaaacctggatcaggggtcagcaaactatgacctgtgggacaaatgtagccagctgctagttttcagaaatcaagttttacgcctggcacggtggctcacacctgtaatcccagaactttgggaggctgaggcaagcagatcacctgaagtcaggagctcaagaccaggctggccaagctggtgagaccctgtctctactaaaaatacaaaaaattagccaggtgtggtagtgcatgcctgtaatcccagctacttgggaggctgaggcaggagaatcacttgaacctgggaggcagaggttgcagtgagctgagatcgggccactgcactccagcctgggcaacagagtgagacctcgtctcaaaaaacaagaaagaaatcaaattttattggaacactgcctttgactgacacacacacaaacacacacgcacacacacaccacccctggggctattgttaatgtgttacagttgttgacattttttcaggttatggtttcatggtttcagtctgatcaaccaactccagccacactgatcaaagtgtgttatgtttttggttttccagaccactgcgatctcggctcactgcaagctccgcctcctgggttcacaccattctcctgcctcagcctcctgagtagctgagactacaggcgcccgccactatgcccggctaattttttgtatttttagtagagacagggtttcaccatgttagccaggatggtctcgatctcctgacctcgtgatccacccgcctcggcctcccaaagcagaccactttcactctgacaatgataggtcttttactgcaaaggttgctcaacaatgagccgatagtcaaggtattcaacagatgtttcacaccccttatcatcctcaggctgctgccatttctttatgtgttgtctgtggctgcttgtgttctacaatggcagagctgagtaactgtgtcagagggtgtgtagcctacaaagctgaaaatattactctctggcccttcacagaaaggttaccaactcctgccctagataacaaagataactaccacttggttgaggatactgctcaccaagtacccctacagtgacccacaccagtcaagcaaggaaacaaggtaagtctgtgtaaactttataaaaatgctcttgttcctcttgcacatgacctctgtgagtaggggattagagaaaagtaaagcatttgaagtgactgacaatcactcctgttatatagcagatcccctttatccatgggaaaaacattctaagactccctgtggacacctgaaatcatggatagtactgaatcctaaatcctatatatacaccctgcatttactatgcagacatacctgtggtaaagtttaatatataaattaggcacagtaagagatgaacaacaacaacaataaaatagaacagttataacaacatctacaaggattgggtggaaaaataaaaaatacatgtaacaatatgccagcatcagtactcttgtgctctggtgcaattgttaagtaatatcagggttatgtgaatgcagtagccctgcracaatagctctgataaccaagaaggctactaaatggacagcatggatatgctgaacgaaggcagaattcacatcctgggcagacagggcagggtggcatgagatttcatcatgctactcaaaatggtgcataatttaaaatttatgaattgtttcttcctagaattttccatttaacatatatatatatttttttaccatggttgactgcaggtacctgaaactgccgaaacaaaacagcacataaggagagactactgtattttgctttatgcaagatttcaggtatatttcaatatgttacctttttcctacaacatggctctctgccccccaccgccacctttttctctcagtctctttcatcttagccctttagtatgctcttctctgagctcagcagtgcagaggctgtaccatgtgtttcccaaagtaaatggtttcctctttctgctccagttccctccagctgcaatagcagggagttgggacagaaacaaatcaaatagttcttaaaattctgggaggactattgaatggccacaaagcccatccagaaaccctgctggtcaaacaaattgattaaatttgtcaaatcatgtattacatttactacagcaagggagatcatcttgacagggttttggtagcatttcaatagaggaatgttaggcaagagtatacataagtttctgggatataaacgccaccagtttaagtgggtgcttctccccccacagtggcgaatgggtaaggattaggcaaagtttgtgacttagtttaaaacggatggacacaaaaagccaggcttgatgagcaatctgtccagataaacataatgtttgtcctaaaaatcaaaatgtttgtcctgatagctgtttatttagataaactgatttgcaaaaatttcctagagcaaaaagttaggttgacataagtggtgttgattctcaggccccacagttggcacaggcagtctcatttctyaagacaaaatgaaaagaagtcagctaaaacttataatctttaaaagctgtaaaacaattggggagacgggtggatatcccaaccaatawtagttgctctacgttttatacttaaaagaaacaacctattactatttggccaaatcatcatatggtgaattgatctaacaaataaaagagttttggcaacatggactgcttctaatgtaagtgttacataaaattttgtccttgactttctttttttctctctatagccctcttttaaacttaaccatggcttcctatcatctacaaagttatacccccaatcttagtttcaatccttgatctctcttcattttatttgtgtatttatgtatttatttatttagagatggagtctcactctgttgcccaggctggagtgcagtagcaccatcttggctcactccaagctccgcctcctgggttcaagcaattctcctgtctcagcctcccaagtagctgggaatacacatgtgcaccaccatgcccagttaattttttttgtatttttggtagagacagggtttcaccatgttggctaggctggtctcgaactcctgacctcaagtgattcacctgcctcggcctcccaaagtgttgggattacaggcatgagccactgcacccagcctaatccttgatctttctttcagattcaaaattatattctaactgcctgcttgatatttctactggatattctgattcattttccccgtaagacacttcttcctccataatagtctaatcaccattctacctgtcaacgaagctaaaactaaaagagtaatttctttttttttttttttggggggacggagtttcgctcttgttgcccaaactggagtgcaatggtgcaagctcggctcaccgcaacctctgcctcccaggttcaagcgattctcccacctcagcctcccaaggagctgggattacaggcatgcaccaccacggccrgctaattttgtatttttagtagagacagggtttctccatgttggtcagactagtctcgaactccccacctcaggtgatccacctgcctcagccttccaaagtgctggggttacaggcrtgagccacggcccccaactaaaagagtaatttctaattcttctctttcctcggtccctctattcaaaactattcatgtcccagatccaaaggattctctaaagcagtgttaaagtgctggtcagtgaggagataaggagtttatgcaagaacataaaccaagccctgtttccttcatggagaaagcctcatcagctggactaaataatgtgcttagtgacacacttaattactagtytggctcaagcttcttactttgttacaaaccagaaatagcttgctgaccaactgccagtctcagactgtaccttgtcccagaagggtacaaaattaggttctaagggcaaatatggacctttacctagggaccacactctagcatgacaatgaagatcatgtagtcatccctgtcttagccccaagttctgaagaatttttcttaacattgttagtctgtttcctctttttttcactaagcactgtgttttaaaattctatccaaatgaatctactctttgcttttctttcatttatttatttattttgagaccaggttatgagattggctaactttttatttttggtagagacatggttttgccatgttgcctagactggtctccaactcctggcctcaagcaatccaccctcctcagggtcccaaaatgttgggattacaggtgtgagccaccatgcctggcctaccctttgcttttctaacagctgcataatattccatggtaactctcccattccagctccatgccaccagaaataattctgcaaagaacatcttcatgtgtctcctggtttgggctcttcacctcttaagattttgtaacagtcttctaagtgtctccctatttccaacttctgcctaattcaaatctctctctgctcacagtacagttctaaaacctttgatagctccccatgactgaaagaggaaatgctcttacttcatcctggtccctaagattctattcccaatgacctggctttatgtctcactactgtgctattcatattgtatcttccattcacattggagcgctactttctggtcttctctcatatttctacctttcctgcctgtcaaacctttactctttttatttcactctctacgatacatttcctcccatttgcaaccgtcagatactaccaatgttcaaaaataacccccttgacaaagctttctcctattcttttccttattagaaatttcaaaagtttgttactctcccgcttgtgatattattctacatatattatagttatttattttatttttttgagacagtctcgctctgtcgcctagcagcctaggcgtgcagtggcgcgatctcagctcactgcaacctctgcctcctgggttgaggcgattctcctgcctcagcctccagagtagctgggactaccggcgccactactactcctggctaatttttgtatttttagtacatgccgcggttttgccgtgctggctaggctggtctccaactctcctgatctcaagtgcctcggcctcccaaagtgctgggattacaggcgtgaaccaccgtgcccagataatttttgtatctttagtagaggcggggtttcgccacgttgcccaggctggtctcgaactcctcagctcaagcagttctcccacctcggcctcccaagtttaatgtaaaatatcagatgccattgtttcagaaagccttcagtagattaaggagattgttctccttatccttaagatgtctgttttttacatggcaatattaacggactgaaagctcctggagagacgcaattgcccttgtaacttccatttccgtacaatttctggtaggaaataataataacaataacacttagtggtgtttattatttgctgggcatccttataagggttttacatgttttaaatttatccctcaggacaactccatgtgatgggtgctattatcacaaaaattttatagataaagaacctaggcacagggagaggttacgttaccggtccatggtcacgtggctggtgaatggcagagccgggggctgaacccagcaatctcagccagggatccgtggtcttaaccactttgttacctttatcccagggtctgtcaatgtttattccagttacaggggtggaattctgctagaagcttttgagaacctcatctagcgttgtgtttttttctaccaaggcttttagctgctaagagagaggccactgccagtaacagccggggcgccgagctgtcaaggctgacggaggaatggacgctcatcgcgcagcggagtgttggaggggcaagcccgccaagagacccactttgcacaactgtcctcagccaggaaacgacagatcaggaacccagggacagaaacacacgcggggcctcttcagaggtcggcggggggggtgggaaaggggcggggaggaagagcagcgcagggcctggccgtttggaggaggtgctggggcggcgcgaagggaggcgggacagggtagactcacagatccaggagctgactgacccgccgtgggcgaggcatcgctgcagcgtctgaagcctcttccgcggtcccagggcctccagaacccagccagggaccgtccgccaactcccgcccaccgcgcgacgcgtaggtttttgtgacgtcacacggatttttccggtgaccggggcgtggccacgcttcggactccacaaggaaagaagagagccccctttggggcggagccactgagggctgcgcggaagaggctgggtgtgataaactataaagaggccctaaactcggatgcaacgtgacgggarttgtagttctttcacctggcgggcgtctgctccggttcagctgcaggaggtttcttgggagttcagcccagcgcgcagccccgccgcgacgccgcgagccgagaactctcctggggcgaagggagcgctgagaagtcgctactcttactaaaaggatgcgttggatgctgggccatacccttggcgatgcacactggagacccgctcggatacggactccattaacatcaaacggagcgtgttagaggatccgagtttactgagcactttctaggaagcgtgcactgagctacgtgctttctaggccttagttcaatacttaaccatattcattataatccggtgaaatcgtaattatttagccttattttacagatgaggacactgcgtaccaacaagtaacctcactaagaatttcgtcatggaggagaagggaacctgtattcaaattaggaaggatcctgaagaaagggcacctttaggtggaattttatctttggttctgctgcagagtacttgctgctttttagtgctccctccacccccctcattcttccttgtagattagtctgttgtttgtatgctgagttccttttttaagctccttgaaagttggaacccactgctgttgcctgttcaggatgctacacattgaatcaacatggatttattaagcgctgaacgagggctagggatcgtgctgggtgctgaggattgagtggcgaacacttgggtcagacaagtaaaagggcaattagaataactgttaaatgcttagatggggttagttctatggaagcacccatggttgggggggtgggatacagatcagagagaaaagggtggtctgcaaatagtttgggatggctacactggagagtgatcaagagtgagtgtagggcaggggttggccgactttttccataaagtgctctgaaagttgcagattccaggagaagtaactattgtcagacccagacaaattggagcctagagaccagaaaggaaggaaactcatgcttgtatgtctgagrtaagaactgtctcaaggccagacgcggtggctcacacctgtaatcctagtactttgggaggcygaggcgggcggatcacgaggtcaggagtttgagaccagcctggccaacgtggtgaaattcccgtctctactaaaaatacaaaaaaaaaaagaaaaaaaaactgggtgtggtggcgggcgcctgtaatcccagctactgaggaggctgaggcaggagaatcgcttgaactcggaggaggttatagtgagccgagatcgtgccactgcactccagcctgggcgacagagcaagactccgtctcaaaaaaaaaaaaaaagaaagaaagaactgcctcaaggactttaaaaaataaaccaaaaaacccacaatttcttcacatctttcatgcatttaatgttttgcacaacttgcttgttttgcaaatatgcgcacatttctatgacaagatttattgctaaatattctttaaaactgcagcagttcagataagatactgtcgaaaggacgtttggcccagcagcaggacctccaccaatgaacggactccaattcttgatttgagccttgggaaccaatcaacttwgtttccaagagtttatgtgaacttccctcctttaccagtaaaatcttccccctattcttcccttctccagacccgtggcttgccatagctgtacatcttggattataattctttttgttcactcccaaagaaactcagtatctttggagaattctttctttgttgtcttttagcttcccagagccaaacaagaaatattttaggttttgtgggtcatgctggcttggtcacagctattcaacttgtatcttaaaattagccatagacagtatgaatgggtgggtctctgttccaataaaaccttatcctaaacactgaagtttgaattttatgtaattttcaactgtcatgaaatactcatcttttgatctttttcagccactgaaaaatgtaaaagccatccttaagttgcaagctatacaaaaacagacagtggactggatttgacccttgagccatttgtccatgtgccctcacctgatctagaaagctaaaatgcacatgcctcacgcctgtaatcccagcactttgggaggccaaggtgggcggatcagctgaggttaggagttcgagaccagcctgggcaatatggagaaactctactaaaagtacaaaaaaattagctgggcgtggtggcaggtgcctgtaatcccagctactcaggaggctgaggcaggagaattgcttgaacccaggaggcggaggttgcactgagccgagatcacaccactgtactccagcctgggcaacaagagtgagactctacctcaaaaaaaacaaagaaattacgaattttaagatggtgatagcagagcactaaacccagagtggggcccgtgtgactgcacattttgcccacccatgaagccagccctgggtgcgtccaacttcaggatttccccccccaaaaatcagttcaggaaccctatgtcaaaataaaaatcaaagacaaatatgagcacagagagacatttttacttgcagttcaagaaaatcagactttcagagagtggctcgctaaatagaatagaggaatttatagctcagatgaaatggcagatatttatagctcagatatggcagttcattccaattggataagaacaagatgttcctgttttgtggtaaggaaaacaggatgttcttgtttttgtggcttatctctggaggcaaagcttttaggatttcccgttagtcaaggcttttaggaggttcccgctattcatggtttatctttgaatgcaaagttattgggaatgaaagtcttttctagtgtatggtaagtgatttgtaggcagggttaggctaagggcaagatattttccttttctcctctctgtttgctgtgcccactttaatatagtttcctctagctcagaatctcctccacttcctaccatagctaccatacaaagtaaacgttatcatagattgttgctgtgggtttgttttactttactccaggctggagtgcagtggcgcaatctcggctcactgcaacctctgcctctcggattcaagcaattctcccgcctcagcctcccaagtagctgggattacaggcatgtgccaccatgccaggctaatttttttttttttgtatttttagtagagacgaggtttcaccatattggctaggctggtgtcgaactcctgaccttgtgatccacctacctcgacctcccaaagtgctgggattacaggcgtgagccaccgtacccggcctctgggtttgttttataaaaataattaacaaaattacttttcttaaatcatgctgttaattcataatgtaatatatgagctgtatgtggacccatgttttaaaatacaataaatatatataaaacaagtatatcttatttatatgaatgtgtgctttcgcaagaacagaacggagctaagccaagtgagcccctactttattatcctaccatgtgtaggttattttcaaataggattgctcttaactctccaagtgtcctttgagaaaataacacgtctttttatttagtttcttttcatagcttgttttataatatcacactccaaattggaaataacagtgcccatgctcatggattgttatacattgttgaaatttcccattggctagaaacacttgctttgtttctaggttagagatctgtgactttcaaattctcaggagtctgagtcatacaatggatgactcaggatccaagcaggttaagagttgggcaagttcaaacaggagaagcaaggagatgttaataaaggagctgttcccaaaggtgtggacagagttagggcagagcaagggtaaaggtagttcaataccatagcgctacaatagcaggaagaccttacctcttctggtcctggagggcaaaaccaaaaccttgccagagtgaccacaggtgaagccacctgaaaggaactgtggcctttgaatttgtaaccgcctaaggggttcaccttgccccctgcctagaaagaactgattcatcaagacgggggaattacaatagagaaagagtaattcacacagagccagctgtgcgggagacagttttattattactcaaatcagtctccccaagcatttggggagcagagtttttttttgtttgtgtttttttttcagagtcttgctctgtcacccaggctggagtgcagtggcgctgtcttggctcactgcaacctctgcctcctgggttcaagtgattctcctgcctcagcctaccaagtagctgagattacaggcatgtgccaccacgcccggctaattttgtatttttaatagagacggggtttcactatgttggtcaggctggtctcgaactcctgacctcgggtgatccacccacctcaacctccaaaagtgctgggattacaggtgcgagtcaccacgcccagccaggagcagaatctttaaggataaattggtgggttgggggaagccagtgacccgggagtgctgattggtcaggacggaaatgaaatcatagggagttgaagctgtcttcttgtgctgagtcacttcctgggtgggagccacaagatcagattagccagtttatccatctgggtggtgccagctgatccggcaattgcagggtctggaaaatatctcaagcactgagatatttgaagaaaatcttgaagcctcyagttgcatgactcttaaaccataatttctaatcttgtagctaatgttagtcctacaaagggaatctagtccccaggcaagaaggaggtgtgctttgggaaagggctgttatcatctttgttttaaactataagtttctctcaaagttagttcagcctatgctgaaygaacaaggaggttagaagcaagatggagtcggttaagttaaaactctttcaccgtctcagtgataattttgcaaaggcggtttcagtttgataaggcaacctagccagcctgttgtgatccagccaggaaggggctacaggaatacccttcaagctccattcttcatcccctttttgatgtcctgctgtcggctgtcattgcttcagccaaccagaagttagagctcaaagcatccccgtttatgcgatcaataaaagtcagcttctcagagcctagagtagagaaggagagaaattagaaaataagtaactcatcaacagattactgatttttttggtaaagggattaaatatcaaaaacattttgaaaattaataagaatagcttcatctgagccaaaataataattattatagtttcctttttttcttttttttttgagacagtctcacactctcgcccaggctagagtgcagtggtgtgatcttggctcactgcaatctccgcctcctgggttcatgtgattctcctgcctcagcctcccaagtagctgggattataggagcccaccaccaagcccagctaattttttttgtatttttggtagagatggggtttcaccatgttggccaggctggtcttcaactcctgacctcaggtgatcctcccgcctcagcctcccaaagtgctgggattacaggcgcgagccactgtgcccagcctattatagtttcataacagtgagagggatgacaattgtggtctttcactaagatgctgggagccagcgcaatgacagcttaaaccaccatctttttttgattagcttcacttgttatttttatttttagaaagttatgtaattcctaactcacaattactggttattgcaatggaatcaaatgcctggtatttctgtcagataatcagactttcaaaccccattacttacattcattcaaacaaatatttaatacctgttatataccaggtgggatgtatcagtacatgaatatgtcctctaggagcttacactctagtgtgagagatagaaaagcacacaaacaaaacagcatatggagatacgaactataaagaacaagatggggaggacggattgagagaaagagagagatttatttttgctcaggtggtcatggaaggcttctctgacgctgtgacacttctgctgagatctgaggattaaaaaggaggcagctatgcagagatttagagacagagggaaaagaaaggcactgaagtaaaaatgtgcttgatagcatttgaaggacagaaggaggtcagtgtggctgaatggagcagggagtaggaggaaatgggattggctgagcctgggcccaaatcaggtaaaaccttgacgatcaaaaaactgtctttgggccaggcctggtgtctcacgcctgtaatcccagcacattgggaggctgaggcaggtggatcacttgaggtcaggagtttgagaccagcctggccaacatggcgaaaccccatctctactaaaaatacaaaatgtagcctggcatgtggtggcaggtgcctgtaatcccagccactcggaaggctgagacacaagaatctcttcaacctcagaggcagaggttgtagtaagccaagatggcaccactgcactccagcctgagtgacagagccagactctgtctcaaaaaaaaaaaaaaaaaaaaaaaaacagctgggtgcagtgactgatgcctgtaatcccagcactttgggaggctgaggtaggcagatcacttgaggtcaggagttcgagaccagcctgaccaacatggtgaaaccctgtctctactaaaaatacaaaaattagcygggtgtggtggcgtgcacatgaagtcccagctacttgggaggctgaggcaggggaattgcttgaacccgggaggtggaggttacagtgagccaagattgtgccactgcactccagcctgggtgacagagtgagactccgtctcaaaaaaaaagaagccaggcgcggtggctcacacctgtaatcccagcactttgggaggccgaggtgggcggatcatgaggtcaggagatggagaccatcctggctaacagagtgaaaccccatctctactaaaaatacaaaaaattagccaggtttggtggcgggcacctgtagtcccagctacttgggaggctgaggcaggagaatggcatgaacctgggaggcagaggttgcagtgagccgagatcgtgccactgcactccagcccaggcaacagagccagactccatcttaaaaaaaaaaaaaaaaaaaaaaagacaaaaaaaacccccaaacaaactgtctgattcaggcatggtggctcatgcttgtagtcatagctgaggtgggaggatccctggagcccaggagtttgaggttgctgtgagttatgatcatgccactgcactgtagcctagacaacagagtgagtgaggccctctttttctttttttcttcctgaagtctttgacagagcagagaaagaccttatctctaaaaaaacatagcaacaaaaaaacccaaactaactttgatgcatcagggctgtgaagaagcaacacacacacacagacacacacactcacttgcacacctgactttgaatcttattcaaaatgaaatgacagtattgaagttttaaagaaggggaatgatamccgtgcaacacaggtgagccccaaaattggggcttagcctggggaagtccttggctttacccaggaaataattcaagggtgagctgatagtagaaaacaggtttgtttgtttgtttgtttgtttttgagacatggtctcgctctgtcacacaggctggagtacagtggcatgatctcagctcactgcagcctccacctcctgggttcaagaaattctcgtgcctcagcctcccaataagctgggattataggtgctccccaccacgcctggatattttttgtatttttagtagagatggggtttcaccatgttgtccaggccagtctcgaactcctgacctcagctgattctcccaccttggcctcccaaaatgctgggattacggtgtgagccaccatgcccagccagaaaacagcttttctgatgtggcagtgtgacagctccatgactgctcctgcagagcggagctaccccataggcagtgtattgagaggagcagctcagaggcagttctctaatcatgtttatacccacttctaattacatgcaaatcaaggggcaggtaattcagaaatttctagaaaaggggtggtaatttccaggtcattgccagagagagtggtgctaacttctaggtgttgccacagcaatggtaaactgtcgcgtcactggtaggagtgtcttatgaagaagtgctttccatgcttctctgtttcagccagtcttcaatctggtctggagttgagtcccacctcctacctcaataccatttgggcagcagtgtgaagaatggagggggctttggggagtgaattgcagcatgttttgaataggttagagcctggtggtggcttccccgaaggctatgcctctccttaatcccctctagaatctttagcttcctcacaaggtgggaagcccttcagggaccgagaaggaggtgatggtggtggcaagcagcattgcatctgcaggacctttgggcctggatctgttgccttcaatcttgcattgctgtgatgacagtgataacacttgatatcttagtatcacaggctcttgaatctcagaaccacggaggctgtgtcactaagagcttggtctctgactacagcttctgaatccttattttggcctaaaatgaatcacttgactccttagtaattctattttttcacctgtaatatggggatagtaatataaagcctattcaaagtgcatgaggacaggyaattctcagaattcaaaattttcaagattttagaaagctattatggtacatatgactggatattatgagacaccccattttgagttgggttttcagccacatgtattcttcctaaaaatctgttacatcaccctcttttacctttctcttagcagttaacactctgtaatatcttaatttgtttgtttgttgcttgtctccatcaattagaatgtaagttccttgaaatcagggacttttcttttgtttgccactgtgcctgaaacactttaaacagtacatgatacctagtgaataaccaataattactaattgaaaatgaatgaatgaacaaagctttgatttgtctctttccaatctctacctccttgcctctaatccttcaatgagtttctgggctcagtcttcaaaatgtactcaaatttgaccactgctgaacatctgtggggctgtcaactgagtgcacgcccaggctgaaagtgttgtctgactctcctgttcacctggtaaactcctcactcctcttcccatttgttcattgattccacatttatcgaggtacacgcagggtgctaggcgtgaactcacagtctggtgggggaggtaggagaggaacactgatagagatcattactgcataagaaatggggaagcagtggctcacgcctgtaatcccagcactttgggagaccaaggggggtgaatcatttgagctcagaagttccagaccagcctggccaacatggagaaaccccatctctactaaaaatacaaaaattagctgggtgtggtggtatgcgcctgtaatcccagctacttgggaggctgaggcaggagaattgctggaaccctggaggtggaggttgcagtgagccgagatcgtgccattgcactctagcctggacgatagaacgagactctgtctcaaaaataaataaataaataaggaaaaaaaagaaatggggaatgcagaggtgggtgtggtggtctgggcaggtgaagacctgcagccctcactccaattgcacagaagactaggccagagacaaggagtcactcctctctgctctgtgctggggtggagatgggggttgggattagggtggtggggggttcttttgtgtatatgaggagaagccaggcaaacccttgcatctgttcttcccctcaaatgatattttaaaaaacaaacaagcccagtccagagtgagtacaccttgtcctgcctcttttctcatgtgtttaggtgggagtgaccttctggccccatttgacagtagagaacctgagattaggcaaggagaagccatttccccaggcttgccacaaactaaggccgcaaacagactgtgtaccattcgctcaggagcaattcgtattgcagctcatgagcacccagtccagagccacctccagaacaggagctcaaccctctttttgagagcttctctgaggggccctcctattaaaaatggggaaactgaggcccggagaaaggaagtgacttgcaaggagtaacagagcagtcagagagacctgccccaggagttctaattctaatcaccataacagctattatttattgagcccttcctgtgtgctgaatcttgttccaagcctttacaratagtgtcttgttccatcccccagtgattctatggctatatactaaaagcccacagtcctttatctgcaatttggaagcccaaaaaactctgaagccaaaaggattttcctgtatttgctgcccagactcttctgtgtgaagagtggataaatgtggaatcaattaatgaatgggaagaggagtgaggagttgaacaggtgaacaggagagtgaagctatttaaattatatatttttttggtttgtttgtttgtttaattgtttgtttctttgttgagatggagtcttgctctgtcacccaggctggagtgcagtggcacgatctcggctcactgcaaccttcgcctcccgggttcaagtgattctcctgcctcagcctcccgagtagctgggattataggcgcccaccatcatgcccagctaatttttgtatttttagtagagacggggtttcaccatgttggccaggctggtctcgaattcctgatctcaggtgatccgcccaccccggcctcccaaagtgctgggattacaggcgtgagccaccacgcccagcctatttatattttttaataataatttttattgataaattttaaaaattagggggaaaaggtgtgaatagccatacccttattagcgtttcattgttttgtaacaatacacatttaccaagtagcaggagtctgagcatggcttgactgggtcctctgcttatggtctcaaaaggctacaatcgagctgtcatcagggactgcagtctcacctgggttcagatggggaaggactcacttccaagttcactcatgttaatggcagaattcagttccttgaggtcgtaggactgagagcttcaagttttttgttggctgttggctggaggctgccctcagctctgagaggctgcctgtatttcttgccatgcagagtcctctaacatggccatctgcgccctcaaagctaaactgggggagggggagaaagatgggtgctaccatcttatgtaacatgaccccaatcatgtacacacaatcacatacatcccatcatctttactgtttctttcagttagaagcaagccacagatcctgcccacactaaggggaaaggatcacataaggggaggcaaggatcgtggggccaactaagagtctttccaccacaaaccacaaagccttccactgcaaatattattgtgtttggttatgtcctagaaaaaaataaggttttaatctcacatgaaaagtcagaatgccagactgggcaatatgggaaaacctcatctcttccaaatatatatatatatatatatatccagctgtggtggcacatgcctgtagtcccagctacttaggacgctgaggtgagtggatcgcttgagcctggggggggtcaaagctgcaatgagccaagactgtgccactgcactccagtggacaacagagtgagacactgtctcaaaaaaaaaaaaaaaaaaaaaagagagagagaaaaggaaggaaggagaaggaagagaggaagagaggaagcgggggagggagggaggtcagaataagaggagggaggtcagaataggatagttccagggttggttgttcagtggcttaatgacattataattcctgctcagaacctctgtgattcccttgagttttcctctcatgctttcaagatggctctgcaggtccaagcaatacatccttgcactgaggatgcaagttaggaaaattctagttcattgctttactttgagcctcttatttgacttattccattttacttgtgaaatacgcatgtgacagctggaattggcattagacatgttagacagaaagtaaaattgagtatatttctgattctcaagcatttgtttttgccactgtttaagaaataagcaatgcattgtcacatactaagcactcagttgtttgttgaatgaaatataacactgtagggtagggtaggagaacactaaagttcctggaggcaggtaacatgtacttgtatttttctcacatctctcttgttaagaacacaaaatctttgcctagaagaactcacagcagcatcctcagtactatggcacttgctatgattaaaccaatcattaccaagggaaatgagatatgacttagatcaatcataattcatccctcaggatgggcatgagtctgaatacccctatagcacatggccatctgatacctgaacaaaatcaggattctgttaaaaaagaagaggaagggagaaggaatgactataaacaacaagcaccatcctccacagattcaaggaagaattaaaaggggtagtaaggtggtctctctagagaggcaaygttttacttgagatttgccaagaaattgtcagacttgtgaaatctgcggactagcaatccgtggggtgggtaaggaagagcaaatatactgcttagaggtacagagtttctttttggggtgatgaaaatgttctaaaattgattgtggtgataattgtacaattctgtgaatatactaaaaatatatactttaaatgggtgaattgtatggtatatgaatcataccttaataaagctgctatttaaaaaaagaatagtaatgtaataccttgagacaagacaagcttgatatgaattataagaatggtttgactgggtcagattcagtgaaaaattttcataatagacctttaattattgttaatctgctaaaaaacagtatggaacttaagtaccgagcttctaatggaagatagagaaataccctatattttcaggtgggatatttcctatcggtgtttttttcccaggaatgcagttttcctaggcttcaagctgctcagaatatgtggccttcaatagacctgcagccaggattaggtgggactttgcctcatctgaagggcttcttcttattttatttatcgtaattttttgtagagataggatcttaatatattgcccaggctggtcttgaaatcctggactcaagtgattctcccgcctcagcctcccaaagtgttgggattacaggtgtgagccaccgcacccgacttacagggcttcttctatacttactaattctcctaatgtgtgacatctggtctactacttaaattggtgcttttccattggatataagccttagcaatagatattacctaattttctcttacctttttatgggtggggttattttcattataatttttttttcctgggtttgcacaactgccagaaaacattttatcagagctaggttatgaacattgcaggtgggcctttcaacttcctgcagaagtgcagaggtgcaactgagcattcactaagaactggcacttstccaaactgtgcaaaagagggagtgcaagtctgtctcacacacgtaattgaggaaggaaaagaaggccagtgttgctgaagcttagggaaggagataaagacagagaggtaggcagggactagatcacatagtgccttgagaatcatagagatttggttacagctaagtgcaattgggagaatgttggagggttgctctgaacaaggacatgacaggatctgatatgcatttttaatagattaattttggggaaaatatatgtaacacaagtaactgaagaggatgtgtatctagattttaaaaggtactgcaaatcaatatgatgaaaacacacacacacacacaattggaaaatcagcaaaatacttaagcaggcacttccccacagaggaaatctaaatggtcaaaagcatatgaaaaatgttctgtcttgttaatcaaccagggaaatacatgttcgaacttccacatgttggccgggcgcagtggctcacgcctgtaatcccagcactttgagaggcggaggtgggcggatcatgaggtcaagagattgagacaatcttggccaacatggtgaaaccccgcttctactacaaatacaaaaattagccgggcgtggtggcacgcacctgtagtcccagctacttgggaggctgaggcaagaaaattgctttaacttgggaggtggaggttgcagtgtgccgagatcgcgccactgcactccagcctggtgacctagcaagactctgcctcaaaaaaacaaaacaaaaaacgaacttccacatgttaaaacttgtacaaggccgggcatggtggctcatgccagtaatcccagcactttggaaggccgaggctggcagattacgaggtcaggagattgagaccatcctggccaacatggtgaaactccatctctactaaaatacaaaatattagctgggtgtggtggcacatgcctgtagtcccagctactcaggaggctgaggcaggagaatcgcctgaacccaggaggcggaggttgcagtgggccaagattgcgccactgtactccagcctggcaacagagcaaggctctgtctaaaaaaaaaaacaacaacaaaacaagcaacaacaacaaaaaaacttgtacaaaagccagaggcagtaacaggagcctgtagtcccaactactttagaggctgaggcaggaggatcacttaagcccaggagtttgaggttgttatatataaaggttcggtgccgcaaaagaaatagcactcgaatataaaattttctttttaattctcagcaaggcaaggtacttcaatagaagggtgtgcccttacagatggagcaatggtgagcgcacacttggataagggaggggaaggggttcttatccctgacacacgtggcccctgctgctgtgtggttcccctattggctagggttagacctcacaggctaaactaattccaattggctaatttaaagagaatgacagggtgtgtgctttggcaggagtcagggcagggcaggtagcaggtaatcagaatgagttagggtggagtaggtgaccagaatgagtcagagtggagtaggtaatcgaaaaaggtagctttacgaggaagttaagtttaaaagtagaaggcaaataattgaacatactgacattaattctttgaaaagaaatttagaactcatatctaacaaggctatggtgcagtatgattatgcctgtgaatagccactgcactgcagcttggggaacatagcaagactccgtctccaaaaaactccccccaaaaaactgtacaagccactaggatggtaaaagtaggaaaaacaatctgacactctcaaggaactttgacaataccaatggaaactcaccctttggtagagcattaaacaggttgtaaccattttggaaaagaaaggctgtgcatcttcaagtttattagacagtctgatatctacattctcctagttatatatcttagagaaactcttgcatgtaagtgccagaaagcatgtatcaaagtgtttattgtagcactaataataactgaaaacacccaaaagtccattaaagagtataataaattatgatattaattacaatatatgaaattctatacagagctacagctatatgcataaggacagatgaagctcacaaacattatattgagccaaaaagcagcaagtcacagaaaaaaaaaatagtgagattccatttatataacttgaagatgggtaaaacctaaactatattgtttaggttgtaatattggtgatattgcttatggatataagtgtgagataaaactaaagcaagagaatgatcatcacgcacacacacacatacacacacacacacacacacaaatacatgcacacaaagaactgcatttatctttgcagaaagggaggaaatgtgagcaagaagaggtcttatgatgtcctgaaagtgttccgtttctatgaagcatgaaaatttttaattttgttgaagtccaacctatctattttttttctttgattgcttgtgctttggaggtcatatttaagaaattcttgctaaattcatggacacaaagatttacacctatgatttctttgaagagttttataatttcagctcttacatttagatctttggtatattttgagttaatttttgtatatgacatgaggtagggggtccaatattattcttttgcatattgtgttccagttctaaacctgtgtgtttggatacatggatatttactttataatatattttatatactcttatgtatgtatattttatagattgaaaagtataagagacaatggctttgggtactgtttggagtatcctgtctgtggagaataagttgtgaaacagagaaaatcagaaagaccaattgggatgtttcaaaggtttctggctaaagtaacagtatggatggtggtgccattaactaagacagcaatgaatgcaaaaagagcaagttttgtggggagacacaaaattatctttaggatatgttaaatttgagaagcattttaaacatccaagtggagaagtcaaaatgtaattggagcctggtgtggtggaacatggatgtagtcccagttactraggctgaggtaggaggattgcttgagctcaggagtttgagaccagcctgggcaaaatagtgagacccccatctccacaaaaatttaaaaattagccagctatgggtggcatgcacctgtagtcacagctattcttaggaggctgaggcaggaggatcactcaagtccaggagttcaaggctgcagtgtgctacaatcacacctgtgaatagccactgcactccaacctggacaacgtagtgagacctcatctataataataataataataaagcagcaaatgatatatgaattcagagttcagggaagaaaacagggctctaggtaytcatttgggaatccgtaayatgcttgtcataaagctatgggactgactgagattaaatagggaaagaatgtacacaaaaaacagaagagcatcaaggacccagctctagagagtcctaatatttagaagatgaggagaaaaaagaggcaggtactagcaaggagattgagaagaagcagccagtgataaagaggggaaacagtgtggcttcaggaaaacttcaagaagaaagtgtttcaaaaagaaaataatggtcagctactactgagaaattaaytgtgatttggatagagaacaaatcattagatttggcaagataaagatggttggcaagcttgataggggatgttttgtggcagatggcaagtgtcggtggctttatccaattctgaacaggatatttgctagcatgcacacaagaccgtaattcctctttcataatgaatgctactaatgttacacaatgtcagatgagtcacttgacaatgtaattttccagtagcagtgtgttttgctttctctctgagcatattttgaataatttcacattaggtttttacaaaccttttgacagcagtaagaactgtctgttttaggatataagaagtgcaaatctgaatggatatctagttttggcctctttctgactttagcaaaagaattatttaattttttactatgctgttttgttttagaaatgaaaaatttaattggtttaccagtgctcagtgttttgttagaaatcaaaatgaaggtcgggcgcggtggctcacgcctgtaatcccagcactttgagagaacgaggtgggtggatcacaaggtcaggagatcgagaccatcctggctaacatggtgaaaccctgtctctactaaaaatacaaaaaattagccgggcctggcagcgggcgcctgtaatcccagctactctgaggcaggagaatggcgtgaacctgggaggtggaggttgcagtgagccaagatcgcgccactgcactccagcctgggcaatagagcgagactccatctcaaaaaaaagaaaagaaaaaaaamatcaaaatgaaagcatcattaacttcatgtcaaaacttgacagrcttacttaaaagataaacatggtgtaaaaaaaagagtagctggattgctcattttcagatatccactttcatacttctattcacatttttctttacttgtttctataaaattatcatattcacctatttcctcagtgaaaatggggctcttgttaattttttatatttgtgacattctctactttaatattcacattactattttcatcactatgttttggtttagtgaaatactttcaaagtcctcgataacatttttttctataaattttttattttttaattatccgggcatggtggcttcrcctgtggtcctagctacttggtaggcagaggcgggaggatcacttgagcccatgaggtcgaggctacagtgagccatgatcacgccactgcattccaacctggtcaacgtacgtagcaagacccagcagtgttgtcttgagcatgtcacttaacctctccaagtctgtttcctcatctttcctttgcaagcacagcaagtccctgtaataagataggcacaactgtctgatccaggtaggcacgagttggcaaagactggagatctaccttctgctttgatgacttttctgcattaatcttctcattttctactatcctctggccaggcacggtggctcacccctgtaatcccagcactttgggaggctgaggtgggcagatcacgaggtcaggagatagagaccatcctggctaacacactgaaaccccgtctctacttaaaatacaaaaaattaaccaggcatggtggccggcgcctgtagtcccagccacttgggaggctgaggcaggagtccataacatttttttaaacattggcgatataaggccacactggtaaccacatgaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttacctggtaaattttttttttttttgagaacggaagtctcgctctgtcacccaggctggcgtgcagtggcaccatctcggctcactgcaacctccgcctcccaggctcaagcgattcttctgcctcagcctcccgagtagctgggactacaggtgcgagccaccacgcccagctaatttttgtatttttagtagagacagggtgtcaccatattggccaggctggtctcgaactcctagacctcgtgatctgcccaccttggcctcccaaagtgctgggattacaggtgtgaaccactgcgcccggccttacctgttaaattaatgttagtggaaacacattgccaaactcaatttttcaagtacatgtatcttcaaaatacaaatayacttcaaagctactgtactttgaaatatgttatcttcaaaaatgacattatcactaagaatataggaagccttaagaattgaatatggtggttcaaaattagtatttttcctctttgtaggggaaatcacccaaaagtaacaatcagaactgttaccacctgactggttcttgcccactgcacagataaaaccaaaacactgagccagcaggagttgcagcagagaaagagtttgattattgcaaggcaatagagtgaggaggacgggatacatttcccagatccacctcaccaagaattcagaggctaaggtttttaaggatgatttggcaggtagggcattaggaaacagatgttgtggattggttgggggatgaaatcataggagtgttgaaactgtcttcatgtgctgagtcatttcctgcaggggagtggtcagaggaccggttgagtcagttcctttgttgcagtcacggtcactgttcaagctggtgtcagttgattcacctgaaggcaaagtctgaaaaatatctcagagatcagtctcaggtttcacaatagcgcttgtgactgcctgttacataactcctgagcaataagcaattatagaaaagcaaacaagagaacaatgatgggctatcattcaactacgcctacagcttaagaggtgagctccctggtgattgaaactgcttgcactcctcagttgatccaacttctggaaaatacaaaggcagtctgcatgacttaaagatcattggttctttttctttttttttttttttttgagacagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacaaaaaaaaaaaaggactatgttacgtaatcatgcctggtagatgaaaatgtcaaaggggaaagaaagtaagtgtaacaaacatctattagctgtgcctctattttaacaaaatttaggcctctctaaattacaaagtaagtggaatggttgagtgtgggagggcattaggggtgcagattttagaagtattttattagatttagggtttgggattagattagatgaggggtaataaatgattgctagggagaatgactggatcagggaacagaaattaacttgtaggtagttctctttggaatttaaatgatccttggagagagtcagtcattatcttgaaaaagggtctgtttaggtgtggttacattttcggtcttacagatgttaccaaaacacccaagattcagtctaggtcctgttgctcccctcacagaaagccaatcattaagacaatgagtattgccagggaagaaggctgtaatccagtgctgcagcagaggagatgggagatcagtcccaaatccaactccctgactgtctaaaatttgggatttgtatagcagggaagaaatgtaactatgtgtggaaaaacgggaattttagggaggggtaaggaagagaaaggggtcaacaggaagcaggcagtcatgattggtgagrcgtctggctccctttgtccagatgtgatgatctggtaagtttcagctccttgatactgtctgggaggactgatggtttcttttctgagaaagcaactcagataagacagatgtaattttctcaagttttaagaccaggaggataaatttctatgtttattaaaargaaccataaacatcacctctacaggacaattgggcaggtttcccagggaagggaagaaaactattgttctccttggtgggtctggakcttaggcaggtaaaggaacttgagcctctttggaagagctggtgaggggtgggtagatcagagagaccttgagtcttcttagttcaggatgtaaacatgccatattttggggaattggtttctaagcctcaacattacagacaggaatgaaaaccgaccttgtctggaggagaactttccaagtttggtacagaggactcccacagattatgatgaagccatcaactcacaaacwggattaccaaacacacaagaaggcaatcactgtgagagtcagcagaaacaactgatttagatttctcaaatatttctagtattagaattataattacatatataygacataaaacagctgtgtatgaagtgtttaaagaagtatataatttaaaaagtgagccttcaactagaaacaggaatgaacagaaacattttggaaacaatccaaaaagaaccaggaattaaaaatataatggggtgactcacatcygtaatcccagcactttgggaggctaaggcgtgtggatcctttgagatcaggagtttgagaccagcccagtcaacatggcaaaaccccgtcactacaaaaatacaaaaattagccaggcatgatggcacatgcctgtaatcccaccactttgggaggccgaagggtggatcatttgcggtctggaattcaagacaagcctggccaacatgatgaaaccccatccctactaaaaagacaaaaattagtcaggtgtggcagtgtgcgccttataatcccagctgcttgggaggctgaggcaggaggttgcagtgagccgagatcgcaccactgcactccagcctggccacagagcgagacttcgtctcaaaacaaaaaaaaaaaaaatgaggtcggggatggggaagtggtggtaggaactcagtggagggatgaactagcagattagataactcaagtgagaatttgtgaaccagaaaatatatctaaataactgatccagaatgcacagggagaaacaaggaaatggaaaatatgaaaaaaaggttaaaagatatgtaagataggatgagaatgagacaggatagttcatagttcaaggtcaagtcttgaccttgaccccctttgtgggcaggaactggagtggcttgtttcactcagcctgcagtccgtggatggctaagtgttaacagcccaggctgacagccttctgcacctgcccttcttgacacccgaattcttattcagagtccaggaagaatcaggtcacataaactttttgaagggtagtgtatatggaagattttactgtgtgataaaagtggctctcagcaggatggggaattggaaaggggatggtatgggaagaaactgctctttctctgaagccgtgtctatctgtagtttccgatgctcagctgcatgtattcctgatgctcagcagcttgtatccccgaccacttgcatcagctgctgaggttgctctttttcttccttttgttctgctagctggtctggtatttataggcatatgacagggggtggagcgggccaaaaaagcaatcatttgggtggaaaaaatggggtcagctgtttcacttaggactgaggttccaggcttgagggtgaagtttagcctggagcccagcagttctgcatcaagaagatttaacatacacttagtttcaattagaaagatagtgagaaaagaktagaggcaatgtgtaaagagataatggctgtgaatttcccagaactggtgagaagcatatacccacagatcttgaaagcaaagaaaaaaaaaaataaggaaacagggaaacaaatttaaaatataatttttwaaaaattgcagagaaaaaggaaacgagtctaaaaatgtaaaatggcatattactaaaaaagattccaagtagtcaagagcaatctatgtcctgataaaattattagatttcaaaaagaattatttaaaagccagagaataaatcacttataatgagaaaaacaggctgatttcagatttctccacagcatttgttcttagaagacattatgtatacataccaataaaatcctccagcaaagagatgtgacccaggaattttgtatgcagtcaaactgttgcttaaatataaaggtaggtggtgtggtgcctcacgtctctaattctagcactttgggaggctgaggcaggaggattccttgatcccaggagttcaagaccagcctgggcaacatggtgacaccttgtccctaataaaaataaaattaaaaaaaaatttagccaggcatgatgatgcatgcctacagttccagctacctgggaggctgaggtgggaggatcgcttgagtgcaggagaytgaggctgtggtgagccatggttgcaccaccacactccagcctaggtgacacagtgagaccctgtctcaaaacaagacaaaacaaacacacacacatatatatatttgtttatatacatacatatgtatgtatgtatataaagccaaagagttttgaaaacacaacatcttaagggtattgtttgtattaactcacatgaagaatccaccaatggacaaatgttgtcaaaccagagatgactagaaagcactgggtagatagcataagcgctgctggtaaattggcttaaaackaaaataaatgtgggattgttgttattaaacagaacaaatatamacattaagaaacataatataattaacaaaaattgagaagttgtagagagaaaaaggaggtggaaggaagaagaaagctactaatttaattattagcaattatcagaatagggcattgataatagtggttaaagaaagaagatcagggccgggcacagtggctcatgactgtaatcccagaactttgggaggccgaggcaggtagatcacaaggtcaggagatggagaccatcacggccaacatggtaaaccccgtctctaccaaatacaaaaattagctgggcctggtggtgtggcacacacctgtaatcccagctactcaggagcgtgaggcaggagaatcgcttgaacctgggaggaggaggttgcagtgagccaagatcgcgacactgccctccagcctgggtgacagagcgagactccatctcaaagaaaaaaaaaaaagaaagaagatcagacatttgacaaaatacaaacatgcataattatcagaagaaatggacatacaacaaaaacatctcacatacgaaaacatctcacatacgaaaatatttttaaccttgaaaccatgaattataacatgaaataacatgatatagtcatgaccaaacatgtctttcatatcaaaaattttaaacaattgtaataattgtaaatgagtttaattcatctagtaaaargggaaaaagtcagatagaaccacaaataaaaaataattcaataccataaaaacaaagacaaacctaaaactaatagattcagaaggacagaaaatgaagagaaaaaaagataaatgggcaaacctgtactaggctaatgcaaacgaaagtaattgttatcttaatttcaaatatggagaaaacgaaactactggggaaagggagggtccactgagaaccatcccagtaactcaaccacggctggtcttcgctggacaccatgaaycacactgtccaaaccttcttctctcctgtcaacagcggccagccccccaactatgagatgctcaaggaggagcacaaggtggctgtgctgggggtgccccacaaccctgctcccccaacgtccaccgtgatccacatccgcagcaagacctccgtgccccaccatgtcgtctggtccctgttcaacaccctcttcatgracccctgctgcctgggcttcatarcatttgcctactccgtgaagtctagggacaggaagatggttggcaacgtgactggggcccaggcctatgcctccaccaccaagtgcctgaacatctgggccctgattttgggcatcctcatgaccattctgctcatcatcatcccagtattaatcttccaagcccatmgatagatcaggagacatcactgaggccaggagatctacccatgacctgtatcctttgtactccaccttccattcctcgccctgctcccggagccaagtcctgtatcagccctttatcctcacacacttttttacgacggcattcaataaagtgtacgtgtttctggtaaaataaataaataaataaattcaaatatgactgagtttgggggaataagtgctaaataagacacagacactttatatgctaaaggttgaaattcacaaaaataacagttatgaatatctatttacaaataacatggcattgatataagcatagcccttaaagcaaaagttaaggtgttggaggccatgggctgttgaccccctaaaggtttgctaaaaaatcaccgacatgaagcagattgacgaatagaagaaaaagcgtacaaatttatttaacatgtatacacaggagccttcagaatgcggacccaatttcccaataagtaacagaagcttatataccaccttgaaattgcagaaacaatgcggactcagagtatgtccaaaaacaggatttagtggcaaggcaggttatgggaggaagaaaggaaggaagaggctttgctagcaatggtggccttgttgtacagagaagcctccctcagagggaatacatggtaaaagtttatttccacacctttaaaggtgccagactgccagtctctcctggatcgggaaaggaatagaaaagagaggcagggctgcattagtggagattctstacagatgcaaattttccccacaaaggacagctttgctaggccacttccgttttctgaccaaggggcagccatttcaaaatatgtcaaagaaatatatttggggctaaaatattttaatttccttcaaggtctacaacagaaaagtagagagaaatacattaatggtgggatactttaactcttctcaaaagtatgcagaaagccaaacaagggtatagtgaatttataattagtaaggtagatatatgtcaaattctgtgcttctgaaaacagaaaatacatatttttatatttccaataaaaaaaccttcaataaatttcaaaaagataaaacagtacagctgggcacactagctcaagcctgtaatcccagcactttgggaggccaaggcaggtggattgcctgaggtcaggagtttgagactagcctggccaacatggtgaaaccccgtctctactaagaatacaaaaattagccaggcaaagtagaaggcacctgtaatcccagctactccggaggcgaaggcaggagaattgtttgaacctgggaggtggaggttgcagggagccgagatagcaccactgcactccagtctgggtgacagagagagactctgtctcaaaaagagagaaaaaaaaaaaaaaaggataaaacagtacagacaactttatctagtaccaaggcaataaaactagaagacaataatataaggaggaaaccaaagcccctacgtatttggaaataaaatatcttggttttaaatagctctcgggcccaagaggaaaatccaaatgaaattgcagaccatctaaaaagtaatgataacaaaaatattgcacatcagactctatatgatactgctgaagcagtgttcaaacattgtattttaaatatctttattacaagttatgaacaatgaaataaatttctgaaattcttttctacacttatcttaaagaatattatatagaattactataatcacctgttgactccttccagcccactgcacagacaaaaatcgatttactgagacctcagcattgcagtagagaaaaatttgacacaaggccaggcacacagaagatggtgttactcctcaagtcagtttccttgaaggctcagagattagggtttttaatggacaatttggtgggcagggagctagggaatgggtactgctgagtgatcagggaggaaatcacaggggtgtggaaaatagtccttgtgcacttagtccacttctggtggagccacaggaccagctgagtcatgagtcacgagtccaggtggagtcagtctgagaaaatctcaaaaaaaaaaaaaaaaaaaaatctcaggttttacagtagtggtgttatctataggagcaattggagaagtcacaaatcctgtgacctctggccacaggactcctgagcaataagagattgtagaaactatgcctacattttagcagaactcaggcccctcccataaccctaatcttatggcctttcattagttttaaaaaggcagtttcagcccctgaacagggagggaattcattttagggaaggattattataatctttgcttcaaagccaaactatatatttttatttttgagacagagtctcactctgttgcccctgagctggagtgtagtggggcaatcttggctcactgcaacctctgcctcctgagttaaagcgattctcctgcctcagcctcccaagtagctgggattacaggcacccaccactgtacccggctcattttttgtattttttgtagagatggggtttcaccatgttggccaggctggtcttgaactcctgacctcaggtgatttccccgccttggcctcccaaagtgctgggattacaggcatgaaccaccgcacctggcccgaagttaaactattgacaactacattcctcccagagttagcttggtctgtgcccaggtatgaccaagaacagcttggaggtaagaagcaggatggagtcaattacatcagatttcttttactgtcataattttgcaggggcagcttcattacaaatgcagaacttagtaataaaagtcatattgttggctgggcgcagtggcttatgcctgtaatcccagcactttgggaggccgaggcggctggatcacgaggtcaggagttcgagaccatcctggctaacatggtgaaaccccgtctctactaaatgtacaaaaaattagccgggcgtgatggcgggtgcctgtagtcccagctacttgggaggctgaggcaggagaatggtgtgaacccgggagacggagcttgcagtgagccgagattgcaccactgcactccrgcctgggcgacagagcgagactccgtctcaaaaaaaaaaaaaagtcatattgttagatatgaattctaaacttgttttcaaagaatatgtcagtatgttcaattatttaccttctacttttaaacttcctcataaagcaacctttttcaattacctgctccaccctgactcattttgatcacctgctccaacctgactcatttcaatcacctgctccaacctgactcatttcaatcacctgctccaccctgacgcgttctgattacctgctccaccctgattcattcccattacctgctccaccttgactcattcccatgacctgctccaccctgactcattcccattacctgctctgtcataaccatttttcccgccaaaccactcaccccatcactctctttaaattggccaatcggaattagtttagcctgggcggtctaaccctagccaataggggaatgacacagcagcaggggccacctgaatcagggataagaaccccctccccttccttgtccaagtgtgtgctcaccattgctccatctgtaagggcgcacccttctatagaagtaccttgccttgctgagaattaaaaagaaaattttatattcgagtgctatttcttttgcggcactgaaactttatatataacaatattaataaacaaagcaaggccgggcgcagtgactcacgcctgtaatcccagcactttgggaggccgaggtgggtggatcacgaggtcaggagatcgagaccatcctggctaacatggtgaaacgccgtctctactaaaaaaatacaaaaaaattagccgggcgtggtgacgggcgcctgtagtcccagctactcgggagctgaggcagaagaatggcgtgaacccgggaggcggagcttgcagtgagccgagatcacgccactgcactccagcctgggcgacagagcgagactctatctcaaaaaaaaaaaaaaaaaaaagaaacaaagcaaaaaatttgactgggcatggtggcacacgcctgtaattccagcatttggggaagccgaggcgggtaaattgcttgagcccaggagtttgagagcaacctgggcaacatggcgaaaccctgtctctacaaaaaaattagcctggcgtggtggcaagcgcaggtagaaccagctactgggaaggctaaggtggaagaatcacgtgagcctgggaagttgaggctgcagtgagccatgattgcaccactacactccagcttaggtgacagagcaagactctgtctcaaaaaaaaaaaaaaaaaaaggaagaaacaaaacaaaaaatgtaaaaataaatactttaataatatgccataatgacatgtatactgatccggatttgtatctagggattgtactgtgggagtccaaaaacctgctgcatrtgtaaaatagttatactatttaatragcaaaagtcactagcagcaaaattatccaaaaatcagtggagttctaggaataaagtatctcttgtggtgccaaagcaaaaatgcaagtctagacctcagcaaggcaagactttatcaaaggaggctatgacaataggaagacactcaaagcctaagctagaaacctctcagggaagggrtgtgtgagcagaaactgtggcaaaggcagctgtggaaagagaaaagagaaaagggtgtattcagtttgctaggggaagtcttgaacttaatgaactgtgtcaaaaaagaaaaggaaggacaaggcagcacagtttagttggtggataggtatatggagtggggtttgggtctgagagagagcaaacaagttacaatgcagaaagtttgcataaagctgagggcctagctgtccttgtcaaagcagactgaagttacatgaagcactaagtttaaccatccctgttactggctatctgtgcacacttaaatgattttggcttttaagcagatataaattgcatatattccaagtcatgttgacacaaacgtatcttagaatctggctctacaaatattcaaagtaggtcacatccacaggtgaacaaatcgtaaggcagctggaaaacttcactgtattagttaataagagaataggccaggtgcagtggctcactcctataatcccagcactttgggaggccaaggtgggtaaatcacttgaggtcaggagctcaagatcagcctggccaacatggtgaaatcttgtctctactaaaaaagtaggtgaggaccgggcacggtggcttatgcctgtaatcccagcactttgggaggctgaggtgggtggatcacgcagtaaggagatggagaccatcctggctaacatgctgaaaccccgcctctactaaaaatacaaaaattagccaggcatggtggcacatgcctctaatcccagctactcaggaggctgaggcaggagaatcgcttgaacgcgggaggcagagcttgcagtgagccgagatcgtgccactgcactccagcctgggcgacagaggagactctgtctcaaaaaaacaaacaaacaaacaaacaaaaaacagctggacatggtggcaggcacctgtaatccccgttactcacaagtctgaggcaggaaaatcacttgaacccaggagacggagattgcagtgagccaagatcgtgccactgcactccagagcgagactccatcaagaaagaaagaagatgaaggaaggaaggaaggaaggaagtaaggaaggaaagaaagaaggaaggaagggaaagaaagaaagaaggaaagcatcaaaatgaatgaagttaaagatcagccaaacaaagctaagaaagcaaagaaattgaaaaaataaaaatagaaactacttaattagaaaaaaagtagaattaaatatataatccaagagctggttacttgaaaaataaaaaagataggcttttagctaagttaactaggaaaaacagctaaaatatacttkatgcaataatttggaaattctagataaaatggattatttttaaagaaagtatgacttgccaaaactgatcttaaaaaaaaaaacagaaaatctaaataagcaaataattaccataaaagaagtataaagagctattccacaaaaggagtaccaggtctagatattttcataggtggttatattccacctttaaggaaacaattccaaagctatgtgagcttttctaacacataaaaaaaagaaagaaaccatctaaaatacttctatgaagcaagaatagtttgacactaactctaacaaggtgtgtagaaaaaaacctgagcactaatctcatttatatgtattgatgaaataatactaggtactaggaaaaagaatcctgtaataccttamaagaatgaaaggacaaaaatggggattatttcagaaatacaaggataataaattattaggaaatctattttataaagagacccaaggacaatcaactcaacagactttgaaaaataatttgattaaaagcttttgggaggccaaggtgggcagatcatgagatcaggagattgagaccatcctggctaacacagtgaaaccctgtctctactgaaaatacaaaaaattagccaggcgtggtggcaggcacctgtagtcccagctactctggaggctgaggcaggagaatgacgtgaacctggaaggtggaggttgcagtgagctgagatcacaccactgcactccagcctgagcgacagagtgagattccatctcaaaaaaaaaaaacaaaaaaaaaaccttttaacatttatttatttatttatttatttatttagacagagtctcgctttttcacccaggctagagtgcagtggtgcgatctcagctcagctcactgcaacctcagcctcttgggttcaagtgattctcctgcctcagtgtcccaagtagctgggattataggcatgcatcaccatgccttgctaatttttgtatttttaatggagatggggtttcaccatgttggccaggctggtctcgaactcctgacctcaagtgatccatctgcctcrgcctcccaaaatgctgggattatagatgtgaaccacagtgcctggcccatctacttttcaatcaaaaatgatcataaaagaataagaatataagttgacagcaagaatgaggaaataaaaaatttttttaattaaatttgaaaaataaaaaaaaagaatagaagacatttccttaatatgaatctattttaacctcaagacagcttatgttcaaaggaaaatattagaagtactcccattaacaaaagattttaaataatgatgactactattatcagtaatatttttctatctaatgtgtttatctttatatttgggggaaaattagaagttaaaagttattggaaacaagacaacaatgcctgctgtcatcacttgcattcaaaattgaactggaagttctagccaaggcaattaggcaagaaaataaaataaaaggcatctaggttggaaaagaggagggacaactatctttttttgcagatgagataaaaatccctaaacaattcacaaaaaatccattagggctaataaacaagctcagaatggtgcaacaatgcaagatcaatatacaaaaatcagttgtatttctataaagtaacartgaacaatccaaaaataaaattaagaaaataattccatttataataccatcaaatataataaaatactttgcaacaaatttaacaaaagaagtggatgactcagccaggcaaggtggctcacacctgtaatcccagcactttgggaggccgaggcaggcagatcatgaggtcaggagttcgagaccagcctggccaacatagtgaaacctcatctctactaaaaatacaaaaaaattagctgggtgtggtggcgggcacctgtaatcccagctactcgggaggctgaggcaggagaattgcttgaacccgggaggtggaggttgcagtgagctgagatcgtgccattgccctccagcccaggcaacagtgtgagactccgtctcaaaaaaaaaaaaaaaaagaaacaaacaaacaaaagaaatggatgactcatactgaaaaagagatcattgaaagagatgactcaggaggctgaggcaggaggatcaggagtttgagtttgtagttagctatgatcgcgccactgtactccagcctgggtgacagagcaagatcctactgaaaaccaaaaagagaagcaagaaaaagagaaaaagaaagaagactagttgaaacaacatctgttttcatggattggaatatctaatattgttaagatatcagtacttcttaaattaatctgcagactcaacacaatccctgtcaaaattccaacagcatttttaattttttcagaaatgtaaaagctgatcctcaaatacatatagaactgcaaggggccctgaataaccaaaacaatcttgaaaaagttaaaaattgaaagactcacacctccccatttcaaaactttgcttaaagctataatatcaagactgtagtatgggcatargaatagacatgtagttgaggacaatgaattgagagtccagaaataaacccagactcttgcatcaattgattttcaacaaggctgccaagacagttcaatggaggaaagaataatctttcaacaaatggttctgaacaactagatatctacatacaaaataatgaatttggcacctgagtaccayacactatatacaaaaattaactcaaaatggatcaggacctaaacataagagctaaaattataaactcttagaagaaaacatagatgtaaatccctgtgaccttggattaggtaatgtttttttagttatggcaccaaaaacacaaactataaaagaaaaaaatagaaaaattgatctactccaaaattaaacactttagtgctacaaaggacattatccagaaactgaaaagacaacctatagaaaaggataaaatatttgcaagtcattctagtaaagaacttgaattggccgggcatggtggctcacgcctgtaatcccagcactttgggaggccgaggcaggtggatcacaaggtcaggagatagagacaagcctggctaacaccgtgaaaccccgtctctattatgaatacaaaaaattagccgggcgtggtggcgcatgcctgtagtcccagctactcgggaggctgaggcaggagaatggcgtgaacccgggaggcggagcttgcagtgagccaagatcgtgccactgcactccagcctgggggacagagtaagactccgtctcaaaaaaaaagaacttgtatctagaatatataaaaaactctaacaatcgagcaataaaagtgctgaacaaactgtgcctttgttcagaaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcccaggctggagtgcagtggtgtgatcccatctcagctcactgcaacctccgcctcccgggttcaagcaattctcatgcctcagcctcctgaatagctggaactacaggcatgtgccacgatgcccagctattttttaaatttttagtagagacaggatttcaccatgttggccgatctggtctcaaactcccaacctcaagcgatctacccgccttagcctcccaaagtgctgagattacaagtgtgagccactgggcccagccgtataataattttttaaaacaattacaggtgttgatgaggttgtggagaaataggaacccatggaaattgctggtagaaatatgaaatggtagtaaaaaaacagtttgggagttcctttaaaaggtaaacctagaggccgggtgtggtggctcacgcctgtaatcccagcacttcgggaggctgaggcaggtggatcatgaggccacacggtgaaaccccatctctactaaaaatacagaaaccaaattagctgggcgtggtggcaggcacctgtagtcccagctacttggaaggctgaggcgggagaatggcgagaaaccaggaggtggagcttgcagtgagccgagatcgcgccactgcattccagcctgagcaacagagggagactccgtctcaaaaacaaacaaaaaaaaaacttaaacctagaattactaatatgatgagcaatttcactccttggtacgtaccttagggaattgaaaacatatgttcatataagatagcaaaaaaaggaaacaactgaaatgttaatcaactgatgartggataaacaaaatgtggtatatccataaaatcgagtattatttagtcataaaaaggaatgaagtatgaaagatgctaaaacatagatgaacctcaaaaacattgtactcactgaaagaagctatatacaaaaagcttccctttttataggaaatgtccaaaataggtaaatccacagagacaaactatagactagtggctgccagagcttagggggaaksaaggatgaggagtgactaataatggctacggagtttcactttgggatgataaaaatgttttgaaactagtggtgatggttgtacaaccttgtgactacactaaaaatcactgacctacacactttaaaatggtgaaatttatttgtgcttgaattatrtctcaaaaatatggttaagttttaagtttattataacagaattaaacttttagaaaagggaaaaaatggttttacagggaaaggatgtggtaattttataaattatttctagatgataggattatatacatggaaaaacctgagagaaaaacacaaaattttatagatcataagagaattcaggtggactagcatgacattaacagtcaaaatcaatcattttcatatatacaaacaataagcagttcaaaaacatctatttacaatagcaacagaaaaataatttctgggaataatctaacaataaatgtgcaaaatctaaacgaagaaaactttaaactcgctactaaaggaaataaaagatggtttgcagccaggcgtggtggctcacacctgtaatctcaacactttgggaggccaacgtgggtggatcacttgagctcagaagtttgggaccagcctggccaacatggtgaaaccctgtctctacaaaaaatacaaaaattagccgggcgttactggcttgagcctttagtcccagctactcatgaggctgaggtggaaggatggcttcagaccagaaagcagatgttgcagtaagccaagcctgtgccactgcactccagtctgggcaacagagccagactgtctcaaaaaaagagaaggtttgaacaaatraaaaggcataacttgataatataggatgcttcaacatgataaaacttcaattctttctaaattaatttataataactcctctcccaaattctaaggatttttttwaaaaaaagacaggctgatttgaaagttcaaacagaaaaaaataaaaattcaacgtacgtttgatgaagaagggaaatgatagaaaactagtcaaaacgaagaggaaagcctaaattgacatttgtacaaagctatttattaaaatcttctttgtaattaagaaaacagtctttgtatccattcaagaattctctgcagctatgaaaaagaatgaagctgttctttgtctactgatatggaaagtgtcctaggccaggtatggtggttcatgcctgtaatcccagcactttgggaggctaaggcaggcagaatactggaggtcagaaattcaagaccagcctggccaacatggtaaaaccccacctctactaaaaattaaaagaaagaggaggggagggagagaaagaggctgggtgcggtgggtggcttacacctgtaatcccagcacttcaggaggccaaggcgggcagatcacttgaggtcaggaatttgagaccagcctggccaacatagtgaaaccccatctctactaaaaatccaaaaaaaaaaaaaaattagccaggcatggtggtgtgtgcctgtaatcccagctacttgggaggcggaggctggagaatcacttgaacccaggaggcagagattgcagtgagccgagatcacaccattgcactccaggctgagcaacagcaagactccatctcaacaaaaaaaaaaaagagagagagagagagagtcctagacaagagagagaaagagagaaaatgaaagaaagagagagagaaggaaggaaggaaggaaggaagaaaggaaggaaggaaggaaggagggagggagggagggagagagggagagggaaggaaggaaggaaggaagggagggagggagggagggagagagaaggaaggaaggagagaaggaaggaaggaaaaaaaagaaagagtcctagatgagagagagagagagtcctagatgagagacagtgaaagcaagaaagaaagaaaggaagagagaaagaaagagtcctagatgagagagagagagagaaagagagaagggaagggagggagggagggaggagagtcctagaccagkggtccccaatcctactggtctgtggcttgtcaggaagtggaccccacagcaggtggtgagcagtgagcaagcaagcagagcttcatctgtatttacagctgctccccatcactcacattaccacctgagctccaccttctgtcagatcagcggtggcactagattatcataggagcatgaaccctatcrtgaccagagcattcaggaatctaggttgagtgtccttatgagaatctaatgcccgatgatctgttactgtctcccatcacccccatatgggaccatcttattgcaggaaaacaagctcagggctcccactgattccacattatggcaagttgtataattgtttcattatatattacaatataataatgatagaaataaagtgcacaataaatgtaatgcgcttgaatcatcctgaaaccatccctccccaccctgattcatggaaaattgtcttccacaaaaccagtccctagtgtcaaaaaagtaggagaccattgtcctagatatactgtttcatggaacaagtaaggtgcagaaaagtgtatagcttatgttgcttgtgtaaaaaagagcaaaatgggccgggtgtggtggctcatgcctgtaatcctagcactttggcaggccaagacgggcagatcaygaggtcaggagatcragaccatcctggctgacacggtgaaaccccatctctactaaaaatacaaaaaattagccaggcatggtggcatgcacctgtggtcccagctactcgggaggctgaggcaggagaatggcgtgaacccaggaggtggaggttgcagtgagctgagatcgtgccactgcactccagcctgggtgacaaagcaagactccgtctcaaaaaaaaaaaaaaaaaggcggggggcaaaatgtgtgtgtatttgtgtatgtgtgtgtgttttcttgtatactgtaaaatatctctgtaaggggatacacatgctgatcaatactggcttaggggatgtggttagggggagaccttatactgtttatctttaacctttttcaattttgagtcttatgaaagtcacatctaatttaaaagtaaataatggaccgggtacagtggctcacacttgtaatcccacactttgggaggccaagaggggaggattgctctagcccaggagttcaagacaaccctggacaacatggtaagatcctatctctacaaaaaattttaaaattagcagggcatggtggcacactcctgaggttccaggtattcaggaggctgaggtgagaggatagagtgaacttgggaggtcaaggctgcagtgaaccatgatctcaccactgtactccagcctgggcaagagtgagaccctgtctcaaaaaaataaaaataaatgatacactgaaaatatagcagaatttctgtaaaaaaaattttttttgagatggagtctcactctgttggagtgcagtggtgtgatcttagctcactgcaagctccacctcccaggttcacaccattctcctgcctcagcctcccgagtagctgggactacaggtacccaccaccacgctcagctaattttttgtatttttagtagagatggggtttcactgtgttagccaggatggtcttggtctcctgacctcgtgatccacccacctcggcctcccaaagtgctgggattacaggcatgagccaccgcacccagccaaaaataattcttaatcttaatttcacattgataaaatgtatttgaacaaaattattatacttctttatttttttcctctgaaatggccaaactctcttgactacttgatagaccaccagctgactattctttgagcaaggctgtcccagaactttaaacattcagatgccagagaggctactacagttggatccagtatctgaacccacatctctttaggaccacaaattgtattcttataccagagattaagtgggatcttattagagaaattcctaattcttaattcaattagtcagtatttgctggaaacctattatttaatattatctgttatacagagattagtgtatcctggctgctgttctcaagaagctcacaagcatgctgaagttactaaactatatccaattacataaaataggttctaaaggccccagcaactatggcagttggttaaaatagatttattataacaccccgtgcctaagtatacatctgaaaggatacacacaactttttatttttattttatttttttgagacagggtctcactctgtcgaccaggctggggtgcagtggtgcaatgtcagctccctgcagcctccaccttctgggtttaagcaattctcctgcctcagcctcctcagtagctgggactacaggtgtgtgccaccacgcctggctagaattattaatagcaattacatctgttggatgggattgctagaaaggagacaaggggaagacttttacttttttaaatatttcaaatatgaagatggtgggatcatgaaggattttattcatttttagcatttttgtttttcaaataaaaacataggaaaaaatcaagagtttcaaaccaatacataaagttatttcttcacataattaaaacaaattatcatataccactttcctacctcccttcattgaatagtacaaaacttggtactctgcttttatctactagatattctgtatttgccttgacccttgttaaatgaagtctccctttgtttaggaaaaatatacagtatatcaaaggatgagatcaccaacccaaagctatgctgattagtcttgttgaacaaagaaaatacaggctttggctgggtatggtggctcatgcctgtaatcccagcactttgggaggctgaggcaggtggatcaygaggtcaggagatcgataccatcctggctaacacggtgaaaccccatctctactaaaaatacaaaaaaattaactgagtctggtggcgggcacctgtagtcccagctactcaggaggctgaggcaggagaatggcgtgaacccaggaggtagagcttgcagtgagccgagattgcaccactgcactccagcctgggcaacagagcgagactccgtctcaaaaaacatataggctttatgggaagggtttgttatggggtgtattggttactgaggcaggagtagtttggaaaatcagtcataaaagcatgggttacagaagttcattttctgttacctagatgtgtttgctgaaggagctatcactgatcaattacaacaggtttaaaacaagcattggtgtttagttggtaccatgctataaaaatttcagtctcggctgggcacagtggctcacacctgtaatcccagtactttgggaggctgtggcgggtggatcacctgaggtcaggagttcaaaaccagcctggccaacatggtgaaaccccgtctctaccaaaaaatactaaaattacctgggcatggtggtacatgcctgtagtcccagcaactcgggaggctgaagcaggagaatcgcttgaacccaggaggcggaggttgcagtgagcccagatcacgccactgtactccagcctaggtgacagagtgagactctgtttaaaaaaaaaaaaaatcagtctttttctaggtttgtggggattttttttaaattctaaaaacgaaggccggtcgcggtggctcacgcctataatcccagcactttgggaggccaaggtgggcggatcatgaggtcaggagatcgagaccatcctggctaacacrgtgaaaccccatctctactaaaaacacaaaaaaattagccaggtgtggtggtaggcgcctgtagtcccagctacttgggaggctgaggcaggagaatggcgtgaacccgggaggtggagcttgcagtgagctgagatagcaccactgcactccagcctgggcaacagagtgagactccatctcaaaaaaaaaaaaaaaaaaaaaaagttccatctttttttgcttggtcttgattttaaaaactagaggaatcttgcactgaaaattttaatttcttttgacctatcataattttatattaaaaggtcataatatagtgtattaattttctcttccgctgtaacaaattaccacaaatttagtcacttaacacaatacaaatttatcatcttatgattcagtatattagaaatctgacacaggtctcactagactaaaaaccaagatactggaagagctgaattccttcttgaggctctagggaagaatctgtttcctttctttttccagcttctagaggttacccacattccttggctcacagccccttttctccttcttcaaagcgagcaacaaacgtttctctgaccctacttctgttgtcatatctctttctctgacaaccccttcgtcctccctctttcagttgtaaggacctttacaattaycttgagcctgcctggaggatcaaggatactcttcctaccttgagggccttaatttagtcacacctgcaaaatccctcttgccatgtaagttaacatatttgcaggtcacaaggattaggacacgaacatgtttaggggacctttattcttcctaccacacgtggaaattgaatttataaatatatccgttagaattgcacttgaccgcttaaacaagtaagggatctctctgtctcctatagcaggaaatctgggaacgggaagctcaaggctgattgtgatggcctcaacaatgccagcaaggaaactgacccctagtgtcctgatcactaccatgcttagcaatgactgctgagcctcaggcatcctcaccggttccaggcaggaaaaaagaaatggaagaggcagtaccagcaaaattcagcttacattttgttagccagaattgagtcatgggaccacccctagctacaaggaaatctgagaagggaagtttttagctttcctccttctctaaagaaggaaggaaaattgaaataagagttggaatgagtgacaggtgagctaacctacagaattgactacaagtaagtgattgaacaaacaactttaataatccaattattgaagggcaggactcaggtgtaggaatttagtggactatttgctatacatgttactcaatatctgttagtcctaagatcaaaattgatttttaaaaaaaagactcacaagtcacagtttacttagccttaaaaggtacacggtaaacaatgcacacagctaaacagcagagaccttctgatgtctggcaatgctgggtgcagcttccatgcccctccaccacacagcatgctcagctgcaagaggtgaggctgaagcgygtgcagaagacttgacctctgggcagccaccctttccattctctacctatgtgtagtccatgcttgctgcatagcctctgggagaaagtgctaaatcacatgcctaacagggcagctgcaactcatcaatcaggggtttcacaatgaatgcttctgtaagccaggggcaatctgacctgctaacattccaagtttatcttgtatcaatacattctggggagcagagtggcaagaaggtaaatctaaggtcatatccccagggtccctgggtctggggcaaaagtttagaccagccaaaaattccttccttggtgggctaatatatttatctttctttcttcctcttgaattcagagtatctttcttcctcttgaattcagagtatctttcttcctcttgaattcagaatcaattgagagaaatacaggagtcaggataagtgagcatcaaaatatcaccttaataaagtcaactggaagatgtggccaagtgggcaggctcacactttccccagacatccccgcctggttgctggcacagctgaacaacacaggcttctcagcaaaggcagggtcataggaagcagatccactccctgtaacacacaggtctagaaaggtggaggaagggctgagctcagtctgttcttactaactcacatgtctgactgctcactcctatttccctggggaggggcgaatgaggaacagggagatactcagtgattctcagccaatctcacagttcaaagccacccagggaaccaatgtgcagtgaggtagaaagccactcacctacctgaagttgctgcatctggaaacataagagatggagatactgttcttccccataactcagaagattcattttaactacgctctacttttctcataaatggcaaatttcctctgagatagtttcctttttttatttttatttttgagatggagtcttgctctgtcgcccaggctggagtgcaatggcacgatctcagctcattgcaacctccgcctcctgggttcaagcagttctcctgcctcagcctcccgagtagctgggattacaggtgcctgccaccacgcctggctaattttttgtatttttagtagagagagggtatcatcgtgttagccaggatggtctccatctcctgaccttgtgatctgcccgcctcagcctcccaaagtgctgggattacaggcatgagccatcgygcccggcctttcaattcttttaatacaaagcaaatgaaaacacctgttttcaatttcttttaccagtcaggctatcttttggaacctaagacagtttgcctctaggtttctgctagcactcttgtttgagggcattccctggagtcataaagggcagttctttgggaagaagggatgggaagaaaaaataatgtcagttcataaaataatcttcagacattcttatttataaatgccatcatcaatagagttttcatttttcctttgctcaacaaaaagctatcaagtatcttgagtagctgttttttgttttttgttttaatagttatgacagggaccagcacggtggctcaagcctgtaatcccagcactttgggaggctgaggtgggcagatcgcctgaggtcgggagttcgagaccagcctggccaacatggagaaaccctgtctctactaaaaatacaaaatttagccagatttggtgttgcatgcctgtcatcccagctacttgggaggctaaggcaggagaactgcttgaacccggtaggcggaggttgaaatgagctgagattgtgccattgcactccagcctgggcgacagagcaagacatcccagctacttgggagtctgtggcaggagaattgcttgactcgggaggcaaagattgcagtaagctgagatcacaccactgcactccagcctgggagtcggagggagactctgtcccagatttaaaaaaaaaaaaaaaaaaaggctatggtaatgacctgtctccctcttgcttaagttytttctttctttctttctttctttctttctttctttctttctttctttctttctttctttctttcttttttaatctatctttctttctttctytctctctctctctctttatatttttattttccagagtctccaacccaggttggagtgcagtggtgtgattatagctcactgcagcctcaacctcctgggatcgggatcaagggatgctcccacctcagcttcccgaggagctggaactacaggtgcacaccaccatgcccagctaattttttattttttatagagacgggggtctccctatgttgcccaggctagtcttcaactcctgggctcaagcaatcctccagcctcmgcttcccaaagcgttgggattacagatgtaaaccactgcacctggcctgagttttcagtaaaccaaataattaatgtaattctgactgtattagaacctaaagcacattttctggctatgggtccccaagcagagcaggaggcctgaccagttcatggattccctgcaccgggtctggcagaaagtcacagaactcgttgtattaggtctcccctcaggtacttgaagatacagtcttcatatctcttcaatattccaggggaggggaccctacttgttttcaagatactgacttttcatgttaatagcaatgctcccatagatattatattgcatcccagaacttttcaaatctgtagttccacctaaaattttatctagtgaattgttacttactgcctaggtgccaaccagtacagcagtgcgtcttcatcttacttagacttcagagcctcccactggctgtaatggatgagcatgcacccaagctccccttccaccactctgcttgctggcatatgagagtgctctcctctgcagggtcctgaatcttgattctcattggctactaatatgtaatggcttttgctcagtgctgttgtgacaatcaccctgttggccttctgtgtctaggaagaattacagtcactaccctaacgagctcagagtctcaatttgcagaaggcctgtcattgaacataaaatgaattttgagccattgagaagactttctgcttttcttgagccagtggttgaacagtgtaatcccaggtgtgcctgtaatccttggtctttgggaggccaaggcgagaggatcacttaaggccaggagtttgagaccagcctgggcaacatgggaaaaccccatctctaccaaaaatacaaaaaaaattagctgggcgtggtggcgcacagctgtagtcccagctattcaggaggctgagatggaaggatggtttgagcccaagaggcagacattgcagcgagcttagattgtgtcactgcactccagtcagggcaacaaagccagaccccgtctcataaaaatggctgggcatagtgggtcatgcctataatcctagcactttgagagactaaggcaggaggattgcttgaggccagtagttagagacctgtgtggctaacttagtgagaccctgtctgttttgttttttttttttttggagacagagtcttgccttgtcacccaggctggagtgcagcggtgggatcttggctcactgcaacctttgcctcctgagttcaagtgattctcctgcctcagcctcctgaggggctgggactacaggtgtataccaccactcccagctaatttttgtatttttagtaaagatggtgtgtcaccatgttggccaggctggtcttgaactactgacctcaggggaccttcccaccttggcctcccaaagtgttgggattacaggcatgagccaccatgcccggctcccatctgtattttcaaaaaaaataaataaataaatgacagtatggcctattctattctattctattctattctattctattctattctattcatttgagacagggtcttgctctgtcgcccagactggaatgcagtggcgtgaacatacctcactgcagcctcaatctcctgggtataagtgatcctcctatctcagcctctagagtagctggaactataggcatgtcccaccgtgccgggctaatttaatttaaaaactttttttacacagacagggtctcgctatatttcccaggctggtctcaaacttctgggctaaagcctcagcctcccaaagtgctgggattatargagtgagccactgtacctggctctattttatttatttatttatttattttattttatttattattatttttttttgagatggagtctggctctgtcatccaggctggagtgcagtggtgcgatctcagctcactacaagctcygccacccaggttcacgccattctgctgcctcagccttccgagtagctgagactacaggcgcctgctaccaygcccagctaattttttgtatttttagtacagacggggtttcaccatgttggtctggctggtcttgatctcctgacctcgtgatcctcctgcctcggcctcccaaagtgctgggattacagacatgagccaccgcgcccggccctggttctattttaaataaataaatacatgaaactaaaacacaattggaactttatttgctctttgatgacccttcatagcacctcaatttctcatggcatgcctcttgcttggtttacatcatagaatttctggcataataggccgggcatggtggcttacgcctgtaatcctagcacgttgggaggccraggcgggtgggtcacctgaggtcaggagttcgagaccagcctggccaacatggtgaaaccccaactctactaaaaatacaaaaattagccaggagtggtggtgggcacctgtagtcccagctacttgggaagctgaggcaggagaattgcttgaacctgggcacagaggttgcagtaagccaagatcaygccacttcactccagcctgggcaaaagggcgaaactccatctcaaaaaatataataataatttctggcataatctcagaagattcggccaggcataatggctcactcctgtaatcccagcattttgggaggccgaggcaggcgaatcacttgaggtcaggagttcgagtccagcctggccaacatggtgaaacaatgtctcaaaaagagggagactctgtctcaaaaaaaaaaaaaaatctcagaagattcttagaaatttcttaccactgttaaaagaaaaaaacttcagctgagttaaatgtaaagaagtttagctaaacaatgaacaatttgcgaatagggcaacccccagaatcacagcagattcgtagtgaatccagcgtagctacctggtggaagaagatttatggacagcaaaatgaaagtgacgaacagaaaacagaagtgaagtacagaaacaactggattggttacagcttggcatttgccttacttgaacacagtttgaacatttggctacatttgattggccaaaactcagtgattggcacggatgtgggctgtatacctccactttttacagttcatgatgtacagaaaaacctgtaggccaaacttaaacatgtgagaaggcagctttaagctaaacttgatttaaacccaccttgtctcagttctcctggtttccaaattatcttctggcctcattttcttccctagctcagaaatatagtgactatccatcactatttccagcattaacgccttcaaatctcttagtcttctgtttcacttgtgctataatcatccagacgacaacagacctagctaaagaacatataacattaggtttcacatctgacaaatatgtgatctgcagtggacatatgctcatttttgctcaccattatccagcctcctttctttggcaaaaccatcttaatctgcaccatgctgtattccagtcttggaggcagctccccaactaagaatatgmctctagctaagccagacagtgtctccccaccatcccctctctctggaattggactctggggtggagtgatccaaagatattaagcaatatacaggcagctatgtcctaaataatcaatctattcatttctactactgaggcctgtgaaatgctttggttttgttttttacatattggttcattaacctccccctttgttttgcccctcttgtttccacatatttttccaatgaaatcccttttatcttgtgataaaagtgatttgctgttgtttgcaactacaaaaccctaactagcggtggcagcttgtattagtgatttaaatcctgcataatcaggaaaattatatttacatattaagatgtcatgaggagcaaatgtgaaaagaaactcaaggggtctagtatgcaatagccacaataaatccatgccctctaaaatcaggtgaacctccaacacagcttggcagtctttttatttggtctgggccatctgcttcaccaaatcccctcggagggttttacaaacatttacaattttcttcaggctgcccactctatctctacctcaatctcaacagcctgtctggaatgttacaggtgaacatcaaggagatagagataccatgtttgcagaatctcagaaggcttttttgatcttgtgattcatgccagggtcatgatgtcttaaaactaggtttgcaagaatacacttttgaaaaaacacattaggacattgattagaatcgccttaccaatacctgcatcctataagtgttttgcaatactcasagtggctcagtggagtgagtgaggttgtaatccgagctgctactgaaattcttctttataatttgatagtgttggacttgaaggtcccatctggttacacagtaatttaccactttactgtgggttctggtaygccaaagaaggcagtactctccagtctttgtttaaacaactctaggatcagaatgttcctggtttgtcctggtaccagagacactgtttgaaattgtttgtgtcttcttttcagtcaatcattcaaacgttcaaacatcgagattacatgcatctacaaaaaatgtatgtatgtcttaattatgaaagcattctcaacataccaaactacaaacatatcagccataaatttctgcaatctcaatatatataaagtagcactatgagatgaaagaatgttgatcaacttgaaaagatagttttggggtatccagaaccaaagcctccaacctttctcattgatttctggataaggaggcctcctttatgtattttttctttttaccctctttctttcccttccttcctccctgcctttataaagctacctaaacaatctaggactagcattaagtttgttggacatggcatttttctcagtacaaatatttcaatttttcttcctgtttaaaaattaattttattatatttatttttaaatttatttatttatctatttgagatggattctcgctctgttgcccaggctggagtgcagtggtgcaatctcggctcactacaacctccacctcctgggttcaagctattctcctgcctcagcctcccgagtaattgggattacaggtgtaaaccaccatgtctggctaatattttgtatttttagtagaaatgggggggtctcaccatgttggccaagctggtcttgagctcctgacctcaagtgatccgcctgccttggcttcccaaagtgctgggattacaggtgtgagccaccatggctgtcccctgaatttttttttttttttttttttgagacgaagtctcgctcttgtcccctaggctggagcataatggcgcgatctcggctcactgcaatctccacctcctgggttcaagcgattctcctgtctcagcctccccaagtagctgggattacaggcacctgacaccacgcctggctaatttttgtatttttagtagagacggggtttcaccatgttggccaggttggtctcaaactcctgacctcaggtgatccgcctgcctcggactcccaaagtgctgggattacacgcctgagccaccgcgtcaggccgaaaatttttaacgtttagaaacccacgtttctagcagagcgtggtggcacacatctgtagtcccagcactttgactgggtgaggctggtggatcgcttgagcccargagcttgataccaacctgggcaatacagtgagacctcacctctatagttgaaagaaagaaaaaaagaagggcagggtagggcagcggaggggaggggaggggaaggcaggggaggggagggatgtttccttggatgaaatgtgtttcttcttgtggtccccgaccagttttaaactytagaactgtggcactactaactggcttctaggcagcctcttccacttagatgggtttgaagtacagaaatgatttcatcagcctgaccattgaggctctagagattcaagcatgtggagaagttctgagtgctcaatctcaatgccaatcatttyactggtgaaaataaggttcatagcttgaataagaggaaacatctatccacctgacatcaggttttgttcctgattaaggatacattttgatactggagtgctggaaagggaagattgtggtccctttaaacaatacaaaagggaggaagggaagtgctggatagagaaaggtgtggtccctgcctagggctccacccccacggacctaggtgaggacaggcatttccggcccaaatgttgcatttcccaagaccatcctggcctgccacgcccccatcctgggcctgtaaaaaccagagaccctggcaggcagacacagtggctggacattgtgaggaaggcgttggtggaagaagatgcaagtggctggtcgttgaaaggagcacaccaggagaaaagcatatcagcaggcaccagcataccagcaggcaccagcacgtcggcaggccatcgactggtgggacgccaccggcaggcgggaggaggtgcagtttggccgggacagtcggaggagagccagggctgcccagtggcccaactccaggggaagactatctcccttctggctcctccatcggctgagagctgctcccgctcagtaaaactttgcactcattttccaagtccacgtgtgatccgagtcttccactacaccaaggcaagaacccgggatacagaaagctctctgtccttgcaacaaggtagagggtctaattgagctggttaacacaagacggtaaactaaaagcatcctgtaacatgcccactggggcttcaggagccgtaaacattcacccctagacactgccgtggggtcggagccccacagcctgccygtctgtatgctcccctagaggtctgagcagccaggcactgaagaagtgagccacacccccattgcatgctctgcgagggggacagggaaactttaccgcttcaatatcgacttgcaagtgaaaacagtttctgatattgtatgtgtatgagcaggctactgctgcatgtagcttgtgattgggcctaatgatgttattccataattataatatttagtgcataattattgcattatatgcaaatgttgtactgcattatgaactcttgctcacagcacagttacatcatagaaatgtggggacaatagctgcaggatgtagagtgtctatgctagagacaccctgggggacacagctcttagaacttggtttcataacattggtttaggagaaatttaggtctgaaatctagagcattccagggaggagttggtcttgaacaatttgcgtaggagtggatttggtaaggttctgagtcttgggataggcaccatgaagtatctgaagaaggtgctggcagacagaagtggattatgaggctgggcgcagctcttttatattttctgcataaactggtaattagggtgagccttctgcttttatgatgagctaaaactataaataatggtttggtgcacatatcagtggcgtcctctgaaaaaaaagggaaacttttgctgtttccacattccatcttgcctttgccctagggattgtaccaaatagatgcaactcattttggagttacatactttttaaaatatttgttcgtttatttatttgtagagatggagtcaccctctgttgcccagactggtctggaactcctggcccgaagtgatcctcccacctcagcctccaaaagtgttaggattatagggatgagccaccacatccggcctggaatactgttattaaaaaatgtttctattcctaatcaaaagctcccagaagtaatcaatcccctcaaacagaaccaacacagctatcagttgggaaacctgtgggactttcagactcttgagcaaggaattggatataataatggaactaaaaaaagagaacaaatctaggaatttgcattttgaagtcatcagcatacagatggcagctaagggcaatgacatagaaaaagaaagggagagtgtttagaataagaaaaaagagatgaggactaaattgtcaaaaataccaacatttatagagagctaaaggaagaaggtcagcagtggataaaagccagggaagaatggtgtcacactagtcaaggcaaaagagagtcaaggaaaacaagaagtatagagtgaaacctcagaatatagtttcagagtatccagaaccaagataggagaactagtaaagaggaattagttaaactgtaagagcaagagggtaatggatgcagcaaagttcctgaagagatgggagaagatcataaagaatacaagggaagtttggtagtcagcctccaagatggccaccaatgatccttcctcctggtagtcatgcccttttgtcagcccctcccacaatggtctgagtgactaattgaatgtggcagaaatggcactatgtcatttctgagattaggttataaaatatactgtggcttctgtcttggtgactttcgcttgctttctctctcttccctgatcatttgctctgggggaagccagctgccatctgtggggaagcacatatggtgaggaactaaggcttcttgccaacaaccgtgtgagggagcttggaagggaatcctccagttcagttaagccttcagacaatggcagccctggttgacatctggctgtaactctcatgagacattctgagccagaaccactctgccatgttgctcccagattcctcaaatccgaaatggtgtgaggtaatagacatttgttgttttaagctgtgaagtctgggtaatttgttatatagaaatagataatacaggagggattggctttgaacaggaaggtagactgcttcctctgagaagttaccatgtagggtcatttttgtaaaatcttgttcttcaagtttaccctttattgcttaggcttggtatcttaaaatatttcaaattctaagttacaactagacttaagccatttttattgctcatcaaaaaatattttaggctggatgtagtggctcacgcctaacatcccagcacttagggaggctgaggtggaaggattgcttgaggccaggagttcaagactagcctgggcaacatagcaaaattccctctctccaaaatacatatatttatttaaatatatgtctttaaataaatatatgtttacatgaatgtatatatttatatataaatacatatataaaattagaatttcctactttttgtaacatcctcaaagttggctataatacctattttcttagctgatatccatttaatcattcatttgataaatatttattgtatgtgacattagtattaactttatagaaagcaatgytgcttttaaagtgattagtagggtgataaatgagctatttgctagtatatccaagttatctagtaagaagggtttactgagcaaagaagtatgggtaatagcataaaagtataaacaaatacccaaacagtatacatgagaagttaatcatcttgtcagaagaaaatgatacatacaaaaaacccaagcatgtgtgaagaacagtgtgagaatgtatccagccaaaattatattcaaagtaaaaatcatgtgtgcatgacgaactgtatagcatgagttaaaacaaatgaatacccctgatcacagaacaatgagaaattcctgcagcaagtgagcataactgccaaataggataatataaaagaagtatgaagggaaaactaattttgagcctgtaaccatgtggaactgaagctaattcttcaagttctgcttcaggttatcaggaactgtgctcccgtaatttaaccatttatgataagtacaagattttcacacagaaaaaattattctgctggtggaatgtgaactattacatcaaacttgtaaaattttctataattttcattatttatctcagactttgactcttgtattcttttgaagaaggacttgtgtggaaaccatggtgcaaagtttaaaataccaaatgcgcgttaaagaaattagagttgttagctaccttctgttctcctttgttgtattttgggttttactgggtactggagccgctgtaccacattgatagcctgaggtttgaccaggtcatggggctggacaaaggtggtgagttgatgaacagatccagctgtcagcacagcaaggagatccaatcctgtgggccaaggacagtcctcatggttttcaattaatcgtgtgtaagaaaaattgtactacttgaaagaccttgatttaaattcttgctttaccatttgataactctgtgatactgagcaagagactttacctctgtgagccttaatgtcttctccacaaaatagagctgaaaaaaatctgctgtaattacatcctgtttttcttcttaaaggtcaaatgagcctggcatcaaatatatgtgaagccattttttttttttagatggagtttcactcttgtccaggctggagtgcaatggcacgatcttggcttactgcaayctccacctccctggttcaagcaattcttctgcctcagcctcccgaatatctgggattacaggcatgcgccatcatgtccagctaattttgtatttttagtagatgcagggtttcaccatgttggtcagcctggtctcgaactcctgacctcaggwgatccactcgcctcagcctcccaaagtgctgggattataggcatgagccactgtgccaggcctatgtgaagccatcttttaaaactttacactgctataagcagaattttttcttttttcttttctttttttttttcttttttgagacagagtctcactctcacccaagctggagtgcagtggcgcgatcttggctcactgcaacctctgcctccttttcaagtgattctcatgtctcagcctccgccgcctgggttcacgccattctcccgcctcagcctcccgagtagctgggattacaggcatgcaccaccacacccagctaatttttatattttagtagagatgggatttcaccatgttggctaggctgatctggaactcctgacctcagatgatccaatcacctcagcctcctaaagtgctgggattacagatgtgagccaccatgcccggccttaaacagaataatactgttatcattccgttttgcttaaatctttatgttcttggcaaaagcttagataggctttaagctatgaatacaacttgggaagggctaacagctaattccaaaaaaagaggccgggcgcagtggctcacacctgtaatcccagcgtcttgggaagccgaggagggtagatcacgagatcagaagttcaagaccagcctggcagagatggtgaaaccccatctctactaaaaatacaaaaattagctgggcatggtggcaggtgcctgtaatcccagctacttgggaggctgaggcacagaattgcttgaacccggggggtggaggttgcagtgagccaagatcacgccactgcactccagcctgggcgacagagcgagactccatctcaaaaaaaaaaaaaaaggaaaaccatcttttctaaaaatcattaaaacaattgaagttagtttttgaataagaaaataatgcctaaaacaaatctgtatcactaggcaacattaaatctttatctcctcgagattacaaggactttctatttagtacacaaggaccaatttttccaaaaccaaaaagccaagcctgttagcacttactgtcacaaatggttaccacaaaaacaaaataatgaaggttgaatttatggtttctgtaaaagggaagcctctaggatctttaaaagtatttttttctatttttaaatataacattcattgtagaaagtttggaaacatagtacaagtayaaggaagaaaatttttataacttacaatcacattgctgaggataacattttgttaatgtttttgcatagttttttttccaatttttgtcttcctcttgtctgcttttttctcacattttttttattatgagcagtgccatagcattacataagcttttttcttttctttttttttttttgagacagagtctcactctgtcacccagtctggagtgcagtggcacaatctcrgctcactrcaagctccgccgcctgggttcacrccattctcccgcctcagcctcccgagtagctgggactacaggtgcccgccaccacatccggctaattttttgtatttttagtagagatgggatttcactgtgttagccaggatggtcccgatctcctgacctcatgatccgcccacctyggcctcccaaagtgctgggattacagaggtgagccactgctcccagcgcttttttctttttttttaagatggtgtctcactttattgcccaggctggagtgtagtggctcgatctctgctcactgcagcctctgcctcccrggttcaagtgattctcctgcctcagcctccccagtagctaggattacaggcgcccactaccaagcctggctaatttttgtatttttagtagagataaggtttcrccatgttggccaggttggtctcgaactcctgacctcaagtgatccgcctgcctcagcctcccaacatgcgtgagccaccrtgcccggccagcattacataagctttcaaaacatgatttttactatcctatcctaaaagtttttttttttttttttttttttgagactgagtctcactctgttgaccaggctggagtgcagtggtgcgatcttggctcactacaagctccgcctcrtgagttcacaccattctactgccttggcctcccgagtagctgggactacaggcatccrccaccacgcccagctgattttttgtgtttttggtagagacggggtttcaccatgttagccaggatggtctccatctcctgacctcatgatctgcctgcctcggcctcccaaagtgccgggattacaggcgtgagccaccacacccggtcaaaagattattttttaatctgaaattatttccaaggtaaatatttttcttccaggtrttttcctaaggacccaagttcaaaaccttgcattactctggtctccctttcttttttttttttttttgtcttatgagaaatcaagtctgaattgatttggttcagaatcaaacctgaatctgatcactaaattctactaattcttttctttctatgtctatccacatagttctggcccggccaggcccctgtttcctcagcccagattattgaagtacttttctgacttttttatttctttgtagcctcttttctctatggtaatctattttacatatctctttgcatcattaccttgacaaaaatattgactgcctctaccttatatggcagaggtcccaaacttgagctccaaggctgaacatagtctgcaaatttgtttttctacaactccacagtgctctgaccattatttttaaatttgctggaatcctttcaaagggccccaggtttcactgatttgtgttacctgcctggcgtctaggcttccaggtatggctgagtagactttgcttttttttttttttttttttctgagacagagtcttgctctgtctcccaggctggagtgcaatggcacgatctcggctcactgcaacctccacctcctgggttcaaacgattctcctgcctcagcctcctgagtagctgggatgacaggcgcatgccaccacgcccagctaatttttgtattttagtagagatggggtttcaccatgttggccaggctggtctcgaactcctgaccttgtgatctgcctgcctcggcctcccaaagtgctgggattgcaggcgagagccaccacgtccagccgactttgcattttataactccagagggcactgtgcacataacataaaaagttgtgcagtgcacagcctatacaatctgcacaactctacctggtggccctatgggagcctatggccatttagtgtgaactctagtctgtaaaacgaatatcatgcccactatrtcgactaatcaagcccatcctgtaccatagtctggaaaaggctgacattcctaaaagctttgcactctaagataagccacgaaaaccagaaatatttcaaaagctttgaattccaagataagccgtgaagttattttttatgcaaaagacagaaacatactgtttttctttttatcaagactgaccccaaagttatccaatcagaattgttgactaatatataacaatctgagctatctcctgactttgtgattttttttttttttagacagtcttgctcttgacacccaggctggagtgcaatggtgcgatttcggctcactgcaacctccacttcctgggttcaggcaattctcctgcctcagccttgacagtagctgggattacaggcgcccaccaccacatccagctaatttttgtatttttaatagagacrggatttcaccatgttatagttcaaatacttttttaaaaattagatgtgctagttctgtactaacttgtctttttttgcaagttaaaatgctagtcagttctcaaatttgtctgtgaattttgcaggatagagtataaaattccttaaatcctaattccaagctctttacaatgtgggccctacatccctaaagttttctcctttgcgtaaatactacacttgagacaaactaattgttttcccccaacataaactttatagttctcttctgttgcatttctactctccaatatttctgattcttttcctctctttttttttttttggataaacaagtttatttgtaaatttagtcaacatacataattgacctaaaaacttcaataagataaattttaaaaccacttggaaggccatctctataaaaatgattttcccaggacagtaaccagatgtaacctaacctaacaccatcttaaccrgcagaggttcagtgggctagagctttgtgctcctcccctacaccaagtttttataatacaaatgccacaagaaaaagaacttcagtactgtttcctcttagcagaggagaaaactcaacctagttatgagaccaaccacacaacacaatgaaaagctgcactagttcagaatattagttaacagatgatgctggtgtgaataactcatatttttttctagagcccttataaataaaatcccccagttagtgtttccattatcagctagagggttagttaacatgtggtagaatgaggatttatgcaaggtataaatgcacatagcattttactactatgagaacaagtgcagtcagaagaaaaccaactggactctaaattacacacaccttaatgacaagactccccaccacttgtgaatgtaaaacatttaatttgaaaatgttgacactacaatatataaaatagctattataaatgcacatattgtattctatagctgccaggtttaattttttttttttaaaggaaactataagttacactgtggttaaggtttgtatcttcacccttgaaaaagcctacattctatcacagtgatgtatggtcagacttaacagccccaaytgttaaacacttggatcaagtcataaccagttttattgcaaaaggaccctgttgtacacatttatcaattctagtaccttaatagctacccaacaagtcattaacatacagaaacatgcatcatgagaagcaagaaatatcaygcatccgttttgcatattaacaacttgtcactcctgagcaacagtgctgacatcactgaggtctgtaaacagtcacttttcgcattcatcctgagtgaaagatggaatgacttaagtacaaatgcaacatataaacaatttcttacaaaaaaagtcaccaattaaaccaaagtattttacagaatttactacaaaatgccataaaaactgccttcmcttaagctctctctccccgtatccggcgagccaactggatgtctttgggcatgatggtgactctcttagcgtggatggcacacaggttagtatcttccaacagacccaccaggtacgcttcgctagcctcctgcagcgcaccgacggctgcgctctgaaacctcaggtcagtgttgaaatcctgcgcgatctccctcaccaacctctggaagggcagcttccggatgagcagctcggtcgacttctgataacgacgaatctctcgaagcgccacggtcccaggcctgtagcgakgaggcttcaccccgyaggtagagggggtgcttttcctggcagctttcgtggccagctgtttgcggggggctttcccacyggtggatttacgagcagtctgcttggttcgggccattttctttcacccaacgccgaagttttaggccacttctccgacctccgcgctgcttccgctgcccgaggaagagccgcagtcgcgagcgaagaaccgacactggtccaacgaacgaccaaaccgctctgcgccctcctctcttttatctgcatcccttccattcttcaaagcccatttcggtgtttcgttttttgttgttgttttgttttttgagacggagtctcgctttgttgcccaggctggagtgcagtggcgtgatttcggttcactacaacctccacctcccaggttcsagckattctcctgcctcagcctccagagtagctggrattacaggcgcctgccaccacacctggttaatttttgtatttttagtagagacggagtttcaccatgttggccaggctggtctcaaactcctgacctcaggtgatccgcccgccgcagcctcccaaattactgggattacaggtgtgagccactgcacccgkcctttcaaagctcatttcaatcccacctccktcacaaagcattcttcagccaccttcgttttcatcctttttttctctgcactctttctacccttatcatttacttgacactatgcaaattctacatgtatatgtatttctcatttatttttagtaattatcttttttcttattataaaagtaatacttgtccaatttaaaatacaaaaaatatagagaaacaaactgaaatgtggaatcacatgtgataaacacacacacaagttggctgaatatctgttactcttggaatggggaaagaatcatctagtcatctgccaagaggtataaacctaaagtttagaaacagaaatctgacttttaaatgttacagttctatatgatatttgttccatggagtaaatcataaagtttctctctctctctctttttttttttttttttttgttttttkggagatggagtttcactgtcctcacccaggctggagtgcaatggcacgatctcgtctcgctgaaacctccacctcccaggttcaagcaattctcctgtctcagcctcccaagtagctgggattacaggtgcctgccaccacacctggctaatttttgtatttttagtagagaygggggttttaccattttcgccaggctggtctcgaactcctgacgtgaagtgatccacccacttcagcctcccaaagtgctgggattacaggagtgagccaccgtgcctggccacaaagtatctcttttgtcaggtgagttttttaacttctagaaatatgccacaaagtgagccaggtgtggtggctccgcctgtaatggtagcactgggaggccgaggcaggtggatcacgaggtcaggagtttgagacgagcctggccaacatggcaaaacctgtctctactaaaaatacaaaaattagccaagcgtggtggcatacgcctgtagtcccagctactcgggaggctgaggcaggagacttgcttgaacctaggaggcaaatgttgcaatgagcccagattgcactactgcactccagccagggtaacagagtgagactttgcctccaaaaataaaaaaataaaataacgaaaagctattggattgaccattgatactttccacatctgaagaaatctaccttattttcaaaagggcaaaaaaaggaagggttccccgccccaggttaaaatatagtaaaatctctgagtaattcataacaaataaagcaccttcacactaccataaatctctacactgtgttccaatctgttgagtgcctgaatccaatgacagctttggacgtccccttcccccataatctctgtgcagaccctcaacctcaccccagatgcctttggagttttcattctttattataarcaattgatagtttctcagacttttatatacagcgtaaagaaaatccgtacccagccgggcggtggctcacgcctgtaatcccagcactttgggaggccgaggcgggcggatcacgaggtcaggagatggagaccatcctggctaacacggtgaaacgccgtctctactaaaaatacaaaaaaaaataggtgggcatggtagcaggcgcctgtrgtcccagctactcgggaggctgaggcaggagaatgacgtgaacccgggaggcggagcttgcagtgagcggagatcgcgccactgcacttcagcctgggcgactgagcgagactcctccaaaaacaaaaacaaaaacaaacaaaaaaaagaaaatccgtacccttactactacactaggggcacaaggcggggaagagactcaaacaataagagctactactgtttgctgaacacttatgtactgagtacattccatcctcagaatcaaccttaaacwgttaacatcctcattttacagatgaggaaaatgaggctcagaagagttaactaacctaagagaccctgaagtcctagcattttccacatggaacattttcccctgcaggtcccctttgcctgtagttgttccttccacctcttcctgtgcaggatcttagcccctaactgttcctcctgtccaggctgatcaatccaaagtgcccaaacagtggctgctcatctgcaacaacaattcctccctctttcaagaatctctttgaccaactcttccccaaactagccgcattctggctgacagtcccctctcccactccagctgaagttcgataaaattcttgccgtttcttcccccaagacaggccgttttttagctccttctcaggcctgacattttgaataatgtctatgctaatggagattcagaccctgatctcttcactgccgtactatactggtagttttcaaatttaaaagtcactggttgaattgtttgtttgcaacttgaaatgtcctctctcatagaagtgataccatggtctgaagccagccttttcagctgttataatcatcctgaagctgcctaagtggaggaaataaggcagtaatgaaataaaagattggatttaagtgaatgaaagaaacaggttttggtagagtgaccatataatttactatccaaccaggatactccggggagtgaaaaggtgctattaataattacaccaggacaataggcaggcataaactgaggctgtcctggacacatcaggacatatgttcactctaggtgtmggtcacatcagaatggctttgagcaattcaccctaacctccttgagcctcaatttcttcttcttcttcttcttttcttttttytttttttgagacagggtctcattctgtcactcaggctaaagtgcaatggtgtgatctcggctcactgcagcagccccaaactcctgggctcaagcaatcctcctgcctcagtgtcccttgtacctgggactagaatcgccccaccaagcccaactaattaaaaacaattttttttttttgagatggagtctcrctctgttgcccaggctggagtgtggtggtgcaatcttggctcactgcaagctccgcgtcccgggttcwtgccattctcctacctcagcctcctgcgtagctgggactacaggtgcccrccaccatgcccggctagttttctgtatttttagtagagacggggtttcaccatgttagccaggatggtctcgatctcctgacctcgtgatccacccrcctcggcctcccaaagtgctgggattacaggtgtgagccaccgcgcccggccaaaaacattttttttttttgtagaactggaatctcaccatgttgcccatgctggtttcaaactccgatcctcaaatgatcccaytgcytcagcctcccaaagtgctgggattataagtgtgggccaccgtctccagcctgagcctcaatttctttattgtgaaatgggaggattgacattatggggtgattgtgagaatgacataagtcagagtctattgtgcaaaattgaatttgtaaagtaccatataaatatactttttcagataatagttatgactaatactgttacaggaaaggkgtcccaatccagaccccaagagaaggttctggatcctgcacaagaaagaatttggggcgagttcataaagtaaagtgaaagcaagtttattagagaagtaaaagaataaaagaatggctactccataggcagagcagtggcacgggatgttcaactgagtacacgtatagttatttcttgattatatgttaaacaaggggtggatcattcatgagttttccaggaaaagggcagggatttaccctaactgagggttcctccccttttagaccatatagggtaacttcctaatgttgccatggcgtttgtaaactgtcgtggtgctgctgggagtgtctttgagtatgctaatgcattataattagcgtatagtgagcagtgaggacaactagaggtcactttcatcaccaccttggttttggcaggttttggctgccttctttatggcattrttttatcagcagggtctttatgacctctatcttgtcctgctgacctatcttgtcctgtgactaagaatgcttaacctcctgggaatgcagcccagtaggtgttagcctyattttacccagaccttattcaagatggagtccctctggttccaatgcgtctgacaatactgctgccctgaggtgcctggtgctgattagaccgcgatcaagtgcatattcgctgttgattgatgttactctcctctgtgccactctccctatgtgggcagtctcttctaactgcgggaacagcaaaccaaccagtgagaaaggccatcgtcatttcattcttttgtgtgccaaagcacacaaaccacttagagaatattagagaatatgttctatttccttccagaaaaaaaaaacccactttttttttttttttgagacagagtctgggtggagtgcagtggcgcgatcttggctcactgcaccctcatcttcctgggctcaagcaatcctcctaccttagcctccagagtagctggtactacaggcacatgccaccatacctggctaatatttttgtatttttggtgaagatggtgtttcgctgcattgcccaggctggtctacaacgcctgagctcaagccatctgcctgcctctgcctcccaaagtgctgggattataggcatgagccaccgcgcctggactcacacattctgtttcgattgaagtataaaatgagttagtgttggtgagtaaaacatgaaatttataaacccaaaccccaatcagcaagctagtgagagagagtgctcagcatgggtgctcagcacgcaggaagtccttgagcacaggctcagctcacttttcacttacaattgaaaatctgcactcaggttatgtcatctttggatactccctcctcagacttctccccagatctctaggcaagggggcactaattagaccaacgtgctttgcagcccttgttgactatttccctcacttgtcgttataacattgccttgaggaggagacacttctacagtaaccaggacatgcccgggaagtcccattgtgtggggccctttacccacctttttggccagcttccagtgttcttgacttactggagatctggtagtcttacggccgaaacataattcggttttcattctcttatctcatgtccgagaaccaactattcaacttcctccctcactgctgactggggcgacttttccatggaactaaaaatcctccacatacccgctctatatgaccttgttctttattttccaaggttcttaacctaatacagttattatttacaattctgtgtaaatcctttgtgggatttttttacatactataaccattcatrcattcaacacatattttttgagtgtctagtatatacaacaggtgttggtctaggtctagggctgtatcagtgaatgaaactaagtctttactgtcaaggagtttacatttaattgggtgacacaaaaactacaatagatagataatgtgtctattatagaaatgataataggtgttatgggagaaaattattatagtgtaaggaggacaggtagtccaggggaggggtgtggaaatactgctttacacaagggtagtctgggacagctccgctgtcaaggtggtatctgaatagaaatgagagagyaagccatatggatatgtgatgaaagtgtccctggccgggcgcggtggctcacgcctgtaatcccagcattttaagaggcmgaggcgggcggatcacgagaccatcctggctaacacggtgaaaccccgtctctactaaaaatacaaaaaattagccgggcgtgttggcgggcgcctgtagtcccagctactcgggaggctgaggcacgagaatggcggagcttgcagtgagccgagatcacgccactgcactccagcctgggcgacagcgatactccgtctcaaaaaaacaaaaacaaaaacaaacaaacaaaaaaacgcaaaattagccaggtgtggtgttgtgcgcctgtagtcccagctactcaggaggctgtggcagaagaattgcttaaatccgggaggtggaggttgcggtgagccgagatcgcgacattgcactccagcctgggcaacaagagcaagactccgtcccaaaaataaaaaaatgaaaataaataaaaagagacggccaggagcggtggcttacacatgtaatcccagcactttgggtggctgaggcgggtggttcagctgaggtcgagagtttgagaccagcctgaccaacatggagaaaccctgtctctactaaaaatacaaaattagccgggcgtggtggcgcgtgcctgtaatcccagctactctggaggctgaggcaggagaatggcttgaactcgggaggcagaggttgctgtgagccaagatcacaccattgcactccagcctgggcaacaagagcaaaactccatctcaataaataaataaataaataaataaataaataaatacaatgatattgcagaggccaagtgaagaaaatgtccataatcatactccaaaataataggcttccttggctgggtgtggtggctcacacctgtaatcccagcactttgggaggctgaggcaggcggatagcctgaggtcgggagttcgagaccagcctggccagcatggtgaaaccgcttctctactaaaaatacaaaaattagctgggcgtggtggcaggcgcctgtaatcccagctactcgggaagttgaggcaggagaatggcttgaacccaggagatggaggttgcagtgagtcaagatggcgccattgcactccagcctgggcaacagcatgaaactccatctcaaaaaaaaaaaaaaaattagccaggcatggtgatgcgtgcctgtaatcctagctactagggggcctgaggcaggaggatcacttgaacctgggaggtggaggttgcagtgagacaagatggtgccactctactccagcctgggcaacagagtgagactccatctcaaaaaaaaaaaaaaaaaaaaaaaaaaaaagattgtggcgagcaagtttcttttgaactcnnnnnnnnnnnnnnnnnnnncttggtttttatgacatgaccttttttaagtgcacagtgttgtcaaaaagagtcaaactctgtaaaatatttaaagaaatttattctgagccaaatatgagtgaccatggtctgtgacacagccctcaggagatcctgagaacatgtgcccaaggtggttgggtgcagcttggttttatacattttagggagggcatgagacattaatcaaatacatttaagaagtacattggtttggtccagaaaggcgggacaactcaaagcagataaggcagtggaggggcggcgggggcgggggcgggagggcgtcggtcggggggccttccaggctataggtaaatttaaacattttctggttgacaattggatgagtttgtctaaagacctgggatccatagaaaggaaatgctcaggttaagataaaagattgtgggggctgggcacggtcgttcacacctataatcccagcactttgggaggcagaggtgggcagatcacgaggtcaagagatggagaccatcctggccaacatggagaaaccctgtctctaccaaaaatgcaaaaattagctggggttggtggtgcgttcctgtagtcccagctactcaggaggctgaggcaggagaattgcttgaacctgggaggcagaggttgcagtgagccgagatcgccactgcaatccagcctggtgacagagggagactctgcctcaaaaaaaaaagaaaaaaaagattgtggagacttcgctggcctggtggctcacgcctgtaccccagcacttaggccaggcgcagcggctcactcccgtaatcccagcacttaggccagtygcattggctcacatctataatcccagcactttgggaggccgaggcaggcggatagcctgaggtcgggagttcgagaccagcctggccagcatggtgaaaccgcttctctactaaaaatacaaaaattagctgggcgtggtggcaggcgcctgtaatcccagctactcgggaagttgaggcaggagaatggcttgaacccaggagatggaggttgcagtgagtcaagatggcgccattgcactccagcctgggcaacagcatgaaactccatctcaaaaaaaaaaaaaaaattagccaggcatggtgatgcgtgcctgtaatcctagctactagggggcctgaggcaggaggatcacttgaacctgggaggtggaggttgcagtgagacaagatggtgccactctactccagcctgggcaacagagtgagactccatctcaaaaaaaaaaaaaaaaaaaaaaaaagattgtggcgagcaagtttcttttgaactcttatagtggctgcccttagagagaatagatgacagatgtttcctattcagaccttaaaaggtgctagactcttagttaatctcttcaggagtgctcgcttcggcagcacatatatatgatgatctcttcagggttcggagggcctggaagaaaaagatatagctatgttaatagagattctttacagatgtgaatcttcccctccaaaggacagctgtgcagggccatttcaaaatatggcaaagaaacatgttttggggtaaaatattttgactttcttctttgtcacataatgttaygccagagtcagattggaaagtaagtcacgatatatagggttaaatcaaacccatctgatgagaatttatagtttgtaggccatgactctccagacccttaagataggaatttaggcaagatgaaaaaaaaaaatcagagcttagtcttcacagacaaatagatttttagaatgttcatcaatttaggttttctaaatgtctcttcatgatgaggtttcttccatttttggcagtaaactacataaatgatcttgtatatatatatattagaaatacaggcccagagcggtggcttatgcctgtagtcccagcactttgggagactgaggtgggcctcacttgaggccaggagttccagactagcctgggcaacatgacaaagccacatctctactaaaaatacaaaaattagttgcgtgtggtggcatgggccggcctgtaatcccagctactcaggtggctgaggcagaagaatcgcttgaacccaggaggtggaggttgtagtgagccaagatcatgccactgcactccaggctgagacacagtgaggctctgtctcaaaaaaaaaaaacaaaaaaacaaaaaaaccccacaatgttgggtgattcactattaaatagtaatttaccagttaagaaaaaatatggagcacgaatttccacgtcagcatgtcatcctttcacaggaggcatgctaatcttcttcgtaacatccaattttaatatatatgctaggccgggcrcggtggctcacacctgtaatcccagcactttggaaggccaaggcaggcagatcacaaggtcaggagatcgagaccatcttggctaacacggtgaaaccccgtctctattaaaaatacaaaaaataagccgggcgccgtggcgggcacctgtagtcccagctactcaggaggctgaggcaggagaatgacgtgaacccgggaggcggagcttgcagtgggccgagatcacgccactgcactgcagcctgggcaacagaacgagactctgtctcaaaaaaatacacacacacacacacacacacacacacamtatgtgcatacacacatacgtgcacgcacatgtacatatatacatacgtgcacgcacatgtgcatatatacatacatgcacgcatgtgtatatatacatatgtacacacatatacacatatatatgctgaagcaagcataatttaccaattttttaaaggaggattatgtcaaatcaaaaactgtgatgggaccaggcaaggtagctcatgtctgtaataccaacactttgggaggccaatgtgggaggattgctagaggccaggagtttcagaccagcctgggcagtatagcaagaccctgtctcttaaaaaaaaaaaggcaactgtgatggatgtgagatcttaccccacttgcatagtcataaataagcacatagatagagatgataaatagatactagacgaaacatcaggtttcgtctagtcaaagatcagagctttatttactcacagcaataagagtagccacagcgacattgctgagttgtcctcaagcctgagaattcatataggaaagagactctcctcaaaggagagggaaaagctttgttccctaaggtaaacacattttccttaggaacaaaaaggaaaggagtttgtggattctcaccttttggaatctaagtatctatctctactgggaagataaaatcagcctctttgaggcttttctccacttttgacttgcaaactcatggagagatagttctctacattctttcagagatctttctagggaggaggggaagttccctatcctggaatgtaaggctctgcctccaggtaagagaagttttattatcctttaagtggaagccagtgtctctataatgaaggttgtagagaacaaatatttatgggggaaatgaaagcaagcattttcattttcatagtagattaatatctgtggttcaagagcctgagtttgcaggaacactcagtaatacagagaaaatgtatttcccacagactatagtgcaaaacttcagaatarataaaagttgacttcagtaacacatgggtatcccttctgccctccttccctcccatttactgcatcttttttttgatctttggtgctctcaccggactctaccctgtacttctattttggggtatggatcccttcccaaaagactctttgttacaagattacttttcccatattttacatcctatacttttagagtagctcatctcagctagttgttataaggaaagtaaactaagtcaaaattagtcatcaatgaattattagcttttagtactgcrggagattttttttttcaagagtaccaatgtgtccggaattggtgggttcttggtctcacttcaacaatgaagctgcggaccctcgcggtgttacagctcttaaggtggcrcgtctggagtctgtcccttctgatgttcagatgtgtttggagtttcttccttctggtgggttcgtggtctcgctggctcaggagtgaagctgcagatcttcgcggtgagtgttacagctcataaaagcagcctggacccgaagagtgagcagtagcaagatttattgcaaagagtgaaagaacaaagcttccacggtgtggaaggggacccgagctggttgccaatgctggctcaggcagcctgcttttattctcttatctggccccacccacatcctgctgattggtagagccgagtggcctgtttcgtcagggcgctgattggtgcgtttacaatccctgagctagatacaaaggttctccacgtccccatcagattagttagatacagagtttccacacacaggttctccaaggccccaccagagcagctagatacagagtgtcgattggtgcactcacaaaccttcagctaaacacagggtgctgattggtgtgtttacaaaccttgagctagatacagagtgccrattggtgtatttacaatccctgagctagacataaaggttctccaaggcccaaccagagcagctagatacagagtgtcaattggtgcactcacaaaccttgagctaaacacagggtgctgattggtgtatttacaatccctgagctagatataaagactctccacgtcctcaccagagcagctagatacagastgtmsactggtgcactcacaaaccttgagctaaacacagggtgctgattggtgcatttacaatccctgagctagatataaagactctccacgtcctcaccagagcagctagatacagagtgtcgactggtgcactcacaaaccttgagctaaacacagggtgctgattggtgtatttacaatccctgagctagatataaagactctccacgtcctcaccagactcaggagcccagctggcttcacctagtggatcccgcaccgtggctgcaggtggagctgcctgccagtcctgcgccgtttgctcgcattcctcagcccttgggtggtcgatgggactgggcgccttggagcagggggtggtgctcrtcggggaggctcgggccgcacaggagcccacagagggggtgggaggctcaggcatggcgggctgcaggtcccgagccctgccccrtgggaaggcagctaaggcccggcgagaaatygagcgcagcrccggtgggccagcactgctgggggacccagtacaccctccgcagccactggcccgcgtgctaagtcccccattacctggggccagcagggctgactggctgcccgagtgcggggcccaccaagcccacgcccacccggaactccagctggcccgcaagygccgcaggcagccccggttcccgctcgtgcctctccctccacacctccctgcaagctragggagtgggctccggccttggccagcccagaaaggggctcccacagtgcagtgggggggctgaagggatcctcaaatgccaccaaactgggagcccaggcaggggaggtgccgagagcaagcgagggctctgaggactgccagcacgctgtcacctctcaccaatacttgtcatgtggatgggagacactgtaaaaataaagtgaggtggaaggaaaaggtctgtgaaagcatacttgtaattcataaaataccatataaatgaaagtaaagttgtgtaataattctaaaccaaaaataaaattctaaggccccccaaccatctgaatggactttctcctggccagggcacttttaaaatttaacctgaaagactggttcgggccrtgatggaagggggtggtcagacatgccttgttatacctctccggcattaatatcaacacagaattcagtctgataagaaacattttacagcctattctctctcaagcccactacctgaaggcctcctctgcacatcagaactttggtctccataatccttcatcttaacccagacatttcctttctattcatcccaggtctttagataaactcaaccaattgtcaaccagaaaatttttaaatctacctgcaacctggcagcccccttccagttgtcttgcctttctgaactgaaccagtgtatttcctaaatgtatttgattgaagtctcatgtctccctaaaatgtataaaactaagctgcaccccattcgccttgggtacacattctcaggatctcctgagggctgtgtcatgggccatgatcactcatgtttggcagaataaatttcttcaaatattttacagagtttgactctttttgttgacataattatgcaccgagacttgggaaagagaagacacttaccgcagtgtattttaatacatatgacgttgacttcctgcattttggtgcacaggtcttcattttcctgcctccgtttcatggtcacaagatagctgctgtacccacatgtcaggcctctgagcccaagctaagccatcatatcccctgtgacctgcacgtatacatccagatggcctgaagtaactgaagaatcacagaagaagtgaaaatggcccattcctgccttaacttatgacatcccaccattgtgatttgttgctgccccaccttaactgagcgattaaccttgtgaaattccttctcctggcttagaaactcccccactgagcaccttgtgacccccacctatgcctgcaagagaaaaaccccttttgactgtaattttccactacccacacaaatcctataaaacggccccacccctatctcccttcgctgactctttctggactcagcccgcctgcacccagttgaaataaacagccttgttgctcacacaaagcctgtttggtggtctcttcacacggatgcgcgtgacaccacagagtcacatttatattcctggcagaaagaggaatataaagtaaaggaagaagaaggcaaatargctttgtctttttattctgaaaaggacactaccctcagaaaccaccaccttcatcttattgctaaragcagcgtcacatgaccagcacaagtgcaaatgaggatgggaaagtgagtttttaaattgaacacatggctatttcaaataaaagcagggttctattacaaaaaatggggtgtrtgtgtgtgtgtgtgtgtgtgtgtatgtgtagagggggatattttttaaataggcaactaatagtgttgacttcatccagcaattttacctccaggaatgtatcctatagtgatatatgaggactaagctctgatttttttttttgcccaaattcctatctaaggggtctggggagtcatgccctacaaatcatcaattctcatcagatgggttttatttaatcctgtatattgtgacttactttccaatctgactctggcataacaaggaagaaaatcaaaatattttactgcaaaacatgtttctctgccatatcttgaaacagccctgcaaagtctcttgtgggaaaaatccacattctgtagagaatcccctttccccctttgttttccttccttcctttccagatccaggagataatcagctaagagccaggcacccttctaagttcaataagaaacattttacaacctgctctctctgaagtcagctatctgagagcttcctctgcacaataaaacttggtctccacaatcctttatcttaacctgaacattttctttccattgatccccggccttcagataaactcaaccaactgtcaaccagaaagtatttaaatttacctatagcgtggaagccccggctttgcrttgtcctgcctttctgaaccaaaccaatgtatttcttaaatgtatttgattgatgactcatgtctccctaaaatgaataaaaccaagctggccgggcgcagtggctgatgcctgtaatcccagcactttgggaggccaaagtgggcggatcacgaggtcaggagatcgagaccatcctggctaacacggtgaaaccccgtctctactaaaacaaaaaattagccaggcgcagtggcaggcacctgtagtcccagctactcgggaggcttgaggcagragaatggcgtgaacctgggaggtggagcttgcagtgagcagagatcacgccactgcactccagcctgggtgacagagcgagactccgtctcaaaaaaaaaaaaaaaaaaaaacccaagctgtgccccgaccaccttgggcgcatattctcagaatctcctgaggsctgtgtcatgggccatggtcactcatatttggctcagaataaatctcttcaaatatttaacagagtttgactcttttcatcaacatatccactgtggcagaaacctgttggtgtccccacctcaatccctggggatccctgctaccattttgtggtgcccattcccccaggagctgtgggtgctgctggtaatggtttgtacctacaaccccaggggactggacttggatgattagagccacctggacatgaagttcatgggagttatgtgctgctttaaccagtgactgtctatggtagggtacaaatgttctggtcccttgcctaagggcagacagattctgcttgcactttatgcttcagggctcccggtaggaataggctgagtctagacttcccctgaaaccattcttgctttccttcttcccctcccctggcctgcttccctccctcaccctcctagatttctacctagactactttcctaataaatcacttgcctacgaagctccaccagtctcagcttctagggaaatagactgaagacactcacgtatgcacaaaatgacatatacaagattatccattgyttcattcataatagaagactgttaacaagcaaatgttcatcactaggctcctggttaaataaagtacagctgccccaggaaggaaactaggggttcaggaatacggtgaaaagtaaactttcactgaacttttagttctttctgaatttttttttttttgagacagagtctcccccttgcccaggatggagtrcagtggcacgatctcggctcacygcaacctccgcctcctaggttcaagtgattctcctgcctcagcttcccgagtagctgggattacaggtgtgcatcgccacacccggctmatttttgtatttttagtatagatggagtttcaccatgttggccaggctggtctygaactcctgacttcaggtgatccgcctgccttggcctcccamagtgctgagattacaggtgtgagccaccgtgcctggcctctttctgaattttgaagcatttggatgtattgctttttttttttttgagacggagtctcgctctgtcaccaagctggagtacagtggcgagatctcggctcactgcaacttccacttcccgggttcaaacgattctcctgcctcagcctcccgagtagctgggactacaggcgtgcaccaccacgcccggctgatttttatatttttagtagagatggggtttcaccatgttggccaggctggtctcgaactcctgacttcagatgatctgcctgcctyggcctcccaaagtgctgggattacaggcatgggccaccatgcctggcctgcttattttttaaaaaaataaaattaatgttaaaataattaattaasgctgggcacagtggctcacacctgtaatcctagcactttaggaggccgaagcaggtggatcacttatgcccaggagttcgagaaccagactgggcaacatggtgaaacctcatctctacaaaaagtaaaaaaattaaccgggcatggtcgtgcatgcctgtgttcccagctacttgggaggctgaggtgggaggatcacttgagcctgggaggtcgaggctgcagtgagctatgattgtaccactgcactccagcctgggtgacagtgagattctgtttccaaaaaaaattaattaatcaaaaaatccactaaacaagtaaattggatacttaggtgaaaatcttaagtgtaggccgggtgcagtggctcacgcctgtaatcccagcactttgggaggccgaggcgggtggatcacaaggtcaagagatcgagaccatcctggctaacatggtgaaaacccgtctctactaaaaatataaaaaattaaccgggcgcrgtggcgggcgcctgtagtcccagctactccggaggctgaggcaggagaatagtgtgaacctgggaggcagagcttgcagtgagccgagatcgtgccactgcactccagcctgggcgacagagcgagactcagtctcaaaaaaaaaaaaaaagaaagaaaatcttaagtgtaagtacctaaacaatctattaaatgacctgtgaaaccaagggctcctaatgctatgaccaaagactgaagctctctatgagatgccagccactcaatagtgcactttttctgagaagatataagacagccactcagaattatgatgtaataattggtaatgtggggaagtaaataaatgtctcaaagttttgcttttgaaaaatgactagtaaatagtaataacaaaactgttatttatggagggatgagtctgtggcctatctctcttcccttttatgtctacgtttctcacagtcatctmcactccctgtcacttgtacttattcccttgacactgcaatctagcttcatccactccccyaaaatgactcttcccaacgctatcaatgacccctttgtctttccatccagtggctgtttttcaatcctcgtattccttaactctcagcagcattctgtgacatgatgctctcctggtgttctgcctgcatctctgctcatttctttttagactcctttgtcagtttatgctcttctgccagtctttttttgagacggagtttcgctcttagtccaggctggagtgcagtggcgcgatctcagctcactgcaacctcagcctcccggggtcaagcgattctcctgcctcagcctctccagtagctgcgcctgccaccaggcccagctaattcttttcttcttttttttttttttttgagacagagtctcgctctatcccccaggctggagtgcgtactctatcccctaggctggagtacagtgtcgcaatcttggctcactgcaacctccgccacccaggttcaagttattctcctgcctcagcctcctgagtagctgggattacaggcgtgtgccaccatgcctggctaattttttattttttatttttgaaatggagtcttcctctgttgcccgggctggagtgcagtggtgcgatctcggcctactgcaacctctgcctcctgggttccagtgattctcctgcctcagcctctcgagtagctgggactacaggtgtgcgccactgcgccaggctaatttttgtatttttagtagagacagggtttcaccatattggtcaggccagtctcaaacttctgactttaggtgatctgcccacctcagcctcccaaagtgctgggattacaggcgtgagccaccatgcccggccaatttttgtattttttaattagcaacggggtttcaccacgttggccaggttattaaccacatccatggctctgattaccacctgtggataaataygtccccagttctcctctgagctcctattttcctttttttttagagggtctcactctgtcacccaagctggagtgcaatggtgcgatcatggctcattgcagccttgacttccagtgctcaagccatcctcccacctcagcctccsaagtgtctgggactacaggcatgagccaccaagcaccagctaatttttgtatttttttgtagagaaggggttttgccatgttgcccagactggtctcaaactcccgagctcaagcratctactggcctcggcctcccagacagctgggattacaggcacaagccaccgtgcccagcctctgagctcctattttccttttattattattattattattattattattattattattattattattattttgagacggagtctcactctgtcacccaggctatagtgcagtggcacgatctcggctcctgggttcaagcctcctgggttcaagtcattctctagcctcagcctcccaagtagctggggctacaggcatgcaccaccatgcccggctagtttttctatttttagtagcgatggggttcaccatgttagccagactagtctcaaactcctgacctcatatgatccacccacctcggcctcccaaagtgctgggattacaggcgtgagccaccgygcccggcctgagcgcctatattcaactgcacatttaacatttccacttgaatatcccattgaatggcaccaacattcatccaatttctcctttcaggagcttggggaccatctttctcttttagtattcatatctaacaaatcaccaagttccatcaattttatcatttaagtatctttctaatctgttcatttccttccatctatactgtcaccaccctcattttaactaccttatagtttctcacctgattagtccaaaagccttttaacttcctttctgctttcaatcttgttttttctctattgcattcctcacactgcacccagaataatctttttaaaatgtaatgtcacactcccttcagtaaaatcttgcctttgattttcagtgcatttcaaatgaagtccaaagttctcaccatgaactccagtgctgtgtgatctggcctttgcctgcctctcccattttgtttcacagccctctccctttggctccctctaggttccttcctcagcagtggttctttattgtctcagggcatctgcttttgttgtttcacagttgttaacattcttctttctgctttcatgtatttggccttttctcagtgttcaagtcttggatcaaatgtcacttcctcagaaagccctctccaggccgggcacagtggctcacacctgtaatcccaacaatttagaagaccatggtgggaggatcacttgagcccaggagttcaagaccagcctgcgcaacatggtgaaactccacctttacaaacaattgtttaaaattagctggatgtagtagcgtgcacctgtagtctcagctactcaggaggctgaggtgggaggattgcctgagaggttgaggctgcagtgagctaggattgyaccactgcacttcagcctgggtgacagagcaagaccctgtttcaaagaacaaaatgcatcttattcttggtacttgtaatttgtaaacacattcatttacacatgcacatacgtctatataattacatattaaatatgtaattatgtattcacgtgtttattgtccatctccaacacccacctctatcccaaatgtcaactccatagaggcagggaccttattagtcttgttyaccagtgtattccttttagctagaataatgcctagcacacagcaagaaaagtaagaaaaatgatgtggggaatcttttaacaaatgattattcattcakagattccccacatcatttttctttcttttttgccctctagttacattggctttgaattcttttttctttttttttgagacttagtctggctctgtcgcccaggctggagtgcagtagcgccatctcggctcactgcaatctccgcatcccgggttcaagcgattctcttgcctcagcctcctgagtagctgggattacaggcgcccgccaccatgcctggctaannnnnnnnnnnnnnnnnnnntttcaccgtgttagccagggatgtcttgatctcctgaccttgtgatccaccagcctcggcctcccaaagtgctgggatcacaggtgtgagccaccgtgtctggcctcagctgaacattttttaagaattcaaagctggccaggtgcggtggctcacacctgtaatcccagcactttggaaggctgaggcgggtggatcacaaggtcaagagattgagacaatcctggccaacacggtgaaaccccgtctctactaaaaatataaaaattagctgggcgtggtggcatgcgcctgtagtcccagctacctgggaggcggaggcaggagatcgcttgaacccaggagacagaggttgcagtgagccgagatcttgccactgcactccaacctggcaacagagcaagactccgtctcagaaaaaaaagttcagctggtgctgtggcttatgtctgtaatcccagcattttgggagggtgaagcaggaggctcacttgagtccaggagttcaagacaagcctgggcaacatagtgagagctccatctctacaaaaaaatacaaaaatagctggacatgatggagaacgcctgtggtcccagctactcaggaggttgaggtaggaggattgcttgagcccaggagtttaaggctccagctgaccatgattgcaccactgccctccagcctggacaacagaatgagaccctgtctcaaaaaaaaaaaagaaaraaaaagttatgtaactttctccctcatttccttagaatatgctatttgctctgcctgataagctccctgccaccacatatttagttaatgactacctgctttctaggtctcagtgtaaatgctactgctttagcgttgctactcctgacattctagacaaggtgaggtcactgttatataatcccctaaaacctatcttttcccttcagaacacttatgatttgtaattatttttatttatttttgtttggctgggttttttgtttgtttgtaattatattttcttgttggtctgtttgctctagaccagagatcagcaaactccagcccatgggccaagtccagcctaccacttgttttataaataaagtttttggaatacagtaaaatgcattcatttatgtattgcccatttggctcctaaaatatttaccgtctgctttttttttttttttgagatggaatttcgctctttttgcccaggctggagtgcagtggtgcagtctcagctcactgcaacctccgcctcctgggttcaagtgattctcatgcctcagcctcctgaatagctgagattacagatatgcaccaccacgcccagctaatgtttgtatttttagtagacatggggctttgctatgttggccaggttggtcttgaactgctgacctcaggtgatctgcckgcctcagcctcccaaagtgctgggattacaggcgtgagccacggtgcccagccaccatctgctctttacagaaaaagtttgctcacctctactctagactagagtataatctctattaggacaaagatgatctcttcctacacactactaaaatttaaagaatttccgtaaaaactagtgaaataaaataaatggtaatcgctctgctaagtactttayatgtattacccacatcaattttatgakaaaaatattattatctacaatctacacrtgaggaaactgaggctcagagccatctggtgagttgccctaaggtcacacagctgataagtagcaaactgatgtttgaatytaagtttaaaacaatgtttcttctttaaattttttttttttttttgagacagagtcttgctcttgtcgcccaggrtggagtgcaggcgtgagccaccacacccggcccttctttaaatttttaaatgtaattaattgatactacaactagtcagtgaaagtttgataaggagcatcttatcataacacaattaattacyactaattaattamaaaagaaaaatagtaatgtgacagtgaaaacagttaatcaaagttaataccaccaataatggggcaagctgacatcattttctcctgctgtactgcaatgagatggtcataatagctcttatatagttttttgccaaaaatgcaaaatctgaatctaatcacaaggaaatatcyaacaaagccaaattgagggacatgttacaaaattcaaaacatcacataatccaaaagacaaaattttaaactgtcaacatcatgaaagacaaagaaaaactaaggaattgttrcagattgagaccaaagagacatgacaactaaatgtactgtgtgaacctagattggatcccagaccagagaatcttctttttctataaagaacattattgggactattgtgaatcggtgttacaagttgtgggtaattaaatatagctacagggagctgggcaaggtggctcacgtctgtaatcccaacactttgggtggccgaggtgggcaggtcacctaaggacaggagtttgagaccagcctggtcaacatggtgaaaccccgtctctactaaaaatacaaaagttagctaggcatggtggcgggctaatcccagcttgggaggctgaggtgggagaatcgcttgaacccaggaggtggaggttgcagtgagctgagatcaygccactgcactccagcctgggcaacagagtaagactctgtcgcataagtaaataaataaagctacagattatttgtatcccctcctgaaaagaggtgaagtctatttacccacctcttgaatcttgggctggtcttgtgactttgaccaataaaatggagaagtgatgacttctgaatttcattttgaaaaggtctyctggcttctgctcttgctcttagaattctgccctgagactattgtataaagaagctcagtatagcgtattaaagatgaggccacrgcctgaagtatacaagttgatagcaccaagtgctacgtatgtaaacaaaagaccatcttagagagatgacaagtcaagtggttccagggragatcagcagaagcaccactcagctgattccagtccaaatttcaacccacagaaatatgaacaataaacagatgccattataggctactaattttagaggtgatttgttttttttgtttttttgtttttttttgttttgttttgtttttgagatggtgtcactctgtcgcccaggctggagtgcagtggcgcgatctcgtctcactgcaacctccatctcctgggttcaagcaattctctgcctcagcctcctgggtagctgagattacaggcatccgccaccaggcccagctaatttttttttatatttttagtagagacagggtttcaccatgttggccaggctggtcttgaactcctgaccctgtgatccacctgccacggcctcccaaagtgttgggattacaggcatgagccactgcacccggctagaggtgatttgttatacaacaaaggctaactgaaacagacatatcttgagatcatttggctacttgggcaagggctcagaggtgaaaatgttaagarttatcaacttatagtctggtccccagttctcaggcgtgaaaattcaaaattgtgaatgaatccagaattgatgagattccatgaataccaggataaccaaagaattcatgataaccaaactcataagaaactatgtaagccaggatatctaccagaaaaatttatagtgaaaattacatatatttttcatgttctctttttggtaactggtaagtatcttttttttttttttttttttttttgagacagagtctcactccatcacccaggctggagtgcagtggcgtgatcttggtggttcactgcaaccttcacctcttgggctcaagccattctcctgcctcagcctcccgaatagctgggattacaggtgcccgccaccacacccagctaattttggtatttttagtagaggcgggttttcaccatgttggccaggctggtctcgaactcctgacctcaagtgatccacccacctcaacctcccaaagtgttgggattacaagtgtgagctgctgtgcctgtccagtaactggtaagtattgacagaatcagtttacttaaaggagagtgaaactggaataacaggagttatatagttttaagagatactttatccaaactgaaataaaccattcttatcccacaatagtatataactatggaacaactagagtatttgtgtccactatagtaaatttctctggactctgaatagtgagagctaatcagtgcaaaatcttgctctctggctgkcctttacttatctcttctgacctttgttttgattgcaaactttctttggacagtataaaaatcagtattttaggattagaacccaatcaatatattgagttcagttacattctagttctttctgcctgatattacactccaattgccttaatggatcttgagtgcttccagatattcttattaaatatttgtcatttttcttttggctttgttaattgtgacttatgccatgcataattttttgcttagtagtcaaatttatcattctaaaacaatctcttctgtgttttgcattatacttggaaggtcaaggaccttagagacatacytctggctattggatgtagactttctttcttttttttttttttttttttttgagtcagtgttttgctctgtcctcaagcctcgagygcagtggtacaatcacagctcactgctgcctccaccttcagggctcaagcaatcctcccacctcagyctcctgagtagctgagactatgcccagctaattttttattttttgtagagatggggtctcactatgtaacccaggcttgtcttaaactcctgggctcaagggatccttttgcctcaacctcccaaagtgctgggattacaggtgtgagccaccacacctggctgcaaataractttcaataaaaaaaactttcattccaggatcatcagtgcaggagtaagctagttgacctggtaacaaaacacatgacctcaataataaacaggaactcctaaagacaataagaggtaagatcttaggaaaaaaaaaaaaagttttcctcattcttgacctgtgaaacaatttcctggcttatattagaaacaatcattttgccagttcttgttttgtttcattttggcagggtctggtgctggtgctctcttctatgtaataaggtgccggatacgtacctacttacaagaaagattatttgtgtcttcaaagcaggtttacttttgttcataaagcaaaataaaatagcatactagtcatctgctacttattttaatttatggttgtttgtgtttacacaagaaagagggccttttgtgaaaagtaaatgatttacatatcagagataattaagataaccctatrcctctgatgagcaacctcacattttaaccatcttgctataaatmtatatagatcaactgaaatttatacaccttagtcacacccaaatttattatctttaacttcaagatcgattatctcctgtcacatcaaagtaaaattgtctgttacagaaatatatatgtgagcatgcaactgcrtaaaaataaggcagcttttagtgtattttgtgcatattgccataaatttgtacagastgacattctaatgatatttcttttattttcagatttataaatatgtgattacatattgtggaaaaataatgctataggctctgtatttcagttattattatatcttattcattctttactgcatttatgccagtaaaattgatctcacaggcctgctttttgcttataatgctaactaatgaaaatccagagcttggcttatcaatgtgagcctttgtaattaacagaagtcttggaaataaataaaggatatgctcctctcccctatagcacagagaggaggatgtctttctgagatataacacatattcaaaatatctgattttgtaaagtgtcaaatggtygatattgacaaaaatatcaatcttttttctcttttgtgcaatatggagagtggtgtgaatcttcggtttcttattrtaagtcwttttctttgaaaaaagagttttataaaactaagacttagaaacttacttgccctggccttgaaaattacctttggaaaaatgcttgtgctttatgggtcctgagaatatactacttttgagatttgtcaggacgcatttggctgagtaacaggttattctcatggctaaaagcctattacagcaaaggatattatacaggatcagcagaaaaaagttatgcctacaagaagacccgaaagattaggtgcagacttctaggttctccctccatgctggtcacagtaaggtgcttttggcacgactacaaattatacgaacatatatgagatgtctctgcccacgtaagtccacttaggtctgaggwcccggagttcttacaggagtctggttgcacaaggcacattcctcccacgtgacaatctatggtgcagatctttacccaggaggcaggtgctcatggcacatcttgatatttgtgttaggcagtgctggcaattgagcatgtcatgcctcagtgcctcaggagcacaaaacaacttcattggtgactatgttaactccaaggacttagccccaagtggttggctaagggttggtaccgtgactccaggtactcctggaaataagctgagtgaactcctttctcatagattataattctgattggtagctttacttgataatttgttgccctgatagtaatgttgtaattgacatttctgcatgtgtaaataggataaattcttgaaagattrctctgcaaatctgatcatttgtttctcatctcttttttttatattttattttattttatttatttattttttttttgagacagatcttgctctgtcacccaggatggagtgcagtggttgttcgctgcaacctccacttcctgagttcaagcgattcttgtgcctcaccttcccaagtagctgggattacaggcacgggccaccatgcccggctaatttttgtgtttttagtaaagatgagaattcaccatattggccagggtgatctcagactccaggcctcaggtgatctgcccaactctccacctcacaaagtactgggattacaggtgtcagccaccacatctggactgttcctcttttcttttgtgtataatggggttgggtggggtggtagggagaaaagtctgactttgctagatttcttattttaacaaagaatctgtgagtcttttctaggtaaaattaacaactagcaaggggttctagcagagtgtaatttcaaaatactctattatgcttgtaaaataaactattcacaatacatagtgtrgtataataataacagatgtttttgtcagcctaaaaataatgagttgaaggttctaacggttgcctttatagaaaataacatctttggccrggcgcggtggctcacgcctgtaatcccagcactttgggaggccgaggcaggcggatagcctaaagtcaggagtttgagaccagcctggccaacatggtgaaaccctgtctctactaaaaatacaaaaattagttgggcgtggtggcaggtgcctgtaatcccagctactggggaagctgaggcaggagaatcgcttgaacccgggaagcggaggttgcagtgagccragatcacaccattgcactctagcctgggcaacaagagcaaaactcygtctcaaaaaaaaagcaagtaacatctttgtccaggcgcggtggctcacgcctgtaaccccagcactttgggaggccgaggtgggcagatcatttgaggtcagaagttygagaccagcctgaccaacatggtgaaaccctgtctctactaaaaatacaaaaaaaattagcctggtgtggtggcacatgcytgtagtcccagctacttcggatgctgaggcaggagaatctcttgaacccgggaggtggaggttgcagtaagtggagatcgtgccactgcatyccaacctgggtgacacagtgagactctgtctcaaataaataaataaataataacatcttcactgagatacaggtatacttcagagataagcccatatatcaggaatatcaggttttgtgatatcaggttttgttctagaccactgchataaagtgaatattgtgataaagcaagtcacacaaattttttggtttcccagtgcatgtaaaagttatgcttacactatactgtaacctactagrtatgcaataacattatgtcataaatgtgcaacataaatacactaattataaaatactttattgctgaaaaaatgctaacaatcatctgagccttaattgagttgtcatcttgtgtcatcagcaaaaagctggtggagagtcttgcctcaacatggatgacttctgactgatctgagtggtggttgctgaaggctggagtggatgtggcaacttcttcaaatcagacaacaaaaaagtttgcygcattgatggactcatttttaaaatattttattttatttcaatagttcttggggaacaggtggttttgcttacatggatactttctttagtggtgatttctgagattttggtgcaactgtcacttgagcattgtacacggtgcccgatctatagtcttttatccytcactcccctcccaccttttcctgagtctccaaagtccaaagtctattgtatcattcttatgcttttgcatcctcatagcttagctcccatttataagtgagaacatacaatatttcgttttccattcctaaattacttcacttagaataatggcctcccrctccatccaagttgctgcaaatgccattatttygttcccttttatggttgagtagtattccatggtgcatatataccacattttctttatccagtcattgattgatgggcacttaggttggttccatatctttgcgattgtgaattgtgctgctgtaaccatgcacatgcaggtgtctttttcatataatgacttcttttcctttgggtagatacccagtagtgggattgctagatggaatggtagttctatttttagttctttaagkaatctctacactgttttctgtagtggtaaatgcgtttgcatttactttacactcccatcagcagtgtagaagtgttcccttttcaccacatccatgccaacatctattagtttttgattttttaattatgggcattcttgcaggagtaagctggtatctcattgtggttttaatttgcatttccctgataattagtgatgttgagcattttttcatatgtttgttggccatttgtatatttcttttgagaattgtctgttcatgtctttttccctcttttggatggtgttatttggttttttcttgctgatttatttgagttacttgtagattctcaatactagtcctttgttggatgcatagtttgtgaataatttctcccactctgtgggttgtctgtttactctgttaattctttcttttgctgtgcagagcttttttgtttaattaggtcccatctaattatttttgtttttgttgcatttgcttttgggttcttggtcatgaactctttgcctaaaccaatgtctacaagagtttttctgatattatcttctagggcatttttatggtttcgggagttagatttaagtctgtgatccatcttaagttgatttttgtgtaagatgagagatgaggatccagtttcattcttctacatgtggcttgccaattatcccagcaccatttgttgaataggatgtccattccccactttatgtttttgtttgctttgtcgaagatcaaatagctgtaagtatttggctttatgtctgggttctctattctgttccactggtcctatgttcctatcttcttcataccagtaccatgctgttttggtaaccacaggcttggagtatagcttgaagttgggtaatgtgatgcctccagatttattccttttatgtagtattgctttggctatgcgggctctttttcggttccatatgaattttagaattttttttctagttctttctttttttgagacggagtctcgctctgttacccaggctggagtgcagtggcgcaatctcggctcactgcaagctccgcctcccgggttcacgccattctcctgcctcagcctcccaagtagctgggactacaggcgcccgccaccacgcccggctaattttttgtatttttagtagaggcggggtttcactgtgttagccaggatggtctcgatctcctgacctcatgatctgcccacctctgcctcccaaagtgctgggattacaggcgtgagccaccgcgcccagctttttttctagttmtgtgaagaatgatgatggtattttgatggaaattgcattgaatctgcagattgcttttggcagtatgttcattttcgcaatattgattctactgatccatgagcatgggatatgtttccatttgtttgtgtcatctattatttctttcagcatgttttgtttatgttatttctttcagcatgttatttctttcagcatattccttgcagaggcctttcacctgctttggtaagtatattcttaagtattttgtggcttttttggttttgttttgttttgttttgcttttgttgttttgttttgttttttccagcaatgttgcaaaagagattgagttcttgatttgattctcagcttggttgctgttggtgtatagcagtgctacggatttgcgtacagtgattttgtattctgaaactttactgaacagggacagtttgacttccactttattgatttggatgccctttgtttctttttcttgtctgattgctctggctaggacttccagtactatgttgaatagaagtaataaaagtgggcatccttgtcttgttccagttctcagagagaatgctttcaacttttccccaatcagtataatgctggctgtggtggactcttcctttcacaaaagatttctctaggatgttatgctgtttgatagcattttactcatagtagaacttctttcaaaattgtaataaatccttttaaaggtgctttatcaactaaatttatggaatattctaaatccttcattatcatttcaacaatatccacagcatcttcaccaggaatatattccctctyaagaaaccactttctttgctcatccataaaaagcaactcttcatccattaaagctttttttagcatgtgattgaagcaattcagtcacatctttaggccccacttataattccagttctcttgctatttccactacatcttcagttacttcttctactgaactcttgaactcttcaaagtcatccatgaagattaaaatcaatttcttccaaactccagttcatgttcatattttgacctacttacatgaatcaaatggcacctaaaatggtgaatcctttccaaaaggttttcaatccactttgcccagattcatcagaggaatcactatctgtagcagccatcgtcttacaaaatgtatctcttagataagaaggcttgaaagtcagaattgccccttaattcatgggctgctaagtggatatgttaggatgcatgaaaacaacattaaccttcttgtacatctccatcagagctcttgggtgaccaggaacattgtccatgagtagtaatattttgaaaggaagstttttttttggagcagtaggtctcaacagtgggattaaaatattcggtcaattggccaggtgtggtggttcatgcctgtaatcccagcacttaggaggctgaggcaggtggattkgttgagctcaggagttcaagaccagcctgggcaacatggcaaaaccctgactctaccaaaaatataaaaaaattagccaggcatggtggtatgcacctgtagtcccagctactcaggtggctgaggtgggaggctcacttgagcccagtaggtagaggttgcagtaagccaagatcagaccactgcactacagcctgaatgacagagggaaaccctgtctcaaaaaataataataataatagtaattcagtaaatcatgctgtaaacagatgtgctgtcattcagacttttttgttacaattatagagcaatagagtagatttagcataattcttttttttttttttttctgagatgtagtgtcactctactgccaaggctggagtgcagtgccacaatctcagctcactgcatcctctgcctcctgggttcaagcagttcccctgcttcagcctccctagtagctaggattatgggtgtgcaccaccacacccggctaatttttatatttttagcagagacagggtctcaccatgttggccaggctggtctcaaactcctgacctcaagtgatctgcctgccacagccttccgaagtgctgagattataggcgtgagccaccgcgactggcccaacttagcataattcttacgagccctaggattttcagaatggtcagtgagcactggctccaacttaaagtcattggttgcattagtccctaacaagagtcagcctgggccaggcacagtggctcacacctgtagatagtgtggagttatgcagacgactttacagataagttactcaacaactaaagagatgagaggagtttcctataaaaacttttaaaaaatcaggccgggcatggtgcctcacgcctgtaatcccagcactttgggaggccgaggtgggtggatcacctgaggtcaggagtttgagaccagcttgaccaacaaggtgaaaccccatctctactaaaaatacaaaagttagccgggcatggtggcaggcacctgtagtcccagctactcgggaggctgggacagaagaattgcttgaacctgggaggtggaggttgcagtgagccaagatcatgccactgcattccagcctgggtgacagaacaagactccatctccaaaacaaacaaacaaacaaaaaacacacaaaaaaacttctggccgggtgcggtggttcatgcctgtaatcccagcactttgggaggccaaggtgggtggatcacctgaggtcaggagtttgaggccagcctggccaacaaagtgaaaccctatctctactaaaaaatacaaaaattagccaggtgtggtggcaggtgcctgtaatcccgctacttgggaggctgaggcaggagaattgcttgaatccgggaggtggaggttgcagtgagccaagatcgcaccattgcactctagcctgggggacgagagcaagacttcatctcaaaaaacaaacaaacaaacaaacaaacaaacaamccaaaaaccttttaaattaaactgtaaaaacggcagcccacttgggctcccctctccactatagatagctttcttctttcatttattaaactttcactccaacctcacgctttgcatccacattccttaatttgcatggtcataagacaaagaactcctggtgatactacacaacaagagactactacattatggtatattgatgagactgtagcagtatttagagagatccaacatatatttcaagtcttttttcatctgaagtcacacaggatgtattttctctctagaaatgaacatatgtgaaatgtctctgctcagggaagcccattcaggtttcagagtctaaggcttttatcagggaccaatcacaaagacatatcctgttatgcgattagccatagcaaccaaaactcaggatcacaacaatgagaccaggggtacatcatcaatctcaatgtttgtgcaaagcaaattagcaagccagyatggcatggtacattgctccaagtgtacacaacaaaatcatcaattagtgacataaagaacatcctaagaacatttccgagggtttgccaagggtcaatcatgattccaggctcccttggaggtgtaaggactgagcaactagacctacttgctatgtagatttatctcagaaatggcctcttaaagagaattctcatcattctagwacctcatttgtcaacaggatttatacactaaaattcaatcttcctaaagaattgagaacaaatttaataaggagtaaactcagattgcaaagataattgtaaagaagttaatggaggaagtcctagccagagcaatcagacaagagaaagaaataaagggtacccaaattggaaaagagggagtcagactgttactattcactcattatatgattgtatacctagaaaaccctaaagactcatccaaaaagctcctagatctgataaatgaattcagtaaagtttcaggctacaaaatccatgtacacaaatcagtaccacagctatacaccaacagcgaccaaactgagaatcaaatcaagaactcaatcccttttacaacagctgcaaaaaatatatacataaaataaaatacttaggaatatacttaaccaaggaggtgaaagacctctgcaaggaaaactacacaacactgctgaaagaaatcataggctgggtgtggtggctcacacctgtaatcctagcactttgggaggccaaggcagatggatcacctgaggtcaggagttcaagtcaagcctggccaacatcacgaaaccccgtctctactaaaaatacaaaaagtagctgggcatggtggcacatgccaataatcccagctactcgggaggctgaggtaggagaattgcttgaacccgggaggtggaggttgcagtgagccaagattgtgccactgcagtccagccagggagacagagtgagactctgtctcaaaaacaaacaaacaaacaaacaaacaaaaaagaatcatagatgacagaaacaaatagaaacacatcccatgctcatggatcagtagaatcaatattgcaaaaatgaacttactgccaaaagcaatctacagattcaatgcaattcccatcaaaatactgccatcattcttcacagaactagaaaaaaagatcctaaaattcatatggaaccaaaaaagagcccacatagccaaagcaatacaacataaaaagaataaacctggaggcatcacattacccaacttcaagctatgtgccaagcctgtggttaccaaaacagcatggtactggtatgaagataggaacataggaccaatggaacagaatagagaacccagacataaagccaaatactaacagccagttgatctttgacaaagcaaacaaaaacataaagtggggaaaggacaccctattcaaccaatggtgctgatataattggcaagccacatgtagaagaatgaaactggatcctcatctctctccttacacaaaaatcaactcaagatggattaaagacttaaatctggctggtgcggtggctcacacctgtaatcccagcactttgggaggccgaggcagggggatagcctgaagtcaggagtttgagaccagcctggccaatatggtgaaaccccgtctctactaaaaatacaaaaattagttgggcgtggtggcaggtgcctgtaatcccagctactggggaagctgaggcaggagaatcgcttgaacccgggaggcagaggttgcagtgagccaagatcacgccactgcactccagcctksggacagagtgagactgtcaaaaacaaaaacaaaaacaaacaaaaaaaaaccacttaaatctaagacctgaaagcacaaaaatgctagaagaggccaggcacagtggctcatgcttgtaatcccagcactttgggaggctgaggcgggtggatcacgaggtcaagatttcaagactagcctggccaagatggtgcaatcctgtctctgctaaaaatacaaaaattagccggtcccagtggcaggtgtttgtaatgccagctactcaggaggctgaggcaggagaatcacttgaactcagggggcagaggttgtagtgagccgagatcgtgccactgcactcaagcctgggcaacagagttagactctgtttcaaaaaaaaaaaaaaagtgctagaagataccatcaggaaaactcttctagacattggtttaggcaaagagttcatgaccaagaacccaaaagcaaatgcaacaaaaacaaaaataaatagatgaagcctaattaaacaaaaaagctctgcacagcaaaagaaagaattaacaaagtaaatagacaacccacagagtgggagaaaatattcacaaactatgcatcccacaaaggactagtattgagaatctacaagtaactcaaataaatcagcaagaaaaaaccaaataaccccatccaaaagagggaaaaagacatgaatagacaattctcaaaagaaatatacaaatggccaacaaacatatgaaaaaatgctcaacatcactaattatcagggaaatgcaaattaaaaccacaataagataccagcttattcctgcaagaatgcccataattaaaaatcaaaaactaatagatgctggcatggatgtggtgaaaagggaacacttctacactgctgacgggagtgtaaagtagtacaaccactatggaaaacagtatggcgattccttaacgaattaaaagtagaactaccattccatctagcaatcccactactgggtatctacccaaaggaaaagaagtcattatatgaaaaagacacctgcatgtgcatggttacagcagcacaattcacaattgcaaagatatggaaccaacctaagtgcccatcaaccaacgactggataaagaaaatgtggtatatatgcaccttggaatactactcaaccataaaaaggaatgaaataayggcatttgcagcaactggatggagtgggaggccctaagtgaagtaacttaggaatggaaaaccaaatattgtgtgttctcacttacaaatgggagctaagctatgaagaagcaaaagtacgagaatgataaaatggacattggactttagggactcaggggaaaaggtgggaggggactgagggatgaaagactacacattgggcacagtgtacactgctcaggtgatagttgcactgatatctcagaaatcaccattaaagaacttatccatgtaaccaaaaaccacctgttcccccaaaagctattgaaataaaagaaaaaaagaagaagtggctgggcatggtggctcatgcctataatcctagcactttgggaggccaaggcaggcagatcacttaaggccaagagtctgagaccagcccagccaacatggggaaacccgtctctactaaaaaaaaaaaaaaaaattagcagggtatggtggcgcatgcctgtaatcccagctagttgggaggctgaggcacgagaatcgcttaatcctgggagscagaggttgcagtgagccaataacktgctgctgcactcttacctgggcaacagagtgagattctgtctcaaaaaaaaaagaagtgaatggcatcaatcgtgaaaggtatcacataaatatgaaaggttacacaactcttttaacctatttgcctagaaaagagtggtaagtagggcttattgagttgttttattttattttactttttattattcatttgtgtattaatttattctttggtgacagagtctcattctgttgccaaggctgcagtgcagtgacatgatctggcctcctaggatcaaacaattcttatgcctyagcttcccaagtagctgggattacaggcgtgtgccaccacgctcggctaattctttttgtatttttaatagagatagggtttcaccatgtcgaccaaactggtctgaaacccctgacgtcaagtgatccgcccatctctgcctcccaaagtgctgggattataggcatcagccaccacgttcagctaatttttacatttttagtagagagggggtttcaccgtgttggtcaggcttgtctcgaattcctggcctcaagtgatccgctggcctcagcctcccgaagtgctgggattacaggcataatttaccgtgctcagccattgtcatttattttgaatttgggagaagatatcacacccatttctatgttctggagcaggaagtctatcttctggagcagcattgcagtctaaatcactccttagttcagctacatccgagttcttatcccaggaccaagaagaataaggaacacagacaccacagagtaagtagagtaggatttattaagcaaaaggaaagctctcagcaaagagaggtgccctgaaagcaagttttcagaaatggggctgagttctgggtcttttatgtggaagaggaaggaaggaagtcttctgtgggttctgcccaaaatgggaggggtaaagttccctcctaagggtgttgcatctgcacatgcctgggattggccagagtgactccatcttggttgttacccacgagtgcctaagtgaaacccaccaaggggctaaaaccacaaaaatgtcatgttaatgacactatgatgakctgggccaaggacacttaggttgatttattccgcctgtgcctaagttaggacagtcccttctgagcaacatcctggcataaggggaagttcttaaccacatttcttcccattagctgcagaggcggtgtaggtackgtcctgctagcgttcttgtgaacactgcccttctccagagaccctccctctctatctgcctaaccagcctctaactgccttctctctcagcaggaagtctatcttctatcttgggatgacttgaaagataacccaataggagcccagaacctaggcatccaagaataagagaaacgaacatgtgtcagatggagaaaacagaaactatggacatcaaaaggctaaattagggccagatatcaaggtcacactggtgcttttaggaaagtgaagtgtaaacagctgagagtagaactacaatgtagatgaggaagcaaaaatgcttagtatagggaaagcgcagaggcagaaaggaaaatagaacccacaagaattgtattttttcttcttccttcttctttcctatttctcaataaatacttacagaatacctataaggcttcattaagtatgtaagcactaagaatatttaatatgtgtcatgaagagtgatcttcaagtaaacatgactcacatgcatctggtgatcttcctaacctgtgtaaaacccttccatttgttgaatttggcaccaaaggctcttaaaggccatttgttgggaatgtgtggataataggctgacttacatctgtaytggaaaaactctatctttgcctttggagaattatggacgtttggttttttacctttagcggatagaagggcagcaagatttgtcatgtgctgtttaaaatctgaatctgggccaagcgcagtcactcacacctgtaatcgcagcactttgggaggccgaggcaggtagatcacctgccaggcctctgtccaggtcaggaatttgagaccagcctggccaacatggtgaaaccctgtctccactaaaaatacaaaacctagccaggcgttgtggtgcacgcttgtaatcctagttactcgggaggctgaggcaggagaatcgcttgaatccaggaggcgaaggttgcagtgagctgagatggcaccactgcactccggcctgggtgatagagtgagacaccatctcaaaaaaaataaataaataaaataaataaaaataaaaactgaatctgggaaaccccagggtcaatttctttactgatggttttaacaagttagatcacctgacttgattatgtggccaaagggacagaaaacccagctggaaacttctgctttaccgctgtgcgtgcgcgcacatgtgtgtgtgtgtgtgtgtgtgtgtgtkttttctcttttccccctacactacacagaagtaagttagcctctcctgaagccaagtttccttgcacttgataggtcaatctggtgatgaagtcgcatcccaccataaygaccctggggaatttgtgtttattgttgttttaagctactatgttattggctaatttattttttttatttttatttatttatttatttatttgagacagagtctctctctgtcaccaagccagagtttagtggtgcaatctcagctcactgcaatatccacctcccgggttcaaacgattctcctgcctcagcctcccaagtagttgggattacaggcgcatgcccagctaatttttgtatttttagcagagatagagttttatcatgttgaccaggatggtcttgatctcctgacctcgtgatctgcccacctcggcctctcaaagtgctgggattacaggtgggagccactgtgcctggctgttctgggctaattttctatgcagcaatagatagatagctaattaatcaaggtatgaatctgggtatctggatgaaataaggctgaatagtacctttattttgtgtttcagagagtttgtacagcccctcacccctgcaccctacacaacataaaagttttgggatgggtgagaagtctgccttattttgtatgctaggagaagggggactggaatactagcagaccatagacacattcccaggtaggtcaattttacggagtgcaaatggaagctgagactcagaaattggtcctttcaagctgttcctgcccatgtacatcatagaaattcttcaagttcccccaagggtacacatcgcaatttgaccaccattggagaggaggtgctatgccattttgggaaatgctttaaacaggaaacagtgcatgtgattaaataaaccctattcagaaaggttccagtagattcagtttctgcttcttaggctacactcaacacggaaagccatcagaaactagggtcaaggctcaggcaggtctccttgggacaatagaacacatcatgcattggccctgcctcctgcctttgaagtttctcttccctgagaggtrgaagacgggtgtcagattgcatggttcgttttagagarcgttattttttctagaataacttcctggtagtgtgtagrttgtgtgacagagaacttctaattgtttctctcttcctcatacacatttaccaaacacagaacatcttgtccttcacacatttcacatggcaattctggatacatttagtcaacataggacatttcaagacatgattctacaatggctatttcaccagtgcataatcacatttttttaatcttcttttttttttttttttttttttgagactgagtctcgctctgttgcccaggctggagtacagtcactccatctctgctcactgcaacctctgcctcccagattcaagtgattctcatgcctcagcctcctgagtagctgggattacaggcatgcaccaccatatccagctaatttttgtatttttagtagagagagggtttcaccatgttggccaggctrgtctccaactcctgacctcaggtgatctgcccacctcagcctccgaaggtgctaatagctgactttttatttattttttgagatggaatctcactctgtcaccagtgcagtggtgcaatcttggctcactrcaacctctgcctcccaggttcaaatgattctcctgcctcagcctcccgagtagctgggactacaggcgcccgccagcacgcccagctaattttttgtacttttagtagagacggggtttcacgatgttggccaggatggtctggatctcttgacctcgtgatccgcctgccttggcctcccaaattgctgggattacaggcgtgagccactgcgcctggccaatagctgactcttaataaaggacgaagatagcactccttctcagctgtctgcagttctttatatwttggttaactctcatggcttcaattaccacctgtgcatctataacaagatgccaaaagtggctgcttctgttgaatcaaaatcaaggactaacgtcaaaagccgaggcaaagaagaaccaagaaagatatgttttaaagagagccacccatcactggagctagattctacccctgggtttactaacgaacagcagaatgagccttattcatggcagctttcaccctatcctcaactcccgtctatagaaaagaggctggggagaagtggagcagacagaggaaatgagagttgcccttggccatgtggtatttctttccttcacaaaactaagtgagggtggccagacgcggtggctcacacctgtaatcccagctctttgagagaccaaggtgggcagatcatttcaggccaggagttcaagaccagcctggccaagatgatgaaaccccgtctctactaaaaatacaaaaaaattagctgggcatagtggcacatacctgtaatctcagctactcgggaggctgaggcagaattgcttgaacccaggagacggagcttgcagtgagtcgagatctcaccactgcagtccatccagcctggactacacagcaagactccgtctcaaaggaaaaaaaaaaaccaaaaaacaaaaaactaagtgagggagaagcctccagtagaaacgctgagagagactgggggtgcctgcaacaagtagacaggcatttcttttttttttttggagacagagtctcactctgttgtccaggctggaatgcagtggcgcgaccttggctcactgcaagctccacctcccgggttcacgccattctcctgcctcagcctcccgagtagctgggactacaggcacccgccaccacgcctggctaatttttttttttttttttgtatttttagtagagacggggtttcactgtgttagccaggatggtctcaatctcctgaccttgtggtccacccgccttggcctcccaaagtgctgggattacaggcgtgagccaccacgcctggctgcatttcttttcttttttttttttttttgagacagagtcttgctctttcacacaggctggagtgcaggtgcagtggcacgatctcggttcacagcaacctgcagcctccgcctcccgcgttcaagtgattcttctgcctctgcctcagcctcctgagtggctgggattacaagcgcccgccaccacgcccagctaattttttgtatttttagtacagacggggtttcatcatgttggccaggctggtctcgaactcctgagctcaagtgatccaccccccacccctcagcctcccaaagtgctgggattacaggcgtgagctgccacgcccggccagacaggcatttcttgcctcaactgaaccttggcttcgagatggcagcacaagagagagggcaaccttggagtagttgctgctgcttgctggttgggtggcagggatacacatgttttcttggaccttagctggccccaagacatagttggtcaggtaagggaactccagcagtaagagtcagaggctaggcagggtgtgggtggggtggaatgggagtcaagaaaatgaaagccagatttcacctcagtgtggtagaggaaataatgaagttgactctatccccgcctcctgaccgccacctcttttggttcctcaagctgtagctctaagcaaggaatgaaggatagtgtcttagtccattcaggctgctataacaaaacatcataaacagggtagcttgtaaacaacagaaatttgttcctcacaattctccagaaaagttgaagatcaaggcaccagcagattctgtctggtgagggcccactccctggtccacgaaccctcatgtggcagaaaaggccagggtctctctgaggcctctttcataagggcacaaatcccatccatgagtgccccaccatcataacctaatcaccttccaaagctctcacctcctaacaccatcaccctggcagttaggatttcaacatacgaattttggagggacgtcaacattcaggtcatagcagatagggaagttttgaattaggtatgtgattgtggttttcagctggactgaactcagttttcacactgaaagtgaggaatctaaatggaaaatcatgatatctgtccagcatgttgttaaagtataggaaaaggggatttagtakaatatggttgaaagcactgatttgaggaaaaataattttttcatatatactccccactgagttgagactcataaaatggttactggttgaggacaccaacgttttctagctacagattctcagtggcctcctgggcatctccattgggataccaggtcaggctctgtacagaagagcagagatagcagtcattggtgtgcgcccaggagccaggctgactgggtgatttctcagctctacacttagctagctctagaacccttggcaggttgtttaacttctttttgcttcggttttttcatttgtgaaattaggataataatagttctttatgatatcattgtaagggataaatgatttaagttgttggagcatagcaaatgatggaccagggatttaaacccagttttatgtgactctagagtctgtgctgtcaatcactggatatacccattgttaaaactgattataggccaggtggagtggctcatgtctgtaatcccagcatgttgggagactgatgcagaaggattgtttgagcccaggagttcaagaccagcctggataacatagtgggacttggtctccacaaaaagaaaagaaaaaaaagttagccaggcatggtggcatgcacctgtagttctagctagctacctgggaggctgaggtgggaggatcacttgagcccaggaggtcaatgctgcagtgagctgtgattgttccactgcactccagcctgggtaacagagcaagaccctgtctcaaaaaataaataaaatagattatatgttaaaagcatattttgtgtgtgtatatacatatatacacatatatataatatgaaaatatattattaaaattatttccaattaattttatgtttctttttccttatttattgtattttattattatttttgagacaaggtcccaatctgtcacccaggatggagtgcagtggcacgatcatggctcactgcagccttgacctcctgggctgaggtgatcctcccaccttagcctcccaagtagctgggactacaggtgcacaccatcacacctggctaattttttttctttcattttctttgcctttgtttgtttgtttgtttgttttgtagaggtcccagtatattgcctaggctcatcttgaagccctggactcaagcgatctttccaccacagcctcccaaagtactgggattagaagcatgagccactgtgcctagccttttcactttttttttttaaagaaaatgtggctattagaaaattcaaaattacaaatgtagttcacattctatttctgctggacagtgcagctttgggctttgtcatcccttgaagtgttctaaaatggtaaacatctcacctccaaattttttttttttttttttagatggagtctcaccctgttgtccaggctggagtgcaatggcatgatctcggctcactgcaacctctgcctccagggttcaaacgattttcctgcctcagcctcccaagtagctgtgattacaggtgcccaccacacccagctaatttttttgtgttttttgtagaggtgggggtttcaccatgttgtccaggctggtctcgaactcctgaccttgtgatctgcccgtctcggcctcccaaagtgtcaggattacaggcatgggccatcgcacccggccaaacttccaaaatctttttttttttttttgagattgcagtggcgcaatctcggctcactgcaagctccgcctcccgggttcacgccattctcctgcctcagcctcccgagtagctgggactacaggcgggcaccataatcatgccactgcactccagcctgggcaacagagtaagaccctgtctaaaaaaaaaaaaagaaaaaagaatgaaagaaagaaagaaagagagagagagagagaaagagaagagaagaaagaaagaaagaaagaaagaaagaaagaaagaaagaaagaaagaaagaaagagaagaaagaaagaaagaaagaaagaaaataaactggccaggctcatgcctgtaatcccagcactttgggaggccaaggtaggaagattacataacactaggagttcaagatcagcctgggcaatatagcaagacccgttctttccacagaggtgaaaaattggccaggcatgatagtgcatgctgtagtcttaactgcttgggaggcggaggcaggaggagtgtttgagcccaggagtttgaggctgctgtgaactatgattgcaccaccaatctggaatgtacactagaatctttatagtgtatatgtattcctcaacaatacatcgagctcctgaccttgtgatctgcctgccttggcctcccaaagtgctggtgctgggattacagtcgtgagccactgcgccccatgtgaacttttaaaaatacattcctgagtcctatctatgaattgccttttgcccatttttctgtgtatttatttttccatttttattgaagttaaataaaatatattatgggtaataatccttccagtgatatgatatgcagatatcttcgttttgttggtcatttcctttggcatcatctttcatttactttatggttatcttttgatagatgctcttcatttattgcagttcaatttctcaatcctttcctttgtcctgtgtttttcacacattgtttaataaatattttccccctctagtgtcttaaaatattttcctattttggcttctaaaagttgttataattttgccttttacatttagggctttaattctctgaaactgtgtttttgttgctgttgtttcagaaccattttcccaggagccatctttttttctcctctgatctgtggtggtgttccaccccagtcatgtttctgtgtatgcataggacttcattcctggttttcctttctgtttcatagacctactttttaaaaaaaccctatagctaatactaaatttttttttttttttttttttttttgagacagagtctcgcagtgtcgcccaggctggagkgcagtggcgcaatctcggctcactgcaacctccgcctccctgcaacctccgcctccctgcaacctccgcctcccaggttcaagcaattcccccgcctcagcctcccgagtagctgggactacaggtgcatgccactacgcccagctaatttttgtatttttagtagagacagggtttcacagtgttggctaggatggtctccatcwcttgacctcgtgatccgcccacctcggcctcccaaagtgctgggattacaggcgtgagccaccagcacccggcctactaaatcttacaaacaagagtgtttgactgtgcttggccctttattcctgtataacactttttattgtttatttaggtggttttataactttgacaatcagtagtttgttctcattcacattgactgtagattttttaaagtggtgacaggtacatgagttaccaaggtagagagcttgtttggtgaatcttcatcctcattacatttctggacaatgcatatggagacggtatgggacactccttattcctttggcccagacagcttccttgagcctgctgtccatccacacatttggagtccccatcaccctatggcaaatttctgaatatcttagacagcttgaggggcatgcttcttggagctcactgcatggatgcaattatgaatattgatggcagtattcttaggtcaccacctgtggatggcaaaatggcccttcttcacctctcctttctttgccagcgccattctgccaggttcaagttgaaaagaaagactgtgagcaattccacaatactttcagaatcagctggagatattgatccttcttatccaaaaataggttatgtctctcaacttatttaggttttctttaatgcagctcaataagattttataattttatccaaagaaggatttatatgcctttcgttaggtttattcctaagcacttgaaatttcttgtaaaatatgtctgttctgtgtgtattttcccccaatattttattattataaactttcaaatgcaaggaaaattttaaaagtacaatggaagccaggagtagtggtacactcttgtaatcccagaattttggggggctgaggtgagaggatgacttgagcccaggagttgaagcttgtaatgagctatgattgtgccactgcactccagcctgggcgatggagcgagaccctgtcttaaaaaaataaataaatgaaataataatacaatgaattagctacatgtccttcacttagactcgatcactgttaatttcatcatatttgtcttaacatctgtctttgtgtacgtaattttgggaggctcattttaacaaactgcaagtggtagagtcatcatttgtaactagaaaatctaattttagggacacaacaagatgttccaggcataccttatattttctttactttttcttttcttttcttttttttttttttttttttgagatggtgtcttgctctgttgcccaggctggagtgcagtggcaccatctcggctcactggaacctccgcctcctgggttgaagcgattcttctgcctcagcctccagagtggctgggattacaggcacatgtcaccatgccgagctaattttttatatttttagtagagacaaggtttcaccattttagccaggatggtctcaatctccttacctcgtgatccacccacctcgacctcccaaagtgttggtattacaggcatgagccactgtgcccagcctgtattttctaactaagcattcacaattgcccatttcttaccctctgctttgtcttaaccaaagccttctctttttcctatgggcccctgaactctgcttgcctccagatctgagcaaaaagaagtagaacttgccctttatcagcttctcctgggagtcggctaatcacatcgagcccactttcctgtcagatctactggtcatttcttcttacttatctagcttccccttaaaagaggctcttatctctgcttcctctcccctaccctaaaaggaaacttttttctgtttgagtttgagatgcttatacatttctgagttcagagtgctctccctatttgatatggttaggctttgtgtccccacccaaatatcatcttgaattgtcatccccgtaatccccatgtgtcaatggagagaccaggtggaggtaattggatcatgggggtggttcccccatgctgttctcatgataatgagtgagttctcacgagatctccctttgctcagcacttctccttcctgcctccctgtgaagagatgtcttctgccatgagtgtaagtttcctgaggcctgcccagccatgcagaagtgtgagtcaattaaacctcttttctttataaattacccagtctagggcagttcttcatagcagtatgagaaccgactaatacactattacaatagtctttctctctagttaaattatttccctaggctggttgcagtggctcacgcctctaatcccaacactttgggaggccaaggcgggtggatcatctgaggccaaggagttcaagatcagcttgggcaatatggtgaaaccccatctctaccaaaaataaaaattagccagtctcataacccagtctcaaaaaaataaataaaactttaaaaataggccgggtgcaatgactcacgcctataatcccagcactttgggaggtaaagcaggtggctcatctgagatcaggagtttgagaccagcctggccaacatggtgaaaccccttctctactgaaaatacaaaaattagccaggcttggtggcacgcacctgtagtcccagttacttgggaggctgaggcagcagcagaatcgcttgaacctaggaggcggaggttatagtgagctgagatcatgccactacactccagcctgggtgacagagcaagactctatctcaaataataataataataataataataataataataatawtaataawaaaataaaataattttaaaaaatgatctccttaagtccagatttatttttattggacatttctgtgccccagacctggaatgggccatttttccaatgaaaagsaaattattcmttttagtgtgtactggtttatttttggtgccagctgcttcctcttgttgttttcttcccccagcaccaatctggcactggagtcatacctccctggaggtttcaaaagccttttttttttttcttgtaagtgtttgccccttgtattctttgaataaaaacattatgtgggcagggaccatgctttattttttaattgaggacgtatattttatgtcttatgtcaccgagtggaaatacagcaaactacctggcctctcagatttctgccttcagttccataaatcctcttaaactaagagagtcacccggtcactttcggatgggacagatacctcagtttattyacatttttcctgacttttcttaattccttcttgtgaagtcagaaactgaaaagtctgagattttctgctacttgcaagctaacaagttaccgtgccacaattttttttttttttttttagacagagtctcrctctgtcgcccaggctggagtgcaatgcagtgatctcggctcactgcaacctccacctcctgggttcaaggaattctcctgcctcagcctccagagaagctgggattacaggcgtctgccaccatgccygactaattttctgtatttttagtagagatgrggtttcaccatgctggccaggctggtctcgaactcttgacctcaggtgatccagccacctcggccttccaaagtgctggaattacagacatgagccaccacgcctggcccacaaatttttatatacatcgtgttagaaaacaggagatctctgagtcagagacaaagacgtgtattcacagtaaaagcagcagccaaggtgacttcagagcttggrttccctgagccccaattcccataaggcaacatagggagggccagatggtacttacaggtgctttcaggtgcaatacaggaggcgaagtctgagtttaggaggctcacattttgcatagggctgcaggaaaatctgcccatcctcccttccagagagaaacattctacactggaatgtgagcaaatatttctggggaaagatgtctgtaaatctctcggtgaaagttaccgttttgatctttatttatctaggaatgtaaatacatttgcttcaggggaagtccttgtctttatytctccagggctgcctgcttgcactaggcattcctagaaagataatcctggcacacaggagcgaaacatgtaggagtgctgaagattcacagacagtcgtctcaatgtctctgaagttttttttcccttaaacttctccttttggacattccccttcattttccttttaaaaatctcatcctttccaacactttcagttgtaagaatttccawatcaagcactcaatatcaaaacaatgtgtgtgacaaacttaaagtgttgaatctgactatgtcagcagaaagcataattatcgatgatgtatgggacagcaatcttgaattaaagaagaaggtgggaaagccccaaatctctcataaattatgatgatgatgatgatgatgatgatkatttagcacacctctgctggcaggaaacaatttattttaaagatgacctgttacattaggtatttgtattgaatgttaccttatgtgttgaaaagggagtgaagagagaatatatatgtaatttcttgtgtatggataacatcgatgtaagtacaaccaaaataccaatgtaagatctgtacaccaacctaataacatgagcatgattgataggttgatcagtagtttggcttattgttcaatgaatatccactcccctctcccttctactgtrggaagattatacttcttgggcctggccctgtgacttgctctggcaaatgtactactaatggaaagacaggagagagaccttgaatatgtttgacttggctcttggtttgacatagctctcctagtcctgccattgttcataagaacaacatgtcccaccagcactgcttcttcagcctgggtcccagaataagactcasgaaacagatatgagcacaacctgaaccccagagcctaggcatctgagtgtcagtctgaggcacaattatcagctgacctgcagatctgccagtaagataaataaattcttggccaggcatggtggctcatgcctgtaatcctagcactttgggaggttgaggcaggtggatcacctgaggtcaggaattcgagaccagcctgacaaacatggaaaaactccatctctgctaaaaatacaaaattagccaggcgggtggtgcatgcctgtaatcccagctactcgggaggctgaggcaggggaatcgcttgaacccaggaggaagaagttgtggtgagctgagatggcaccattgcattccagcctgggcaacaagagtgaaactccatctcaaaataaaagaaaaataaattcttaaattacctgggcatgttggtgcatgctataatcccagctactcgggaggcagaggctgaagtgagctgagatcacgccactgcactccagcctgggcaacagagcaagactcctaaaaaaaaaaaaaaaaaggaattcttgttgtaagccatttggttttggtatgtatgtgttttgttgttgttgttattgttttgttttgtttttttttttgagacggagtcttgctctgtcacccaggctggagtgcagtggcgcaatctcggctcactgcaagctctaactcctgggttcacaccattctcctgcctcagcctccagagtagctgggactacaggcgcccaccaccatgcctggctaatttttgtatttttagtagtgacgggtttcaccatgttagccaggatggtctcgatctcctgacctcatgatccgcctgctttggcctcccaaagtgcgggattacaggcatgagccaccgtgcccggccctaaaaaggggaggcatgaataatccaccccttgtttagcatatcgtcaagaaataaccataaaaatgggcaaccagcagccggctgctctgtctatggagtattcttttattcctttactttcttaataaacttgctttaactttattctatgaatgtgccctgaattctttcttgtgcaagatctaagaacactctcttggggtctggattggaacccctttccagtaacatctttctgacgacccagaggggactatagtgtggaaactcccaactcaaaggctaactttggttaagtgttggggtctgataacatctttctcatgaaccacaartgggacaatactgaaaatacttctcaacccaaaggaaacagactgcagcactaattggccaactttgggtaattggggtacccaagtaaaggatgggattgggttagaggtgcaacttaggggagttagagtctctcctgaaacagagtgggttagagactcatcttaataaaaggcaagaacgcttaaccaaccttgggttagaggcccaaattagaagagttatcccttctaagatttagggagttagaggcctctctcagtaaagtccttctyggctaagaatgggtttgacactattaactgctattctctttcaaataatctgccttgcactctttgctgacagctatgggtgacaggattaggcatgaacaggatcgtgggacatggggagctttttcttccctaaaaggggaaacttgagagctgatgggactgctgaaaaatatcccttcacagctgacaagcggccacctgaacttttgattcagtgttgctggaatgggtgggtctttctctcaactccctgagatcttcaccttccccatcctgccacaggcaaggcttttctctctctcctttccctttcttattttttctattactcagggtaaccatcyttcccagagatcacaagtcaaaactctctggtcagaggttggattaaygatgatggggyccaacagggggcaagtttgagccttgccagtttgatattgggtgctaagcagagtggcaggtcataaactgcttctttgacttttacaaattgttcaatttattttattctattttatttatttatttttgagatggagttccatgctgttgctcaggctggagtgcagtggcacaatcacagctcaatgtaacctctacctcctagattcaagtgattctcctgcctcagcctcccaagtagctgggattacaggcacgtaccaccatgcctggctagtttttgcatttttagtacagacagggtttcaccacattgtccaggctggtttctaactcctgacctcaagtgatccgccccacttggcctcccaaagtgctgggattacagacctgagccaccatgcccagcctcaattcattttaaagcattaaattctagataaggcctggggatatatgggattagccatgccccctagctatacaaagaaggttataaagaaaaagattttatataacaaaggatcttgtatggtaaattcttgttctaaagtaaaatggttgtttgacaagaggtatgtttaggacaagtccraaagtccaagcatgtcataaatggtctgtgtaagtcataaaaatatgaaaataatttatgcaaaaaatgttgtacaatttaaaggtaattaggcttcctaaatgtgtcataaaatgccactataacttgtaactgtaaaactttcctgctttacagctaggtaaggcctgggacacgtaaatgctaaaaaaaaatcagaccttatctgcacttctgtctgctgtcctcggctccatacctaattaaaaccctgaacttaccaaggttttcaccaaaagttaaagtcactaagagttaacagtgtaacatgtatttgtgactactgaagaaacagttttacatgcaaggtgtgtaagaaaagtaaactttgtttttagtaaaaaattataaaaaggcatgggcatgtattttttttgcctaaagggttaaaggattgctttaagtgaaataggaaaattctaaaggtttaaacaagttgtaaacgttttataaaaaaattaattataaaaaaaatctatgtgtgaacagattggctaaagttaaaggggtattattcagttttaaactaaacattggaataaaagcacaacaggtttttcttaaagcaaaaacctgcttttactctgctctttaacaaatattgtaaaggtagttataaaagaggtttataaaaatcttaccttatggtcaaactgattaaatacatttgtctataaggttttattaaaaactgggtttgacagtaatagtacactaatgtaaaagtgacatttggcttattttatataaaaatcatacaagaagcactgtcaaatataaaataatgtttagcttctttgggctatatttgtataaatatgttattggtatgtgttccaaaataattctaatataacttagtgtatattattaataattataattgttacataaaatcattgtatgccacagaggtaaccaaatttctttgtcaattgtgtttttaactgtgactgtcctaagacattttgtcatccacggacacttgttgttttattcctctttaaaaaaatggtttataatcagctataggactctaacaggtgctcttaaattcaggtttctaatacctttgaacactgtaatattaaaatacaggaaaaaactttcggactcayggaaagctgaaatgttcataaatatcaaacaggaattaactgcatggactaaactaatagaagctatttacagcttttaacaattaagtatactcctgtaaacaaaacgtggatcatatttgtttctctctaccagatttctctaaaatatggaaactatttgtaagtattcttaatttatggcaatatagttatttgcataagtgcaataaaaatccattttcttttgtaacaggatgcaattggaaaaactggttattttaccaaggctttaactggaatggtgtgttttcctttaaggaattaaatttaacttatagggccaatacaagtcccttgggagaactggcctcataccttgcctacacagtccctgcacagggtttctgacctgtgataagtaaagaatgtcactttctaacaggcccagaagccccaggttatcttggaacctcaagaggagaggaatttacctagctcataggtatttaagcatacaaaccaatggcagggctcggatctaaaaaaatcttatctaagattccttctatggaacagagttccaatttacaaaaagcttatgtgaaaaataattattcttgctacactttatrcaaacaatcaggccaagtataataaagcaagttggtgttaccataatttgtctttaataaaaatgggaaactggagacagaaaacttaatgtttcaagaactgtggtacacttgttattaaattctagtctcatcagttgctttaaatttttttccctgcaaattaaactgactctgcttattcctgtaaatcaaccagtaatctctaactgctgctcaaaagaaacgagaggatgggtaatgtcaaaatctgaatcaatatctaattctgggcacatactggaatcatctagcaaccccctatcagcttggttctaacacttgcccagttgatagaaagccttctaacttagttaagttgggataattttgcttatgttgttttagtgtggtgaaatatattgctgttgtactctttgtatagcaatgcaaaataagcttactcaatgttttcttaaacacttattaatcttccaaatatcaccttttgttggaactcaaaagttataaatggccctcaacataccaatgctttctttctttctttctttttttgagacaaaaatctcactctgtcacacaggctggagtgcagtggagcgatattaactcactgcaacctctgcctccttggttcaagtgattctcgtgcctcttcctcctgaatagctaggattacagacacccgccaccacgcctggctaatttttgtatttttagtagagtcggggtttcaccacgttggccaggttggtctcaaactcctgacctcaggtgatctgcccacctcggcctcccaaagtgctgggattacaggcgtgagtcactgcrcccaggccaatgctttctaactaagctcctctctaccgtaaacacaaaagaccctaatagttaggcaggaatatcattgcccctattcagcataaagaagttacagaaaatggatctttgtccctctgcagcccttaggattaagggttctcttataaaaggaaggtgggaaatgtcagaggcattggaaccagagcaactccatcttgaaaaggggctgggtgaaataaggctgagacctactgggtggcattcccagacagttaaggcattctgattcataggatgagataggaggtcagcacaaaatacagttcataatgaccttgctgataaaacaagttatagtaaagaagccagctaaaacccaccaaaaccaagatggtaccaagagtgacctctggtcatcctcactgctacactcccaccagtgccatgacaacttacaaatgccatgacaacrtcagaaagttattatatatggtctaaaaatgagaggcatgaataacccaccccttgtttagcatattaagaaayagccataaaaatgggcaaccagcagcccttggggctgctgtctatagagtacccattctttcactcctttactttcttaatacattgttctcactttaatttacagactcgccctgagttctttcttgcacgagatccaagaaccttctcttggagtcaggatcaggacccctttccagtaacaaaagtagattagagattatcagaggttggggagttattgcttaataattagagtttattttgggcatgttgaagtttcagaagtaaatagtggtggtggctgctcaacattgtgaatatcattcattaataccactaagctatacacttaaaaaagccaagatggcaaactttatgttatacatactttaccacaatttgtaaatgaataacgaattagccaaaatatattgaaatgggtgaattgtattgcatgtgaattatatcttgacatagttgttagggacaaaaagggcattcacaatttcaaccttgctgaaaagacagaattctgcagtgctagtaagaagagttaggacacgggataagattgacatgcaattatttagtaagtgtatgcaagcttaaaatccaaaaaataataaaggaaacgcgaagccagtaattgaggacagagccactagtctcctacttttcatgttttgctattcaatacttgctacgagaaagactatttggctaacttcctagaacttgtaacattgtcagtgcccagctaccttaatattccagggagcattgctgacactgttttggcttttgcatgatgagtaattataatgctataagagaggcaagcctgagtcctgggattacccctttacctctatttaggtttatctattccattccagtaatagttactcaccrctaytttaaaaaagaaaagaggytttttgacatcagctgttgctattctatatgttatcttctttctgtaagggaaggtacccttatcwccattctggatctgagcctgaaatctggccaccttttcttcattcatgctgatagtgaacctgaagcaggaggctttttcaacactagcaagtggcaacagcaaaatggcagctctgatgaagacagagaatggaccattggcagttagttttwagaaaatgagtttctagattctcaacttctgtctatgctttttcttaaaagagatcttctatcatgctagctctcagatgttacccagtcctactcttccagctccccatttatrtccaagctcctgctactgatatacacccactatggtgcattgcttatgggaggaggaacctccagggctccaggaaagatacatttctaaatatcagtgctggccagtgaggaagtggatgactctgatgatggagtaatgcatcttttgcaagttagatgtttcccaattctttgctttcaacaaaattgaaagagagctgagaaagttgacataccaaatttcattaaaaatcaacttttgataatcagtaactatgtgggttttggcatatacttcagaaagagttcaaataattgaatgaaatcactataataaaaccccttctattccattctacctatttatgctacaaggagtccaataaaaacaaatccatacttagataaagaaaggcctttttcaaaaagacttatgtaatgggggtggcagggggaaagctattgtgaaagaatactccactggagcaaacaaggttagaaggaacagagtatgggggaaatggaatcagagagtggcacattggacaatttttctttgcartcagccaattctggaagggtcattaaggaggttgttccacattccaatgcttgtttaaactcaacagtaggccaaagttcaggggcctcaggggaaaagagaagcctaactagagtttggtcaggtcagattagcaggtattttgtccagactggtcagtgcaaacagttcatctaatcatttatgagataaaataatgggaatttggagagcctgtgttgtctttgtcttaggtaaacaagggggtcgtcatccattggtcttatctaaatcatatagggaagggtggatttttgcagtaagccattttcaggaccgcaraagagtggagggatttttaaactattgctattttccaggagtatgatgctcaggtaaagttcaacattgccaacctttttgtttgtttgtttgtttgtttgtttttgagatggagtttcgctctgtcgcccaggctggagtgcaatggtgcratctcagctcacagcaacctccgcctcccaggttcaagtgattctcctgcctcaggctcccgagcagataggattacaggtgtctgccaccacgcccagctaattttctgtatttttagtagagatggagtttcactatgttggccaggctggtctcgaactcctgacctcaggtgattcacctgcctcggcctcccaaagtgctaggattacaggcgtgagccaccacgcctggtcccattgccaaaggtttacatggatttgatgctgaaccctgtgcattttattaaaaagtcatgagcatccatacgacatccatttcactaaaataagtatttccagtaatgttttacttccatattggagcacccactaactcagctattagtgttaagttcaggaatgacagaaggactcattagatacaatttgtttccataatatagatgcttattccatgcaaactgcttcattatgmagaatccacaattacatttttggcatcctgatcattttatctaaggatccaagatcacaaggatttcttaagcagttgctgttatttttcaacaaaattactcaacttctttatactataatgcttgtcctctgtaacgccttgcatgcccctattgggatctgggctagtttgattaaggagggatctcagtgggatggcagtgtgatttaactatgttgtccctccctttccctcacaggtactagggaagctatgaagatcagattttgctaggcttagagctcttggctttcctttcccttctctttgtcaatgctttcatttccaaaaaagccataagaaacgaacatgggatagtatttctagcttttccctgcactgcttgcttctcttttttcaacccatttaatcagttcttagtgaattagatcaatgtttttttaaatttcactgataagagcaattcttggatggagtcatatcaaacaacatgatggttaagcaatctttcaggcatcaaaattatttgttccctattcatcttcttacaacataagggttttttgcctctacggggtcagaggtcttcgtatcaattgccactttatttttaatttaatttttctttttcatcactcccaaagcaccggaatcaatcgccacttttgatacaaacctggattgatggaaagactaacaaaacaacgcagtttcttttttcttttctgagatggagtttcactcttgttgcccaggctggagcgcaatggtacaaactcggctcactgcaacctccacctcccgggttcaagcaattttcctgcctcagtctcccaagtagctaggattacaggygcccgccaccatgcctggcttgtatttttagtagagacagggttttgccatgttgcccaggctggtctcgatctcctgacctcaggtgatccaccagcctcaacctcccaaagtgctgggattacaggcatgagccactgcgcccagatcaaaacgacacagtttcaataccagtttacttattttattcaaaggatgcaggacaggtagttcagcatccaagcaagcactgctttgagcaaaaggccttgcaatatcccaggcacagyttccaagcttatcatttcatgggtcatgctcagttacaagggatgaaggtaaagcaagatggaccaccttggcactgsgaagctcttctactatctgctctttgactttttataacttattagtcatatcattcctcagggtgtgtataacttaataaataactttttttttttttgagacagagtctcactctgttgcccaggatggagtgcaatggcccgatctyggctcactgcaagctccacctcccgagttcaagcaattctcctgcctcagcctcctgagtagctgggattacaagttcatgccaccatgcccagctaatttttgtatttctagtagagacggggtttcaccatgttggccaggatggtctcaaactcatgacctcatgatctgcctgcctcggcctcccaagttgctgggattacaggcgtgagccatcacgcccggccataaataacattctttgggagcagctgtagcacctcaatgaaaggttatacaacaaatagccccaacaaccagatacacttcaggtggaaaaagcatggtccacacaacattctacacttaccrtaacttagtacattttgagaactaattttgcaagaaagtaaattcagggtcagcttcccaggtgtccctggacctggaccaagagtttcaattctctgagaattgtttctcttacaatgcttaacaattattttttaaaagtgtatttactttttgtgattgtttgtttattactaataactgtagtgatcatttaatccagaagaaacattgaccacttagaactttaagatcggctgggtgcggtggctcacgcctgtaatcccagcactttgggaggccgaggcgggcggatcacgaggtcaggagatcgagaccatcctggcgaacactgtgaaaccccgtctctactaaaaatacaaaaagttagctgggcatggtggcgggtgcctgtagtcccagctacttgggaggctgaggcaggagaatggcgtgaacccaggaagcggagcttgcagtgagtggagatcacaccactgcactccagcctgggcaagagagcgagactctgcctcaaaaaaaaaaaaaaaaagaactttaagatgacaggaaataaaaacaatttaaaataatttcaattcttagacacatttttgctcagagaaatatgataagatgattaataaaagacttttgaacacatattaaaatcaaattttgtgaggaaaaggaatgaaaaatttttcaaagataaaataaattatataaaatgtctgtctattgaagaagagtgttattttctctcttgtatgatgaatgatggaatataccaaaaccctatgctaattagatttggtagatacactttaagaagtaatataacgtctgtttttatttatttrtttatttagacagagtcttaccctggtgcccaggctggagtgcaatggcacaatctcggctcactgcaacctccgccttctgggttcaagcgattctcctgcctcagcctcccgaatagctgggactacaggcacacgccaccacgcctggctaattttttgtatttttagtagarcyggggtttcaccatattggccaggctggtcttcaactcctgacctcatgatccagtcacctcagcttcccaaagtgctgggattataggcgtgagccaccacacccggccagaaaaagtaatataacttctatttttaaaagtcaatatttacattatgcctcaaattatgttctttgaaacaagttagaagtaggtgaggaagaacatatctttttgaaattattttaggtgtactgagaaaaagttaagtttaacagagagaagggatgactaaattatgttaaactatgtgactatccgagggttcttttagtactctcttaatctagccatagcccttagatctatcctcacmgtaagaaacacatgtttttctccaattactttaggggckactactgtatgtcaaagatcatgtcacttgattttatttatcttttcrttgcaacactattcacaacttgtcacttttkaaaaaacacaaggtcagttaggtagatcacatgactattcttagtttttcatactctgtatccaaattttacctttatactctttgccrtgtgactttgcagttctccccactagggaagggatgtatttcctgtgagttactttgactaatgaaatatgagttgaggccgggcatggtggctcacgcctataatcccaacactttgggaggccaaggcgggtggatcacctgaagtcaggagtttgtgaccagcctggccaacaatggtgtgaccccatctctactaaaaatacaaaaaattagccgggcatggtggcggacgcctgtaatcccagctacttgggcagctgagacaggagaatcacttgaacctgggaggcaaaggttgcagtgagccgagatcacaccactgcactccagcctgggcaataaagagcaaaactccgtctcaaaaaacaaacaaacaaacaaacaaacaaataataaaaaaaagaaaagaactatgagttgaaggaayggtgtgacagttcttgcttcaagagacaataatttccgatatgttcctgcgattatttatttatgtatgtatttatttattcttttttgagatggagtctcgctctgtcacccaggctgaagtgcagtggcaccatctcagctcactgcaacctccaactcctgggttcaagcgattctcctgcctcagcctcctgagtagctgggattaacaggtgcgtgccaccacgcagggctaatttttgtatttttagtagagatggggtttcaccatgttggtcaggctggtctcaaactcctgacctcgtgatccgcccgccttggcctcccaaaatgctgtgattacagccatgagccactgcacacagttgttcctgtgatttttttaacgaagatttaggagtttttcctttgagtgagaaaactggcgatatttgaataatggctgaagaatagtattgtatgaatgttaatttcccggttatgatcgctgtactgtgattgtgtaagatgttaacaccagggaatgctgcgtaaaagatatacaggaactctgtactattttggaaacactgtagtaagtctaaaattatttcaagacaaaaagtttacaggacatgccccagttagctgctggtccaaagaactgaggaaacatgttgagcagtcctgaacccaagtagaagcctrgagccacactcaggcaccctatagcctaaagcaaggttgctccagcccatgcaaagatccatgaacttgttgttgtaagtctgagacataggaggtgtgttatgaagcattattgtggtaataactgactgttttagtccattctcacactgctgtaaagaactgcctgagacttggtagtttaaaggaaaggggtttaattgaytcacagttccgcagggctggggaaacctcaggaaacttataatcatggtggaaggggaagcaaaaccttcgttcttcacatggcagcagcgaggagaagtgctgagcaaaagcggggaaagccccttataaaatcatcagatctcatgagaacgcactattatgggaacagcacgggggaaaccgccctcatgattcaattacctcccacagggtccctcccatgacacgtggggattatgggaactacaatacaagatgaaatttgggtggggacacagccaaaccatatcactgatgaatataatggagttgaaatatcttgtctttaatttgtatgtgcacatatgtgcatgtatgtctgtatgcccatgtattttaatccagcacctctttattcatgcattagagtgacagtcagaggtcctcaataattgatgagttttcctttgagaatgaaataagagagatttgataacttgattaattcatagacaccaccttaactaagtgatcagagttaatatcaccagtaatgagatatatcaacataatataatcccttacataatgcaccaagaagggggcaacatacctgctgtggaattcttgccaaaaatgcataacctcaatctaattgtaagaaaatatcagacaaactaaattcagctactctctgtaaaataactaatcagcagtcctcaaaagtattaaggtcatgaaagacaaagaaagactgaggaactgtcacagattggaatagactaagaagacatgatggcttagagaaatgtaagatcctggattagaccttggaccaatgaaagaacattagtgggaaaactggcaatatttgaataacggctgaagaacagtatttagcaatgttaatttcccggttttgatcattgtactaggttgcgtaagtgttaacactagaggaagctgggtaaaagatactacaggaacgctactattttggaaactttgaggtaagtctgaaattatttcaaaatgaaaagttttaaaaaacatcaggaatgaggccatttatctttagagtaatacattttaaggaatctttagggtttccatttaggataatatttgccagacctcatgaaattaaatcaaaatctctgaggtgggagtgaggcatcggtattatttttaagccctttaggcgatcccaattgcagccaagtttaataacaagtagtatagacaataaccatcaaatgaacaccagtgtacccaccacctagtttaagaaatacccagttttgtttgtttgctgrgatgtcaaggcaagaaatatctagttttaagaaatacgctgtagactcttccctgatcctgcctgcaaatttctccaaccatagttttcctcattctgtaatcaagtttaatttaatttaatcatagtttaatcaaatacacatgtatccttaaaacatatagttttaaacatatacttttatttttacacgtttaacttaatatgaatgaaaccaacattataaatatatttttggcagctagctcttttcttactcaacattatgtcaatgaaatgtatagattttaattcatgtagatgtagtttattttcattgctttcagtattttattattttgttatatcaggatttgtttgtccattctaattgagaacataagggctgtttctagttttttgttatgatacataatatagctttgaacattcttgtttgcctcattgcgcccacatgtaagagtttctcctgagcacatgcccagtaaatggaatttctgagtcatagggcacatccatttcaggtgttctagataatgccaaattggtttccaaaatcaatacaccaatttggagtcctatcagccgtgtgtaaggttgcttattgctccacatccttgccatcttttgattgtgtcaaacttaactcctttttttttttttttttgcaatatggtgggtataaaattatctcattatggtttgaatttgcctttccctgttaagtagtgagactgtgcttctgttcgtgtttctgtgggttgtatactcatgaaatgtatgtatgtgtttttcttccatttttctcacgggttgtttggtatttctttwtttttttcttttttttttttgagacagaatctcgatgcattgcccaggctggagtgcaggggtgatctcggctcactgcaacctccacctcctgggctccagtgattctcgtgccttagactcctgagtagctgggattacaggcacataccaccacacctggctaatttttgtatttttttagtagagacagggtttcaccatcttggccaggctggtctcccactcctgacctcaaatgatctgcccacctcagcctcccaaagtgctgggattacaggtgtgagccactgtgcccggctgagttgtttggtatttcttacttatttgtagaagttagttatgtttttctcagttataattctttgtcaattatgtgccaaatatcttctcccagtttgtagcttatattttcattttcattgtggtatcttttgaaaaccagaagttcttaattttaatataatacaatttatcaatctttccctttatatgattttcttctttttcctgttttaaatgatggactattagaacgtggaactatattattttaaatattatgataaatacatagaatacataatacaaaaaagttaaacaactggtatatatattggataagaaaagataaaatgatatctttcagctgattataagatttatgcrgccgggcactgtggttcatgcctgtaatctcagcactttgggaggccgaggcggacggatcatgaggtcaggagttcgagaccatcctggctaacacggtgaaacccccatctctactaaaaatacaaaaaattagctgggcttggtggtgggcacctgtagtaccagcaactcgggaggctgaggcaggagaatggcatgaacctgggaggtggagcttgcagtgagccgagatcgtgccactgcactccagtgtgggtgacagagtgagactccgtctcaaaaaaaaaaaaaaaaaaaaaaaaaaagatttatgcctgtatatcccaaggactccggtttgaagaaaaaaaaaaactacttgaatcaataaaagtagtgatatggtagttgtattcaagataaaaatacaggccagatgcagtagctcatgcctataatcccaacacttttagaggccaaggtgggagaggattgcttgagtgcagaagttcaagacctgcctgggaaccatgccgagacctggtctctacaaaaaataaaaaattagctgggtgtgtggtgatgcatgcccctagtcccagctactcaggrggctgaggtgagaggatcccttgagcccagaaggtcaaggatgcagtgagccatgatcatgccactctaccccagcctgggcaagagagtgagatcctgtctaaaaaaatttaaaaaaagataaatatgcaaaaggtataaaaaccagtatgttttttcaattcttgaagtagtggcacatgcctgtaatcccagctacttgggaggctgaggcaggagaattacttgaaccctggaggcagaggttgcagtgagccgagatcgcgccactgcactccaggctgggtgacagggcaagactctgtcttaaaaaaaaaaaaaaaaaaaaaaaattggccgggcgcagtggctcatgcctgtaatcccagcactttgggaggctgaggcaggcggaacacgaggtcaggagatcgagaccatcctggctaacatggtgaagccccgtctctactaaaaatacaaaaaaatacaaaaaattacaaaaaattagccgggcgtggtgacgggcacctgtagacccagctgctcgggaggctgaggcaggagaatggcgtgaacccaggaggcagagcttgcagtgagccgagatcacgccactgcactccagcgtgggcgacagagcgagactccgtctcaaaaacaaaaaatcaaacctgcaataaacttatgcatatatatgtttayattgttggaagtttatcttcagggtaaatttctagaaatgagattgctgggtcaaaatataagtgcatatgtcgtttattcagatattaccaaatttctctccagaagcgttgaaccmattttcattcccaccagtaatgaatgagactgtgtatttcccttacagtctctccaacagaatatactgtcagtctgtatttttaaatttttgtctatctaaacttttccaggtaaaaatggtatctcagtgttgttttaatctgcatttttctaattatgaatgagtctgacattttttcatatatttgagagacatttttctatctttttttgtttgttgtctgttcacatcttttcccatttttctgttgagtttttggtcctttgtcctcaaattttaagcattttttatattttaaggattttactccttgtctatggtatatgtgtgaatattttctcctatttttgtcagttatcctttgtccttctttatggtacttttgtcacgcaaatttaagcatttacatatcatcacatttatcaatcttttattacgtctgaattttgagccccagttcaaaagccattccctacactgaagttaaagaggaatctacccgtgtgtttttctaatatgttggtgcaaaagtgattgaggttttgccattacttttatttatttatgtgtttgtttgtttgtttatttttgagatagagtctcgctctgttgcccaggctagagtgcagtggcacgactggctcactgcaacctccacctcctaggttcaagtgattctcttgcctcagcctcccgagtagctgggattacaggtgcgtgccaccatgctcagctaatttttttttttttttttgtatttttagtagagatggggtttcaccatgttggctaggctagtcttgaactcctgacctcaggtgatccgaccacttcggtctcccagagtgctgggattacaggcatgagccactgtgcccagccctgctgttacttttaatggtgcttgaatggtttccttttttacatatagatccctcatctattagaagttgattcttacatatggtgtgaagtattcatctatatatattttccaagtgcctacccatttgttctagcattttttcaaagtctttctttacttcagtgatttgacatgccatctttgccagatacctaattgtatcttgataaataaaagttacttttaatggctaagtactttaaaatattatcttaagttacttttagaatttataaayatttctccctctttttaacccctttaaggtaaagagtcccaaagcagctttagggagggaaaaaggtcacagtgggaccttggcctggccttaactgtcaagacactaagctgatgagtggcagctgtaaagagttgtcctggggactgtgccaggatactttttatattatttttatctctatgaaagcaatacatgtgcatagttttatatgtcaaaaagtgactgggcatggtggcatgtgcctgtaatcccagctactcgggaggctgaggtgggaggattgcttgagcccaggaggttgagaacrgcctcagcaacatagcaagaccctcatttcaaaaaaaaaaaaaaaaaaaagaaataaaataaaataaatgtaaaaatgaaaaaacaaaaagtgaagtgtgaacaataagaagtgtaaatcctggccgggcatggtggctcacacctgtaatcccagcactttgggaggccgaggtaggtggatcacgaggtcaggagttcaagatcagcttggccaagatggtgaaaccccgcctcttctaaaaatacaaaaaattagccgggtggggtggtgggcgcctgtaatcccagctactcgggaggctgaggcaaaggattgcttgaactcgggaggcagaggttgcagtgagctgagatcgcgccactgcactccagcctgtgcgacagagcaagactctgcctcaaaaaaaaaaaaaagaaatgtaagtccttggctgtacccctcccctaaccttgatttccaactagagtttaagccttaagaggggagattagaactaataaataattttagcaaggctgcaagatatgagatcaatacacaaaaatcaatcgtgtttctacacacttgcaatgaacagttcaaaaataaaattaataaaagtttcatctacaatagtatcaataagaatacattatttaggaataactttaacaaaagaaatgcaaaaattatactccccaaactgcaaaccattcttgaaagaaactaaaaaacatccaaataaatggaaaaacattctatgttcatggattgggagataatattgttaagatagcaatactyggccaggcacagtggtgcatgtctgtaatcccagcactttgagaggctgagctaggatgatcacttgagcccaggagttcaagaccagccgaggcaacataggaagaccccatctytacaaaaaatttaagaattagcccagccaggcacaggggctcatgcctgtaatcccagcactttaggaggccgaggtgagtggatcacctgaggtcaggagttcgagaccagcttggccaacatggtgaaaccccatctctactaaaaatacaaaaattagcctggcatggtggcatatgcatgtagtctcagctactcaggaggctaaggcacaagaatcacttgaacccaggaggcagaggttgtagtgagctgagatcacgccactgcactccagcctgggcaagagagcaacactccctctcaaaaaacataaattaaataaatttaaaaaaaattagttgagtgtggtggtgcacgcctatggtctcagctactcaagaggctgaggttggaggatcgcttcagtgcaggaagtcaaggctgccaaggctggtgtgagctgtgatcacaccactgcattccagcctgggtgacagactgagatcctgtctcaaaaacaaaacaaacaaaagcaatactcctcaaattgatctatagatttacagatttgaagatttgatcagaattccagctagttatagaaattgacaaaatgatctaaaattcatatggaattgcaagggacctagaatactcaaaacaatcaagaagaacaaagttggaggactcgcactttgcaatgtaaaaacttaataagggctggaagcagtggcttataccagtaatcccagcactttaggagtccgagtgggcagatcgcctgaggtcaggagtttgagaccagcctggctaacatggtgaaaccccatctctactaaaaatacaaaaattagctgggcattgtcgtgggcacctgtaatcccagctactcrgcagtagaattgcttgaacccgggaggcagaggttgcagtgagctgagatcatgccactgcactccagcctgggtgacacagcgagactccgtctcaaaaaaacaaaaacaaaaaacttattgaaaagctgtagtactcaaacctgtgtggctgtagtctaagaattgtcatgtagatcaattgaatggaattgagggtccagaagtaaacccacatgtttatggtcaacatttttaagaagagtgccagratcttcaaatgaggaaagatctcctgattggctacaagtagacctgcccttatttgggtataaacccatggaaagtccctagttagaagttaattgacagtttctggttggttaagtctctagttttgttttactttttacattgggcctcagtttgcttacataggaacccaaaaagctgagactatctcagcctaatggcctcccagttaaaatgttttgttttgttttgttttgttttgttttgagaaagagtctccctctgtcacccaggctggagtgcagtggcgcaatctcggttcactgcaacctccacctcccgagttcaagcaattctcctgcctcagcctcctgagtagctgggattacaggtgcatgccaccatgtgtggytaatttttgtatttttagtagagatgggktttcgccttgttggccaggctggtctcaaactcctgatttcaggtgatccgcccaccttggcctctcaaagtgctgagattacaggcatgagccaccacgctccrcccccagttaaaatgtttttaacgggcagtattaatatcattccatttcacagctgaagaaactgccttaggctatgtaacttaagatcaaacagctgtaaagggtgaatctgggatgcaaacccagccactgactacagagctctgctcatcttttagactatatggcactcaactcacgtcaacttttaaatgtggtttctttcttttagagcaaattttgcaatgaatacattcttgtaaaagcacttaactttacataagtgtttaaaggaaaacacatagatatatccccaaccttcttttttyttttttytttttttttgtggcagggtcttactttgtcacccaggctagagtgcagtggtgtgatcatggctcactgtagtcttgacctccgggtgcaagtgatcctcctgccttagcctcccgagtagctgggaggtgcatgccaccatgcgtggctaatattttttgtaaagaaggggttttgccatgttgcccaggctggtctcgaactcatgaactaaaagcaatccactcacctcagactcctaatagtgctaggattgcctrcatgagccactgctcccrgccgcaccccccacctttgtacagggcaaagactttgttatgtattcttccagacttttacattttagggagaaatttgtgcttccatcgaaaactgcattttataaattgcatccttcctggttatctgattctatgagagttactttataactctataggtttgttagcaatgcaaagtaattaatactatattgataacaagatacaagaattaatgtaaaataattcttatctatatatatgacaatggtctgttagggggaggccaacccacctgccccaccccaagccagtttgcacaatcatttctacatttstttactccacataaatttcttcttctttgacgcctttgaacaggttataacatctgcctacttttctcatttaattaatacgttaagtaaaatctttagcatttgagaagatacaactataaatatagctatgattcagtaattatgggtttcttacatcactgcccattagtcccctccagccaccagaccagactgattatttatggttttgcttgctttgcttttgttttctaggtggckatctcttaggaaccccagtagtttggacacacacacacacacacacacacacacacacaggcaaggtcacagtcagatccctggcacgttaatttggccatttgcccaggagcagctggtagcaatccttgtgttccagcacttaaatttctcctctcaggttaggatctctgagaatataggaaagaaaaaaaaaaaggagtttctcctagtctctcactaacaatcaacgtagaagactcctgtgacctctgatcaccaaaatgtgtaggggtttcttctcaccagcaactaatcaatcaatcctgaccagttgggtgtcttctaaatcagctcagttctgacactatccacctggagatagcatcagattccacaggttgaggactcaattcccgagactgccctgttttccattcagatgccarttgcaagctccaggttgttttacctgtgcttctgactgaccaagctatacatcgggtttcccaaaaacccctccttgggtttgatkgatttgctacagcagctcacagaactcagaaaaacacttaactaacctttactggtttattataaaggatattacgaagaataatgatgaacaccagatgaagagatgcatagggcatggggtgagggaaggggcatggagcttccaggccctctctgaatacaccaccctccaagaatctccatgtgttcagtcatccgaaaaacctctgaacactgatttttggggtttttatggagtctttgttacataagcatgattgaytaaaccattggctactggtgatcaacttaaccttcagcccctgtcccctcccaggaggttgaggagtagggctaaaagttcgaaccagcaaatcctaccttagtctttcaggtgaccagcccccatcctgaagcctagaggctgccagccgtaagtcaatttattagcatacaaaaagacatttctcactttgcagatttcacagattgtaggagttcttatgccaggaaacaggacaaaggccaaatatatatttcataatatcacagtctctaatttcattgttcagcttctccttcccataagactgtcaagcctctccagaacacagactgtgcagtattgaccattccttctactgtcccatttcttagccctgtcttagatactcctatctctgggagaattttgcttgcataccagtatgtctgttgaagagagctcttaatgctaggtcttttattttatttattatttttttttgagagggagtcttgatctgtcgcccaggctggagtccagtggcgcaatgtcagctcacttcaagytccgcctcccgggttcttgccattctcctgcctcagcctcctgagtagctgggactacaggtgcccgccaccacacctggctaattttttgtatttttagtagagacggggtttcaccgtgttagccaggatggtctcgatctcctgacctcgtgatccgcccgcctcggcctcccaaagtgctgggattacaggtgtgagccactgcgcctggcctattttatttttatttatttatttttttgagacggagtctcgctctgttgcccaggctggagggcagtggcgygatctcggctcactgcaagctctgccttctgggttcacgccattctcttgcctcagcctcccaagtaactgggactacaggcacccaccaccacaccccgctaatttttttgtgtgtttttagtagagacggggtttcactgtgttggccaggaaggtctcgatctcctgacctcgtgatctgcccgcctccgcctcccaaagtgctgggattacaggcgtragccaccgcgcytggccattttttttttttttttttttgagacaaagtctcattgtgttgcccaggctggagtgcagtggtgygatctcggctcactgcaacctcctcctcccgggatcaagtggttctgcctcagcctcccgagtaactggaattataggcatgcactaccacacccagataacttttgtatttttagtagagacagggtttcaccatgttggccaggctggtctcaaacttctgacctcaagtratcctcccgcctcggcctcccaaagtgctgggattacaggtgtgagccaccaggcccgaccaatgctaggtctttgcagtgggtctcatatcattccacgtacactgaggcrcacttgttgccagagaccaaaaactttactgagcaccctttcacccccagcgcccmcttggctgggtctatttccaattcttttagtctctggggctgatgaaatgaagatgggagggtagggcaagagaaacaagaagagctagccaagaagatagaaaataaygattttcagctcactgccacctccacttcccgggttcccgcgatcctcccaccacagtgaagtggtgtcatttgcctgggaaaatacccaaggttcattgtctcataccaaggaaatcgaagacacggacacacaagagatgagtaagagcagaggcttaataggcaaaagaaagagaaaagagaatagctccctctcctgcagagagaggggtgcccgagtrggtcttccagttccatggtgaggtgcacgggttttatagactggcttgaggaggcagtgtctgatttacatagggcccaaagattggttagaccaggtgtgacgtttacatagctcacgaagaagctggccaccccaccttaatcttttattatgcaaatgggttttctacctggccagagccatgttgcctgttccttactggacatgtggttgacaaagaaaagggaagatggagctgccaygttgaacatgcctagcccccaggtaaccttttcctattgtcacagctgccggcattcacccatgcaaggttccagcttgcttatctatgtctgcagctcaattttacaggctgactttttcaaaaagaaatgacttggggactgcttttcattaaaaggaaaaccttactgaggactttcttaccctyactatctgcctaaatcatttctttttaactcctatatcaatagcctcccaagtagctgggactatacgtgtgcgccacgacactcagctaatayttgtattttttgtagagacagggcttcaccatgttgcacaggctggtcttggaactcctgagctcaaagtgatctgcctgccttggcctttgaaagtggtgggattacaggcatgagacaccatgcctggccttcaaaaagttaatctaaaaatatatawacatatatcccagaaggagaagcagaagggtcagataggtgagaaccagggctttgaatatcagaaaaaccaggaagagataatatgtcaagtatggagtgatcaatactctcaaatgccgtaagaggatttgtgagcaattgagaaagccatgggatttgttcattagaatgccactgtgaggctcaactgatgaatctcagtagggtggtgaatgtaaaggctagactatgggaggttatggggctgggaggttgagagaaggaaaaycatattttatactgttcctgagacatttaatgaaggaaaaaaaggaaacaaaaaagcaacttaaaggttaagtcccacaaatgaattcttcaagtgaactgaagagtagcaaaacatgccactccaaacatgccactttggcatattgattattttgagataaagacagtgaaaggaagggaaatgggatacttccctgattcccyttgcaggacrtgcaacagaagtgtagctcacctgttcagttgcctcactgcttaatccccttgtgagacagagagcatgcagacaggcaggtgcagaggctggggtgagcgctctggggtctggcccggcygtagtgtctaggagtggatgcctgcagccccagcgttacaaagctttcagcttggccgcccgaagacagcttgaatgttaaccagcttaatggamcytttgccttttcacaagggcagagggccaacatgatagcttgctgtatcccgagctcttgttcagcgtcctggaaaaatcaggtcacacacggactcaaaggatgaatgcgaggttttattgagtggtggaggtggctttcagagggatggatggagagccagayggtgggtggatggaatgggaaggtgatcttcccctggagtcaggccgcccagcggctggactcctttcctaccgcccccagctgaactcctcttggcatccagacgtctctcctcttctctctttccctgctgtgctgttccaccgtccatctgctggtmtcctcctctactcacctgctgctctgctgtggagcttggggtttgcggtttayrtgggggcaggatagagrgtgtggagggacaaaaggcaacctctttgtcttgaaaacaggaatgcctgtcctcatttagggccgcaggtcttcaggcttgaaggtgaggtctttgccagggatccaccctcttctaaccagtattttccctgtcccctgtccgtatcagaagcagatgcagatacaagaaaacttctctgcctgccctccatatttgcctaaaagcaggacataatttttgtttgtttgtttgttttttgacacagggtctcgcactgtcaccaggctggagtgcagtggtgtaaacatggctccctgcagcctcaacctcctgagctcaagcaatcctcccacctctgcctcccaaagtgctaggattacaggcatgagccatcacgccagccaggacacaaatttttttttttgagacagagtctcgctctgtcgcccaggctggaatgcaggggcgcaatctcggctcactgcaagctccacctcccaggttcacgccattctcctgcctcagcctcccacgtagctgagactacaggcgcccgccaccatgtccagctaattttgttttttgtatttttagtagagagggagtttcactgtgttaaccaggatggtctcgatctcccgacctcgtgatccacccgcctcggcctcccaaagtgctgggattacaggcgtgagccaccacgcctggttcaccaggacaaaaatttttaaaggtgtctgcccttccctttctaccaggaaggaccaaagttaatcactggagacaactgtagattcttatcagcccagagatgacaccagaggaatctacatttcaaacttcattaactagctcttaccatctattagttcccccatttaaacatatttactttcccacaatttatcaccctagaaacttaaagtcgttttcctttgtattatcatttctctacaaatgttctttcttatgaagctagaaaaaactgaggcatggtttaaacgtcaaataatttatctgagccaaatgtgagtgactgcagtctgaaaacacttccaggttaccttgagaagtgctccagaaatcaaaaaagagactcgggccttaaaagaaaaaaaggatgaatcaggaaaggggcgactagaaaagttgtttttcgctaggtctggggctttggggaggtgggtttcccatttgcaaaatggaactttaaaagtccacggcacctaacatttccaagctcctctaaatcttccaggaagcacaggagatgcagggcagatgggagcattctcatcctgcagataaacaggcctggggtcagctgggaggttggaaaggcaggcactagaataccaggtactgggtgagtgaaagcacagtgtgacctggcaagggaaggggaggcgagagcaaagcagttgctgtctctccarwttctccttcactaaccacctcagcccagggcctggaaagaaaaagaacttaaggacttccacaggctgagactggatgctgraggtggacagtggctcacacaccttcttgaagtcaagtggctcctcccctgcccaccagatgccaagasggtctgttggacccagacctgtggtgacagctacaagagaaggaggagacaccaaagttgagtttgctttataagtgacattgcaggctgggctgcagtgggggggcaggatgaagattcaggctgtacttttcaagggaccaagggcttgggatccacataggcctcccacaccgtcagatgtcagctccatcaatactgaaagacaatrggagatgaggtagggagggggtgagaacgtggggagagggaagggaggtggtgggaaagagaggaaggaagaggtgaggaaaggcaaggaggaaagggaagggaaaaaaaagttgtttttcaactattatgatcagtgtgatcgtatctaaagcagtcttggagtcaggagacaggctgtaattgtttaaaaggtggcctgttcctggggacttcccagctcagcaggaagcagtcacagatgttttggcagttgtttagccaggaagttctctgcttaagacatgcgtggggtggctgggcgccgtgactcatgcctgtaatcctggcactttgggaggcagaggtagggggattgcttgagcccaggagttctaaaccagcctgggcaacgtagtaggaccttgtctctataaataaataattaatttaawtttttttttaaaaagacaggcctgaggtccaaaccgaaatggcctcccgactccattttatgtgctttgactaacccgtcactgtttcccttcatcattttgttaagwtgctggacaagccccagttctagccaccctttttagttactcatcactgaatgctcccatgtgtatacaggcagcacatgttaaaaaactttttcggccaggcgcggtggctcacgcctgtaatccagcactttgggaggccaaggcgtgcggatcacgaggtcaggagatcgagaccatcctggctaacaaggtgaaaccccgtctctactaaaaatacgaaaaaaattagctgggcgtggtggcsrgcgcctgtagtcccagctacttgggaggctgaggcaggagaatggtgtgaacccagaaggcagagcttgcagtgagctgagatggggccactgcactgcactccagcctgggtgacagagcaagactccgtctcaaaaataaataaataaataaataaaaataaactttttcttggccgggcacggtggctcacgcctgtaatgccaacactttgggaggccgaggcgggcggatcacctgaggttgggagttcgagaccagcctgaccaacatggagaaaccccatctctactaaaaatacaaaattagctggtcatggtgacgcatgcctgtagtcccagctactcgggaggctgaggcaggagaatcacttgaacctgagaggcggaggttgcggtgagctgagatggcaccattgcactccagcctggacaacaagagcgaaactccgtctcaaaaaataataataatacaaataaaaaaataaaaaataaataaaataaaataaaracgtttttatcttgttaatctgtcttttgtcaatctaatttacagggcccagcctgtaaatctaaratgagtagaaggaaaaagaatttttcccctcctgggcagaacactcttgggcacgtgagccttggcttcttaaccacatatctgagcagccagtgtggcagtggtgagtggcagtggagagactccaggaagcagccatttccctatcctgggtgcttcctgtttctgtctaatgctacacatagtccatggtttcagtatgttgtatgtgtttgattgtcaatccctrtaattacatcctacctaaaatatgcatttttgttcccrgaaccaagccgggtccggctgcattttcttgaggcccaataacgagaagcagacagactaggaaagaagggaatttattgctgtaaccagatacaggcagaaggctggagataattccaccaggccaactyaaagtgtyaacaattgtcttagtgtttatataggttgggrttatgcgcctgtgtgcagtgtagcattygcctaagtctactggtaactaattttgtttcaactagaaggtcagaggcaaaaatgctttctaagtcggattaagctgtgagcggcccagtacctacaaggyctgtctrctgtggtaccagagtgattatttctatcttatctgcttyacagcttggtctggagggctgccttagactctccaatgaatctattcgaacagctgcctctgttaccttgactgtctcagatttcgttgacccgagacgggtcctggcactaggaatgaaagactgtctctattattttggtttgctccaggttagggagaagcccacrcaaggctcctactgaccatatgtttcatttctagctttgctgtctgggcaccaatttccctaggtttaactatttgctcaatgttaaggcagctctggggaaattcgtctgtgtaactggggtgctatgcaggcctgtctgtttgactgtcatgcaggtctgtctgtgtgatcatcagggagaatyggccggccacattttcaatctttctcctcttctggaraaaataaccactcagtctttagcgtcagctcacccttcagggtttgacacctggagcagcagtcaaagaagctgaaaacasgaccttcctttctaggtgttaactttagccactgtggtagatggtccagaaagatgaccactgctaattcctttcctccctgaatgtgcatactgttgcagccatcagaggcggagtcggtttccttcccttgaattccgtctggttttgcgacttcccttgactaataaacagaatgaggtggaagttaaagggaatcayaacccaccctatggtacaatgattcttttaagacattcaagttatagatgcagaaagaagcctcttctgagcttcccttatctgactataggcagggccttkggagaatgaagctgccataaatcccctctctgggggagcttccagccaggaaggagcctgactgttagcacctgggtgagaaattgcataaacaaacattatcataaactgtaatacctgccattggtttccctaaaagcccatttktacttcccacagaagctctagctttcccgctccttctgcctattaaattgttgttgtaatatacccttacccctagctgttcagcaagctactgctttctaatgctgtcacatgtatgaatataaagcatgttytttttccctctagttaaactgtctaatgtcargaaatttgcaggcccacttcctccccccaccaccacttgaacctaatttagtgatggaaaggttttattcccartatagttgtgttttatgttcctgttctaggcttaaattttcaggggcctggaagcttccatttttgtttcaggaagctagatgctatgctttgaagaagctcagccaagacaactggaagagaagagactacatggagagagaaaggccaygtggaggaccactggggctccacgcattgagtgaagcctttttggacttttgagccagccaactaataagaagtaaaaccaacactgtggagtggcaaacaaaagaaaatgcattttaatctgggtctcaggaattgcaattgggagacacagatccagcaaataggaaaatcatgttccgtcttggtgagattaggcagaggcttagaaggactactgtgagtttacacatctggaaggttttagcatagttcataatggatgatggctggttaacaatttagtacgtctttgatgatcaatctagttcagcatagctgtctcttgtcrgtaaaaaaaaaaaaaaaaaaaagccaatctctgcaaaatatttaaagagctttattctgagcccatatgagtgaccatggcccagggaacagtctaaaagaggtcctgagaaagtgtgcctgaggtggttgaattacagcttggttttatacattgtagggagacagaagttataggcaaagacaaatcaatacatctaaggtatacattggtttggccaggaaaggcgggacakcttaaggaaggagcaatacaggtcataggtggattcaaagattttctgatttggaattggtcaaaagagttaagctgaagacttaaagtcaggcygggcgtggtggctcacgcctataatcccagcactttgggaggccgaggcgggcggatcacaaggtcaggagatcgagaccatcctggctaacatggtgaaacccgtctctactaaaaatacaaaaaaaaaaaattagccaggcgtggtggtggrcacctgtagtcccagctactcgggaggctgaggcaggagaatggcgtgaacccaggaggcagagcttgcagtgaaccaagattgcaccactgcactccagcctgggtgacagagcgacactccatctcaaaaaaaaaaaaaaaaaaaaaaaagmcaaagtcartagaaagaaatgcttgggttgagataagggggggtgggctgtgattcttgttatatagatgaagcctcagatagmaggcttcagagagaatagatggtaaacgtctcttttggaatttcacaggtgtcagactcttagttaatctctgctagatctgggaaaagcctagctgcattaataaagatcctctacagatgcaaaatttctttctcaaaagatggcttctcaggaccatttcaaaatatgccaaagaaatatattttgaggtaaaatattttaattttcttcaaggtctgttatctgtcatgtgatattataccagttggaatttggtatcttcttaccaaagagtctgtttttgtcagtcttatgatctctattttaatattaatgctggtctgttatacctaaactttaaaagggagagagtataatgaggtacgtccaacccttccttcccatcatggcctggaatttagtttttcagcttgctctggggtcccctcggcctagacagctstctgttcagttggttgggggcttaggatataatttttggtttacactcttcaggttgatgatcaggcaaagcataaacagttcaaatcaaatgcagctggttttacaatttggcccarttacagtcagatttcatctgagggtccaactcttcatgccttctcaactcaactgttagatacctccaacaaaaccatcaaccatctccattgtggattttcttgtcagaaccccagcccatcgtctcactgaagccatcctagtgagtgaccatggctgtcaccacatgaactaaaagaaccatcaagccaagccctgtctagtgtccagacctacagaaacaggagcagtttggagtggtttattatctagcaatagataactgaagtagctacaaagataactttagcatgatttccaggcaaagtgctctctcctcagaatttgtaagattcctccaaagarcagctgtagagctgttaagtatccaatccaaacagatgggagaaaagataaagctcttgacaagctgctgtggaaaataccaattcatgttatctctgccttcctgggaacttgcaaatgaaccagccctcaaatgcagctctggatatgacaaaccatcccagatggacccctaaagktcccsaatagctttgtatctttcaaaaccacataaatcttagaatctacagtttaggttttgtttgtttgtttgtttgtcttagacagagttttgctcttgttgcccaggctggagtgcaatgacgtgatctcggctcactgcaagctctgcctcctgggttcaagtgattctcctgcctcaacgttccaagtagctgggattacaggcacgtgccaccaggcccagctaattttttgtatttttagtagagacagggtttcaccatgttkgccaggctggtctcaaactcctgacctcaggtgatccayctgccytggcctcccaaaatgctgggattacaggtgtgagccactgctcttggcccagtttagggtttatagtgtgccaaactacgagatccctyccagttctgcttatcttaatgtaaaaggacattaaatataaataatataaattatataattaatgacaattaaaattatttttaagttaattgtttttgtttttgtttgagactgagtctcactctatcgcccaggctggagtgcagtggcacgatctcggctcactgtaacctctgcctcctgggttcaagcaattctcctgcctcagcctcccgagtagctgggattacaagcgagtgccaccatgcctggctaatttttatatttttagtagaggccgggtttcaccrtgttggccaggctggtcttgaaccyctgaccttaggtgatccacccacctcggcctcccaaagttctgggattacaggcatgcaccaccgtgcccggcctgctaattggttttttaactaaagaaataatttatggagaaycaaacataaaaaggtataagacaaaaagaaaaagtcaaatggtgtcaaagaatggtgtcccagactcccaagyaggaatccttgcagaaattttccatgtttatacaataaccaccataaacattgaacatttactaygtgtcaagtactctcctaaacactttatatgcattaattcagcagaaagcaaattttttatgttaaagttacatagcaaatattttaggctttgtagagcacttggtctccgttgcaactaatcaacactttgttgtagtaagaaagcagctatagggagtatgtaaactaacggatgcagctatgttccaataaaactttatttawaaaaacaagctatagygccaggcgcagtggctcacgccagtaatcctagcactttgggaggccaaggcaggcagatcacgaggtcaggagatcgagaccatcctggccaacatggtgaaatcccatctctactaaaaatacaaaaattaactgggcatggtggtgcgtgcctgaagtcccagctactygggaggctgagacaggaaaatcacttgaacccaggaggcggaggttacagtgagctgacattgggccactgcactccagcctggtgacagagcgagaccccatctcaaaaaaaagcaaacaagcaacagccagatttggcctatggctattagtttgctaactcctgaattatactcatgtaatagtcaaaaaaaccttatgaggattattatcataacaccattttacagataaggaaccagggatagatacaaaaacagagaactcaagtaaattgcccaacaagttatcaagtagtgaaactgagatgtaatcccaggctgtctagctccagagtgttttttagacactattttttaaagcacacatgtatgcatgtatgtctttaaaatttttatttatttattttttgagatagggtctcactctgttgccccagctggagtacagtggcatgaacacagcacactgcaacctcgacctcccagactcaagcgatcctcctctctcagcctcctaagyagctaagaccacaaacatgcaccacyatgccttgctaattttttaaattttgtagagccaggtcttgmcmtgttgcccaggctggtcttgaactcctggtgagagctgaagccagctggacttcctgggttgggtggggmcttggagaacttttctgtctagctaggggattgtaaacgcaccaatcagcgctctgtgtctagctaaaggattgtaaatgcaccaatcagcactctgtaaaaacataccaatcagtactctgtgtctagctaamggattgtaaatgcaccaatcagcactctgtaaaaatgtaccaatcagcgctctgtgtctagctaaaggattgtaaacgcaccaatcagcactcggtaaaatggaccaatcagtgctctgtaaaatggaccaatcagcaggatgtgggtggggccaaataagggaataaaagctggccacccccccagccagcagtggcaacccactcaggtcaccttccatgctgtggaagcttttttcttttgctctttacaataaatcttgctgctgctgactctttgggtctgcaccacctttaagagctgtaacrccatgaaggtyggcagcttcattcttgaagtcagcaagaccatgaactcactggaaggtagaaactctggacatatctgaaggaacaaactcctgacacaccatctttaagagctgtaacactcaccacgaaggtctgcagcttcattcttgaastcagtgagaccaagaacccaccagaaggaaccaattctggacatgctggcatcaagtcatctgctcaccttggcctcccaaagtgctgggattagagatgtgagccactgcgccyggctgtgctgttttgttttgtttgttgttgttttttaatttgagatggmgtctcgctctgtcacccaggccgtagtacagtggcgcaatctcagctccctgcaacctctgcctcctgggttgaagcgattctcctgcctcggcctcccgagtagctgggactacaggctcatgccaccatgcccagctaattttttgtatttttagtagagacagggtttcaccatgttagcccggatggtctcaaatctcctcacctccttacctcaagatctgcccacctcagcctcccaaagtgctgggattacaggcgtgagccaccacgcccggcctatgtgtatttttttttttttaactcatactgtacatgctgtttggcatcttgcttttctcacttaacaatatcttgcctatctttccacgtatataaatctacctcgttcctttaatttgctgtatagtattccattgtatgaatcaccaatcaataaatacctagattgtttctgtgcattttcccttaaaagcaatgcttcactgagtatccttgtgctgaggtatttgcctgcagacgctcacacagctaagaatgaaggaaaaattattataaataaaatggttggaccaggtgaggtggctcacacctataatccccacactttgggaagctgaaacgggaggatcacttgtggctagaagttcgaggccagcctaggcagcaaagtgagacctcatctgtacaaaaaataaaattaggccgggcgcagtggctcacgcctgcaatcccagcattttgggaggccgaggtgggcggatcatgagatcaggagatcgagaccgtcctggctaacacagtgaaaccccatctctactaaaaacaatacacaaaaattagccrggcgtggtggcgggcgcctgtagtcccagctayttgggaggctgaggcaggagaatggtgtgaacctgggagkcggagcttgcagtaagccgagatcacgccactgcactccagtctgggtgacagagcgagactccgtctcacaaaaaaaaaacaaaaaaaaaamccaaaatacaaaattagccgagtgtggtggcacaggcctgtaatcccarctactcaggaggctgaggcaggagaatcgtttgaacccagtaggtggtggttgtggtgagccaagatggckccattacactccagcctgggcaacaagaatgaaacagtgtcccccactcaaaaaaaaaaaaaaaaagatcagcaacaasataaaaccaccaagggctagagggacaaattgaggagccrgtgtgaccagaggctagaagctgggtgggaagggctgtcctgcctggtgggagctgggtcatatatgagacagatgcagccgctgctgggaagacccccagatgcagaaaggggaaagaaatatgctggctctcccattcaattattcacccttcagtctcctgccagcactttccattggctgattctaaataaaagccagttagcaaaggggcttaggaactgtagtttgcagggctcagcctctgtggracagagcagagcagaagggtagggaatgggttggaaagcaaacaggaaatgactgrtgtaaagaatattgtgttttacattttgaaatactatgcagccataaaaaagaatgagttcaatgtcctttgcagggacatggatgaagctggaaaccatcattctcagcgaactaacacaggaacggaaaactaaacaccgcatattctcactcataagtgggagttgaacaatgagaacacaagaacacagggaggggaacatcacaccctggagcctgtcagrgggtggggggcaaggggaaggagagcattaggacaaatacctaatgcatgcggggcttaaaacctagatgacgggttgttgggtgcagcaaaccaccatggcacatgtatacctatgtaacaaacctgcacgttcagcacatrtatcccagaacttaaagtataaaaaaaaaaaawgccaaattgcccaccaatgcagctacaaagatttatagttccaagtatgtctattttccagcaaattccccagcaccatggagatttatccatctaagttaaaatggttttctgctattttaatttgcatttccttaattatgaatgcagttgaacatcttctcatttgtttatatgccatatttattttgtttagtatttaatgcatgctatttaatatttatttttattttaacagtaggtttatatcttttgccaattttctttttaaaaaaacttttttcccaaattcaaacgagtgtcagtagaatgccaattttcctattaagttgttggacttattacttgtaagaaatatatgtgccaatcttaagtgttgcaaatatttttccccagaatgctctttgctttttaacattttagtcacatgttttactatgctgtttttaatttttatgtagccaaacataaatctttttcttcttctatatcctctggattaaagattttgtcttttgcttaaaaaggccttttcctcaagattatacaaatattggaatggaggaatatttttaaattttcttctgtgttttctctgctctagacaaagactarccctttgggtctctttattctcccaggttaaaagctgtttggtttgagaatattctcttgtacatcctgcattctgtcctcattaatctccaaaggaatttcttaattaacgagagaaaccctttttctctcatctgagatatacaatgtagttagcttggaaactctgacaagcctccttttctatctctgagcatctcctctgccttgtcaactcttgtacgctatcaactagtctaagtttctattccaggatgtggattgtaatgaagaaggccttgaattaaaagggacttggagacaatattgaaatatgactagaggctcagttctccaatatatgcaaaagttttcttctctgcagtagagatggtgcctacaatgatttcacaattctagccggtactatgaggttcataaaaacatggtccacaaattcaggaaccatgtgtgtttgtgtttaactgytgtattcctggcattttgcatggtacatggtatggcaatgatcctcaaaaaatatttactgatttgaagattctttaagtcagaatgatttgtatcttctccagcatatctggatcctaaggggtgatgccaacaagagtcctggagaaaagtgtttctgttataacgtggcatggttaggkcctgaagtatayatttgcttatatttgctgtatacctttgtgctktgctctcttaatgatcccccaaaagctcctttcccgccttccccaggccacaatgttgcagaaaaaaagttcaagaattgctaacttgactgtgacttgaaatgattaaaatgcatgcttasaaaccagtttcttaaaccagtttcttaattcacaaagactagataaaatcacagctgggaataggaaggagatagaagaacaagcagcttgattgcaggggaaagtgaaaggaaatagagacttaaaggaagaagaaaggagaaaaagatcttccatcatgaaggctgaatgataggggaaatttttcacacamccctataaacaaacacagaatctgaggacaatccacatcccacctttgtagacatttaaagtcaccctaccttgatgaggaggaactcagatgccttgagttgaaaatggcccaactgtctgatagaactggtatttgtggtttcttttgaataaaagaaagaaactgaaagaaaactgaccctcccagtcttaaaacttgagaaagttacatttgtcttaatctgagttccttcctcatgaagccaaccatcaggcctcccagatattatcaaggaactgaaacttaccagatcactgcatctggacaatgaggagccagacccctcacccatcrtgattgcctaagcaaccacctgcttcttgttgaccaactcctcccctttacccctccctaattcttgttttcccaaaaatggttacatttcttttctgttatacaaacccttaattttaatcagtcagggagatggatttgggactgatctagaactcatctcccatctcctcagctgcagcacccaactaaagccttcttccctggcaatacccattgtctcagtgatcaagcagcagtacctagacagaacccctggcatttcggtaacagggygaataaatggatgtgcaaggaaaacctcttcatcttaaataaagggcagatgaacactaagccttaggatggtgccaatgaacacatgttgggttgtttccactttttgactattatgaataatgctgttatgaacaytgtatacaagtagaggaaggagtctaaaggcccagggaaacaagaatgatgcatgaatctgttaygaacagcctgccctgccactctgaaagacagtcatccctggaagagcctggaggacgtcccctatacccaggcattacagatgcaacagtaaggagacttgagcattcttataaaactgtgttgcagctgttctttgccagcaggagatggtggcaaaggatgttgccatggaattgaatttcctgatctcagctggaataaaggatccaggagtggtagaggccagttgcaatccttagcttgcagtgacaaggtgtcttagtcagtttgggtttagtcagtcagaataccatagatgggtacttaaacaacgaacatttatygctcaagttctggagactggaagtcctgagattagggtgccagcatggctggtttgcrgtaaaggcttgcctcctggttcacagatggctgtcttctcacatggcaaagagagtgagagctcttctctttctcttctctaaggacactaatcctatagcaggagctccaccctcatgagctcatctatacctaattatttcccaaagaccccacttcctaataccatcccattggcggttagggtttcaacttacggattttgggggaacacaaattgcataacacaaggtgagtacaattaccagagtaacccacagggatgaagtgtgtacgatcacagggtatgaactttcgggatatgtaacatcgtgtaatcagtcataagactgtaggaattaaatacaagggcagcccaaagtacttcttcacatatccaggcaatgattctaggtctagtgggcagaaacctagtttaagtcactgtagtgggaattcacacactcttagccagtttctcaaactaagctagttcagacttggagcccgaaagcacactgcaatgtgaccacaggtgtgttttgtggatcttcagtaaaacattccccagaaataagtagggccatttcccagtgtgactataaactggagacaggtaaatattttttttggtggaggkggsggctaattgattttggctctgaactgatgctaatccatggagacacaaaataaagtaagatgaaatgaaacaaaygcaacaacaacamatccagcatagtccaccactcagagtagaagtttacagaacccaggtgatagatggaaccttgaccagagtcagtttcccagtgtgtccaatggcgtgatggagccattcagtggttacttctctagtctcagaatgaayggtgggaaaaggtatatttagcaactgttctttgattgatgaagcgaggragggctattatattaagaacattcaagtgaaagcctctgaaaatcctcagatcaccaaaatagtgttcccaaagtaactctgcaatctgggggaaattcagtggcgacagttgtgcaacggtgagtgtacrtaatgccaccgaatgttacacttaaaaacggttaaaaaaggccgggcacggtggctcacgcctgtaatcccagcactttgggaggctgaggcgggcggatcacgaggtcaggagatcgagaccwtcctggctaacacagtgaaaccccgtctctattaaaaatacaaaaaattggctgggcgcggtggctcaygcctgtaatcccagcactttgggaggccaagacgggtggatcacgaggtcaagagttcgagaccatcctggctaacacggtgaaaccccgtctctactaaaaatacaaaaacaaaagtagccgggcatggtggtgggcgcctgtagtcccagctactcaggaggctgaggcaggataatggygtgaacccaggaggcggagcttgcagtgactgagatcgcgccactgcactccagcctgggcgacagagggagactctgtctcaaaaaaaaaaaaattagcygggcgtggtggcgggcgcctgtagtcccagctactcgggaggctgaggcaggagaatggtgagaaccggggaggcagggcttgcagagagctgagatcgtgccactgcactccagcgtgggcaacaaagcaagactctgtctcaaaaaaaaaaaaaaaaagttaaaatgwtaaattttatgtaatatatactttgtcacaataaaaaagtaaatgatcataaacagctctrttgttttaacttgtacatatcgtgtttctttcattttaaagtagaaacagtagctatttaaaatcaaaagataatttcaaacattgcttgttgtcattgaattcaagaagaaaactttaaaaaagaaaaaccacacaaaactctaaaaataataaggccaggcgttggtggttcacacctgtaatcctagcactttggaaggccaaggcaggtggatcacctgaggtcaggagttcaagaccaacccggccaacacagcaaaacctggtctctagtaaaaatacaaaaattagccgggcatggtggtgcacacctgtaatcccagctactcaggaggmtgaggtgggaaaattacttgaaaccgggaggcggagtttgcagtgagcagagattgtgacactgaactccagcctgggtgacagagcaagactccctctygaaaaaaataaataaataagtaaaataaataaataataaagtgtactccatatgtattcaatytgttttattttatktttrtttgtatgaacatatacaacacaaatttaaaatatataagtaattaattgtggaaaatgggatctatcgtgaggataaagcaaagttatgcaacaagatgaagcaacaaaaagtgatttttgaggatgattgcaaattatcttaagtaatttagaaagttcacaatttcctgagctttaacagcattaacaggaagcattaagaacaaggatgtggttaggtgtctattggtttgtcagaaagacatgtaacatgaaaaccactgacattaagagacaggtarcagctttaataatttaccagccttgtatttcttcacattcttgtttcagagatagtttgaaaayagtccaaaaggaagataattccaaattcctgaggattttcmccaagtgttgagtgtactatataaagtgataacagaggattatgtggatgcataacccagtggcaacgaattccattttggccgtgaactactgaacagattcactgaatgtgttcatttgctgaacaaatcttatttcagcaaatgacaaaataagatttgttcagcacatctcatgtgagtgctcacatagcgtgggctctgtggtcagacaaacastrggcacttctcttggtgttatcaccttaagctgtgtgccttggggaaagttactcaatttctcattccctccatttcctcgtgcacaaaatggcagaaaataaaggtgttgtgatgattaaatgagatactgtatacaatattctcagtacaatgcccagcacatggtgagccttcaagaaatgctatctactagtcctacgtgcaatgcactgtggagagggctaaaaatgacatgtgtggcacgagttgcagtttaatcctgtgctccacttactctaagattcaggtatgtgttgcactagttggactagtggccaggggtcagaggaaaataagaacctcccgaaaatgtcttcccttattctagaggaagacagagttaagaagaaaagctttagctcaaggaaagggcattagagttaaaatggagggaaaaaatatctactaatcagaatattctactggccacagtctctgaccttctggcaattaaaawtttaaagttaaagattactyaaaattggctgggtgtggtggctcacgcctgtaatcccagcactttgtgaggccgaggtgggtggatcacaaggtcaggagttcgagaccagcctgaccaacatggtgaaaccccgtctctactaaaaatacaaaaattaaccaagcgtggtggtgggcatctgtaatcccagctactcgggaggctgaggcaggagaatctcttgaaatcagaaggcggaggttgcagtgagccgagatcatgccactacactccagcctgggcaacaagagcaaaactctgtctcaaaaaaaaaaaaaaaaaaaargattacttaaaatttacttggaaacttaaaagtgcaccattaagtaactcctgggaccaagcagatgtcatgagaaaaattaagaaatatttgccacttcatcagttataagacaaaaaaawwttttttttaaattttaagacatacttaaattgagtgataatgaatgatatggttgggtctgtgtccctgcccaaatctcatgacaaattgtaatccccaatgttggaggcggggtctggtgggaaatgattggatcttgtacgcaaatttcccctttggtgctgttctcgtgatagtgagtggattatcaggagatctggttgtttaaaagtgtgtagcacctccccactctctctattcctcgtgctctggccctgtaagaygtgcctkcttctcttttgtctttcaccatgattgaaagtttcctgaggcctccccagcatgcttcctgtacagcctgtggaaccgtgagccaattaagcctcttttatttaaaaattacccagtttccrgtggcacacacctgtaatcccagaactttgggaagctgaggtgggtggatcacctgaggtcaggagttcaagrccagcctgaccaacatggaaaaaccccgtctctactaaaaatacaaaattagccaggcatagtggcgcatgcctgtaatcccagctacttgggatgctgaggcaggagaattgtttgaactctggaggcagaggttgtggtgagccaagatcgtgccactgcactccagcctggtcaacaagagcaaaactccgtttcaaaaaaaaaaaaaaagaaaaattacccagtttcaggtatttctttatagtagtgcaagaatggactaatacaatgaaaacaccaaacatcaggctgggtgtggtggctcatgmttgcaatctcagcactttgggagcctgaggtgggaggatcacttgaggccaggagttcaagaccagcctgggcaatatagtgagacccaattgctacaaaaaaawttaaaattagctgggtgtggtggcaagcacttgtattctcagctacttgggaggttgaggcaggcaggaggagcacttgagcccatgaatttgagattgcagtgagtatgatagtaccactgcactccagcctgggcaacacagcaagaccctgtctcaaaaaaaagacagttctaaaaaatgaacataaggtataaacaccaacattcaacatgtacacacacacacacacacacacacacacacacacayacacmygcagttggccctctgtatttgtgggttccacatctggggattcaaccaaccacagataaaaaatatttggaaactaaaaattccaccctgcgcttctggacctcagcaccagccccagggctgctctaggggccacatggctgaagggagygcaaggagctaccagaggcagaatgaagagactgaagcaatgacagccacttattttgaggaattacgtgtcattgatgactatgccaaaacattttgtrttagaattagtgatgatattgattaccccaaatggacactttgctcataggtgatgctactgaattaatatacaggtacagctccacctacttattagtaggtaagactcttggcttaaaggacaagaatgtgcagatttatcaaatgggcttgagaaaatacaattcagaatattggtgaaagtattctttacctgtgggtggagaaaataagagatgctcggccacgcgcagtggctcatgcctgtaatcccagcactttgggaggccgaggtggacggatcacgaggtcaggagatagagaccatcctggataagatggtgaaacyccatctctactaaaaatacaaaaaattagccaggcgtggtggcacgcacttgtaatcccagctactcaggaggctgaggcargagaatcgcttgaacccgggaggcagaagttgcagtgagcagagatcgagccgctgcactccagcctgggcaacagagggagaaaaaaaaaaaaaaaacaactctaggggaatggaaatacctgatttccattccatttcattgagacactcacactgttaaaggaatattgccttttttttcttttttcttttttgattatataaatagagatgcgtctcaytatgttgcccaggctggtcttaaatactgggactcaagtgatcctcccacctcagcctcacaaagtgttgggattacaggcatgagccwttgtgcctgacccattttttgttttgttttgttttgagacagaatcttgctctgttacctaggctggagtgtagtggcgcgatctcagctcactgcaacctctgcctcctgggttcaagcaattctcctgcctcagcctcccaggtagctgggactacagatgcctgccaccacatctggttaattttttgtatttttagtagagatggcatttcaccatkttgcccaggctggtcttgaactcctgacctcaggtgrtccacctgcctccagcctcccaaagcactgagattacaggcatgagccaccgtgcctggccctgtctggcctttttactgctttttatggcttattgaaatagcttgtattagtcctttctcatactactataagaacacatccaagactgggtaatttagaaaggaaagaagtttaactgactcacagttcagcatggctgaggaggccttaggaaaytgatgatcatggtggaaagggaagcaaacatgttcttcttcacagggcagcaggaaggagaatgagggtcaagtgaagcagcaagctccttataaaactatcaaatctcgtgagaacttactatcacaacaatagcatgggagaaactgccaccatgattcaattacatcccaccgggtcccttacacaacatgtggggactatgrgaactaaaattcaagatgagatttgggtgcagccacagccaaaccctataattctgcccctggcccctctcaaatctcctgtcttcacatttcttttttctttttttttttytttttttttttttttgagatagagtmtcactctgtcaccaggctggattgcagtggcacaagcttggctcactgcaacctccacctcctgggttctagccattctcctgcctcagcctctgcagtaactgggactacaggcgcatgccaccacacatggctaattattgtatttttagtagagacggggtttcaccatgttggccaggatggtctcgaactcctgacctcargtgatctgcctgcctcagcctcccgaatgctgggattacaggcatgarccacactgcacctggccgatgataaacctttgaaagctaaaaagcaaagagatgattgcagactaactcagaagaactgagaaagctgaattatgtggcaacagtagagaaaaattgaaaacagaaatgattatattgtagaatcacaaacagacccagatcttctacctgctctcatgctgctggatgactgtttctccctagtttcagcagaagttggagtctgtggactgggaaacatcaagtacagctgagagctttgataccaaacaaaaatggaggtttacacaatcacatgcttgctgattgctaagcccctgcctcctgcctcacagccttcatcaatcatttagtgcccaaaccatgtcagccagatctttaccctctaggaaggggattgtcacacctttctctcaggaatcaaagcagcccaagaggaaagaagagaaactgataagattacccaacaaataaatggccctacagtaaactcagaaatacaagagctctccatatactgcaaacttccaatcagctgtagtccttcattcctcatcgtaagaaaccaaaaattaccagaactctaaagtaagcctctatcatgcaagacaaaaagcacacaagcagggaaagcaccttggagaaacagaatactatgtggatgaaagaaaactaactcatgttcagtcaaagcttctcataaaagaccaggtgccggttgggcgcggtggctccctcactcactttgggaggccgagggaggtgtatcacaaggtcaagagatcgagaccatcctggctaacatggtaaaaccccatctctactraaaatacaaaaattagctgggcatggtggcggtcgcctgtagtcccagctactcaggaggctgaggcaggagaatcacttgaactcagggggtgcaggttacagtgagccgagagcgccactgcattccagcctgggtgacagagcgagactccatctcaaaaaaataaataaataaaagaccaggcccrgtggcttacacctgtaatcctagcactttaggaggctgaggcgggcggatcacttgaggtcaggagtttgagatcagcctggccaacatggtgaaaccccgtcggagtgagactctgtctcaaaaaaaaagaaagtttctcataaaagagcagcaaagaaatctgttatggttaaaacatagaacaaacaaataacaaataacaataactaaggaagcttagtttattagaaatgtgccaggcaagggagatagtgagcaaatggagtcagtcaaatggacgccgagtagctttaacatttgagttttatacagtttcactgaggaggcgttagccaaaggatgcttttagggcggggataacaagagttgggggaggggcaggaaggaagggtagagttagggcaggaaagaattggtcaaaagttgcaaagttgagtcactgactgtgtygataggctaggcaaggctgtctgtgaaaaagtctgtggttttgtttcctgaacacctgggtccaagctgagctgttgctgacatagtttatctgtcttgcaaattgtggtctctgtactgtttttcaagttgtggtttctgtagttttccatttctcagtcttgagaaagataagataagaaaagatactgcattctgaaaacaagaacaagatgttattttgtaaaaagaggaacattcagagaacaagaagaaattttagacgttaaagacatgataagaaatgaacattttaatgaagaattgaaagataaaattgaggaaattacacagaaagcgtggcaaaaagacaaggagataggaaatgagagaaaaaaggtaagaaaatttatgaamtctatgaagttcagcagccaaataatagaatttccaggaagagtaaaacagaggggaagaaatcaacaatgaaatagttcaggctgggcgtggtggctcacrcctgaaatcctagcactttgggaggctgaggcgggcggattgcctgagctcaggagttcaagaccagcctgggcaacacagtgaaaccatgtctctactaaaatacaaaaaattagctgggtgtggtggcatgcacctgtagtcgcagctacttgggaggctgaggcagaagaatcgcttgaacccaggaggcggaggttgcagtgagctgagactgggccgctgcactccagcctgggcaacagggygagactccatctccaaaaaaaaaaaaaaaagaaatagttgaagaaacacactcagaatagaagaaccaaattgaaagtgtccatcataatagatgaaaattgtcctgcactaaagcatatgattgtgaaatgtaaaatatctaggacaaacaggagattctmaggcttccagaaggggtagaagggtggcacaaaagggtggtgggggagtcggaattggattgggtttctcagcagcaacacaggaataagaaaagaaacaaactaaaagaggaaggtgtggctttcttttcctccgggacacagaaggtcgtccttcctacctactggctgccctcgggggcaaccccttgcccagcaccaaggaygtcaagaagatcctgtacaatataagcaataaggccaatggcaaccagtgcagcaagatcatcagtgagctgaatggaaaaaacattaaaggtgtcattgcccagggtattggcaagttgccattgtgctctcccacaaggctgtggccgcctctgctgccccggctctgtagctcctgctgctggccctgcccctactacaaagaagaagaaacatgagaagaaggagtcccaagagtcacatggtgacatatgatttgacttcctgctcccctgccaattcccctggaaagaaagaaagaagggagggagggaaggagggagaggaaggggagtgggggaggggaggggagggaaagggaagggaatagaagaaacaggagagacgcaaagtgatggcgaaggaaaatcacaggatcaaaaacagcaaatgtagaaagcaactgatccggactgggagaggcataactcaaaagacaggcatgttggggatttgttatccaccatttaaaaagataaagccattcttagcccatgggtcatacaaaaacaggctgcaggtcagttttctgaccccgatctagtcaataaaaaagaaacaggatgaactgacactaatttctggaaagaaggaaggaaggaggaaaggaggcaggaaggaaaaaaaagaagaaaggggccaggcgtggtgtctcacccttgtaatcccagcactttgaaaggccaaggcgggttgatcacgtgaggtcaggagtttgagaccagcctgggtaacatggtgaaaccccgtctctactaaaaatacaaaaattagccgggcatggtagtgcacccctgtagtcccaactactcgggaggctgaggcaggaaaaacacttgaacccgggagtcagaggttgcagtgagcctggatggtaccaytgcattccagcctgggtgacagcaagactccgtctcaaaaaaaaaaaaaaaaaaaagaagtaagaagtaaggaaagaacaaaggaaggaaggaagcaagaaggaaagaaaaagaaaggaagaaaagaaagaagaaagaaaagaaagaagaaagaaaagaaagagaaagaaagaagaaaagaaaggaaggaaggaaggaaggaggctaggtagaggtgtgaccctggtattgataaagagataggggagtggtcaaaggcatttccctacatcatactgtaaggaaaattcctgggtgagcccacagaaacgacaggttaatccaaattataaactgagtaatctcattgtagagcctttgcataaatccaggatacctagttatccaatagtctccctggccagattgccaaagctttcgctgctctgggtcttcttcctcattgtagtccctgtcatcagggtttccacagcactcaactcattctccaagctttgactgcagtattcttcaggatacatcatcaatcatcttccctctgccttgacatggtgcttggcactgtgacccttgacacaatgttaagtgccttgacatattgctacactccccaaataagacttacttcaagtgaatatacattagatatctgcaggaaaaatgaagaagagcaagacagcaaccatcmcttccctttaagaattcccttcaagaacaaggatttttctccatataacaagaatgtgattgcaaattgcttcacaaaaaagtaatctggcagagctgtaatctccactggcctctccaaaaagccacaaataaaatagcctttgatatagacaataaattgtaaatatcagtagaagcttccttagaagctatcttgatgatagacactgacttttttgtttatttttatttatgttatttccattgcattatgtggcaaaatatttcacattaatctaaccatcagtctgctttctatcactatatacaatatttgccttttctaaaattttataaatgtggaatgatatcgtagaatcttcggtgtctggctccttgtatttagcataatgctttttttttttttttttttttgagacaatcctgctaggctggagtgcaccagtgtgatctgggctcgctgcaacctctacctcccaggttcaagcgattctcgtgcctctgcctccagagtagctgggattacaggcgcccaccaccacacctggctaatttttgtattttcggtaaagacagactttcaccatgttggccaggctggtcacaaactcctgacctcaagtgatccaccccactcggcctcccaaggtgctgggattacaggtgtgagtcaccacacccagctgtcttcagcataatgctttcgagattcatacatgttgtgatgtgtattggtaggttttttgtttgtgtgtttctattttgttttggctcacaaacagaaaaatctaaagtagctctttttggtaagtagctttgcattgtatggatgtaaaacagtgtatccattcaccagttggttgtttccagttgggagatacatactatgaaaaaaactccaatgaacagttgcacacaagtctttgtgtggacatgttttcatttcttttggggaagtacgtaacagttggattgctgggtcatgtggtaactctgtctttcacataatcagaaacyaccaaactcttttcaaagtattcataccactgtggtttgtgtccctccaaaactgatgttggaatttaattaccatggcgactctattaagaggtgggaccaggctaggcatggtggctcacgtctgtaatcccagaactttaggaggccagcgcaagaggattgcttgaggacaggagttcaagaccagcctggtcaatgtagtaagaccccatctgtacaaaacatttaaaaattagacagacatggtggcacacacctgtggtcctagctactcaggaggctgaggtgggaggataccttgagctcaggaggtcaaggctgcagtgagccatgatcatgccactgcactccagcctgggcaacagagcaaaatcttgactctaaaaaaaaaaggggaggtgagaattttaagagacagaccttaagccctcatgaatggattaatcttttcatgaattaacagattagtggggttatagtggaagggaataagttatctcaagagcgggtttgtgataaaagccagccttgcactcttcttatcctgtgatgccttcacatgttatgacacagcaagaaggccccctgcagttgtgactccttgtccttgaatccaagcacttgccagtttccagaactttaccaaatacatttcgtctgggtgaggtggctcacaccggtaatcccagcactttgggagaccaaggcgggtggatcacttgaggtcaggagttcaagaccagcctggccaaatggtgaaaccctgtctctactaaaaatacaaaatttagccgggcgtggtggtgcctgtaatcccagctacttgggaggctgaagcaggagaatccctttaatccgggaggtggaggttacagtgaaccgagattgcgcggctgtactccagcctgggtgacagagtgagaccccttcttaaaaaaaaaaaaaaaaaagccagtctctgtggctcacgcctgtaatcccaacactttgggaggccgaggtgggcggatcacgaggtcaggagattgagaccatcctggctaacacagtgaaaccgccgtctctaytaaaaatacaaaaaattagctgggtgtggtagcaggtgcctgtagtcccagctactcgggaagctgaggcaggagaatggcgtgaacctgggaggaggagcttgcagtgagccgagatggcgccactgcactccagcctgggcgacagagcgagactctgtctcaaaaaaaaaaaaagaaagaaagaaattttgttttattataatttacccagtctagggtattctatgatagcatcagaaaatggactaaggaacataccattttcattcttaccggcaatgttcctgatgctccaaattctcttccacgcctgatattgttagtctttttaatttgagtcattttagtgggtgtgaagtatagtttttattttcttattattatatttccataagttattgcggtacaggtggtatttgggggggtgtgaagtatatttcctcatggttttaattcacatttccccaatgaccaagtgatgtggagcatcatttcatgttggttttttgccattcacataacttatttggtaaaatgtatgttcacatttctctcttgttgttgatcattcttgccaaattttgtgtagtcttttaaaataactgctttgttccttttactttggatttattttctgtttttctgacttattataaatgattacttactaatataagtcttttaagtttatacatttattttttgtttgtttgtttttgtttttgtttgagaccgagtctcgctctgtcgcccaggctggagtgcagtggggctatctcggctcactgcaacctccgcctcctgggttcaagtgattctcctgcctcagcctcccgagcagctgggattacaggcacctgccaccacaccgagccattttttgcattttttagtagagacagggtttcgccatgttgcctaggctggtctgaaactcctgacctcaggtgatccgccctcctcagcctcccagaatgttgggattacgggcrtgagccactgcgcccggccaagtttatacatttctttctacacactacgtagctgcatcccacagttgtcatctgtaatactttttttttttttttgagacagagtctcgctctgtcgcccaggctggagtgcagtggtgccatctcggctcactgcaagctccgcctcccgggttcacgccattctcctgcctcagcctcccgagtagctgggactacaggcgcccgcccccacgccyrgctaattttttgtayttttagtagagacggrgtttctccttgttagccagtatggtctcgatctcctgacctcgtgatccgcccgcctcggcctcgcaaagtgctgggattacaggcgtgagccaccgtgcccggccgtcatctgtaatactgtttattacattcaaaatgtttaatttgtgtctttcttatttcctagcacataaaggaaattttttagctttttttattgtttatttgtagcttaatagcattatacataggcataccttattttattgcacttcattttatcatgctttctagattgtatttttgttacaaatcgaaggtttgcggcaaccttgtgttgagcaagtatatcagtgccatttttccaacagcatgtgctcacttttgtgtcgttgtgtcagcattttttactgataaactatttttaaaataaggtatatttttagacataatgccattgcatactaaatagactacattatagtttaaaaataactttatgtactaggaaaccaaaaaaaattgtgtgacttactttactgtgatgtttgttttattgcaatgatctggaactgaacctataatatctctgacatgtgcctatggtcagagaatgtcctcattttaattctgtcaattttcttgagatttgatttacagacaatctgtcttcaattaataaaaattttgcgtgcttaaaaagaatgtgatttttgcagttgttagtatagcgttctatgcttctaccatagtaaatatgtaatcatgtttatcaaatctactcgatgaacattttctgtcaattattaattttcaaatyctccaatatgattgaatataaatttgtctgtttcttcttttttttttttttggagatagagtctcactctgttgccaggctggagtgcagtgacgcaatctcggctcaccacaacctccacctcccaggttcaagtgattctcctgccttaacctcttgagtagctgggattacaggcatccgtcaccatgcccggctaattttgtatttttagtagagatggggtttctccatgttggtcaggctggtctcaaactccygatctcaggtgatctgcccacctcggcctcccaaattgttgggattacaggcatgagccaccatacccagcttgtttcttcttgtgatgtttttgctttatattttttttaggctatgtttatatgtttacaacctatgtatatatgtttataacctatgaatatatcttaataaacctatgtgcataagtttcagtctatgtacataggtatgtctatgtacatagaaaagaaacccacacacagacataaaatggtgaaatttcagaacaacaatgacaaagaatgattataaaacagcaggagagaaaggagattatcttcttttttctttttgagacagagtcttgttctttcacccaggctggaatrcaatggctcgatctcggctcactgcaacctccgcctaccgggttccagcgattctccctgcctcagcctcccaagtagctgggattacaggcacccaccaccatgtccagctacttttttttttgtatttttagtagagacggggtttcaccatgttggccaggctggtctcgaactcctgacctcaggtgatccacccaccttggcctcccaaagtgctgggattataggtgtgagctactgcgccagcaaggagatcatctcaaaagaagctgagttagtgacagctggcttaaagacaatgtaagctggaagatagtgaaatgttatcttcaaattgctgaggaaaagcaactgaaaatttggaattctaaacccaattaaatttttttttttttgagctcaatctcagctcactgccacctctgcctcccaggttcaagtrattctcttgcctcagcctcccgagtagctgggattacaggcatgtgccatgatgcccaggtaatttttgtattttttatagagacggggtttcaccatgttcaccatgctggtctcgaattcccgaccttgtgatctgcccgacttggcctcccaaagtgctgggattacaggcgtgagccacctctcccggccctaaaatttgttttaatgaagacaaaataaaattgtttcagacaaataaaactcactctttcgccagcaaactctccctataggaaaaatctaaagtatatattttagctagaaggaaattgatcctaaatgaagctacaagaagaaacaacatgtaaaaaagactttgggtaagtataaaatattaactataaaacaatgataatgtttagtaatakttaaatttgaaagaaaaaagataatattaaaacatatgacaggtctgtgttctggaggagataaagaaatagattaactttgtaatttaagtaatcacaatgcagcttatagggtaacaaccaaaaaaaatcaacccaaaaaacaaaaggcaaaaaaagcatctcaaacctgaatagagtatttaacttccaaactagcaaggaagaatataattaataccaaaaaagagtcaaaaaaaaaaaataggaaggccaggcatggtggctcatgcctgtaatccaagcactttgggaagccaaggctggcagatcacttgaggataggcgtttgagaccagcctggccaacatggcaaaatcccgtctctactaaaaatataaaaattagctggggatggtggtacacgcctgtaatcccagctactcaggagactgaggcaaaaggatcacttgagcccggaaggcrgaggttgcagtgagccgagatcacaccattgccctccagcctaggtgacagagcgagactctctctcaaaagaaaaagaataggaagtgaaagatagtataaactagggcaatagattttttgagactaatttcattaaaggtaaataaactaaatgccttagtagttgtctcagtcagtttaggctgctgtaacaaatatatcataggctgagtacttaaataacagaaatttatttctcacagttacagagactggctgtttggggtttgtttttctgtttctttttcagaaacaggggtctcactgttacccaggctggagtgcagcggcatgatcatagcttacggcagccttgaactcctgggctcaaatgatcctcccacgtcagcctcctgagtagctaggactacaggcaaacaccactgcaaccagctaattttaaaaccttttttgttactgtttttttttgagacccaggctggagtgcagcggcaagatcttggctcactgtgacctctgcctcccaggttcaagcaattctcctgcctcagcctcccaagtagatggaattacaggtgcatgccatcacgctcggctaatttttgtatttttagtagagacggggtttcaccacattgaccaggctggtctcgaactcctgacctcgtgatccacccgcctcagcctcccaaagtgctgggattacaggtgtgagccaccgtgcctggcctcatttccccacttctacataccatctgccatttcatttgggaatatgctgacgaatacctgacacgamccatcrccgacttctctaatcacttcctacagccaggagactgggttctggtaaaagatcccagtcctctcctcaatcctcccctcacacttaaatggaatgggtcttaccagatcatctttactacacccacttaagcaggaaaaaaaaagtttcttgtactaggctaactcactttgaggctcagcgataggcagggctctggcagggctttgatagccctgtctgcagagccagggccctcaagggatgagccccagagcctctccctcccatcttggagcaggggtgagaaaaacaagtttttctcctctttcagcttccccttccccccttaccattctcataattattttgcaaagttttgtaagttcctgtttttccttctgtataaggtcacaagatatgtttaagttgcacaatctgtcactgtttcacaaactgcctttgttctgcttctgtaagcctgcttgcccgccctacaggttttgcaccatcaaactggtgagcccctttttggatgcaygtatagccaacccccttttggatgcatgtataaaagtcaagccctgtctttgttcggggctcagcctttggatgttaatcctctgggctggtacacacctaataaatcctcctgtcccacccattggtctcttctgtcccttgattcctgcaacaccacaggagcaaaaccccagggactccccagctggtttcattatacatctctcaagacaacagacttcactacataccaaaacaaccaaatcaaaacccccttcagccttctcttgtgtctccacaggacccacttcccttcgcctcaccaaatcctggaggaaaaggaagagaaatttacataagctgctatgtctctttctctctcaaactttcattgcttcccaaccaatcttgttacagacctttattgrtaccattatgaaactcccattatccatcctgatcagctccttactattctatgggacttacggcttcaagsaattttccaggactttactcctactcaaataacctttttctccttttgcttgtttctttcaatataaattctgtaatcacatcaaccttaccaatacaaccactcctcactgctctcaaactggaatgctctataaaccttacacaatccctcatgctgcaagctaactcttcctttgctccagaatcctggatgtgcttatcactgtcttcctcagcctatacagcccttcctacaccctttcatgaccttttaacaggaaacataaccataatctataaactccaaaaaggagcttccttttttgaaagagctgacrccctggtaggtgattatgccccttccagggccaatcaagccaacaaatcatttcaaacctattacaactccctacaatgcctcaagccccaaggccctcccattgaagggcccataactaaacacaccgcccttttacaacaagcctcactttgcttttcagcctgtgagggaaatttccctgtagggtccttaacacctaaccaatgcactatcattgttaaacacccctctgaccatcacactaaccgagttgactatcacatatcacctgatgcaaatggggcatttccacaactggctcgttttacagcctctccctcaaccgatgcctctgacctaatttgtgctgtccctagtgcccrctktattcatggctcaatatcaatggtgcaacatctgattgtattaaatgtataaagaataactcttcctatatctctactatagtggatgtctctctggcctcctccttgtccatctggagtaatgaaccacaggaaagaaaaracacttcagccttaattcacttgctttctttccatatctctgcctatatttacaacaaggcttattttttattttattttatttttttttttgagacaaagtctcactctgttgcccaggctggagtgcagtggcacaattttggctcactgcaacctccacctcctgggttcaagtgattctcctgcctcagcctcccgaatagctgggactacaagcgtgtgccaccaagcccggctatttttttttttttttttgtatttttagtagagacggggtttcaccgtgttggccaggacggtcttgatctcttgacttcatgatctgcctgcctcagcctcccaacgtactgggattacaggtgtgmgccaccgcacccagccaagtcttattatttttatatggaaccagtacatatctttgtctccccaccaactgtaccagaacatgtactctagtttatctttctccctgcattggactaattcctcctagtcaacctttgcccattccatctgcccaatatgttaggaagaggagggctttccatgtcattcccttgatggccaccttgggtataaccgccggacttagattgggagcaggcagattggccacctccttaacatactttaaagctctttcaacagaactacagcgttctttagaagatacagcccaaagtcttataagagtccaagaccaactagactgcttggctggagtaatcctccaaaatagagggggactagatcttataatggctgaaaaaggagatcttaaatggcctctgcctctcgttggatgaggaatgttgcctmtacctcaaccaatcaagcctagtaagagatgctgctgaaaaacttacagaaagggctaaaagactaagggaataccaaaacaaccaaatagattgttggttttggaacaaaatcacaacatgggtcatcccattcctgggccctctcctaatgatgtgcctaggactaatgtttttaccctgcctaattaacctttttcaaagatttttaactgacaggatcatggccatttcacagacaactacccaaaaacatctacagacagcattagtcctacagtcaatctgagatcaaagaactctccgcactcctccccttagcaggaagtagccagaaagaacacaccgccccttgtccttytataactataggatctggattgacagagcaagagcatcaccatcttggacaaacactgccattttaagttscccttgattaaaaaaygcctaatccagccccagaaacatcaccctaatggcyaatgtcagcatgaccattaaatgacacctccaaccggaaayrttccaaccccaagataaatccccctccgaccagaaacatgccaaccccacaataaaactctcctccacccagaaayattccaaatctgcgataagctctccctccctaaacccttaaatattcttagtctataagagagaaggccccgacctaaaccagccagaatcccctctcaggtttattctccaaaatacacttgtctgtgattattgagcccctttttgtgtttctttcttcttccttaaacccttacagttgtattgattatagaggcaatagtggatcatagaactatgccttgtgttagttacagagactagagtagcttgtcctggcaagactgttgctgactagctgcgtttcagacattgagctgtctctgattagttggtttttgaagacattttcaccaaagcaagctgccattgatttcagtgggttaagccagttctgctacttacttgttactatggctgtagaacttttcckaataacataaagactttttaatattcagctctctatcttaaggatattaaccatttgtcatcttgtttaaatttttgttctctatttgtcttttaatttgaggattctttaaatgtaaaaatctatrgtttgtaaaatctccttaccatctttttttttttttttttgrgtcattttcactcttgttgcccaggctgcagtgcaatggcacaattttggctcaccgcaacttccacctcctgggttcaagcaattctcttaccttagcctcccgagtagctgggattacaggtataccccaatatgcccagctaatgttttgtatctttagtaaagacagagtttcttcatgttggtcaggctagtctcaaactcctgacctcaggtgatgcacctgccttggcctcccaaagtgctgggattacaggtgtgagccaccacgcccggccaccatctttatactttctatttttttggtttaaaatctttcattattcatagcatrtgatgagagactttacactctatatcattctcattttcaaagcaaccatagactatattgattcataatagttttatgtctatgtatcttgcttccccaaagattccaaactccatgaagccagggtttaaasaatttttactgcctacatcatatattatggtgtatgtgaggtatgtgaggctgcagtgtaaggcctgaactggaatggtaataagtaagactgggaaaaaaaatagaccagccagtagggtatgagtttggaagggttgatgtaaaccaaggacaagttggatgtgggaaaagactcaagaagaggtaactgaggcaagatggttgaaatataaagattggtcatataaaaacatcccataacaagtaaacttaataaatccctagggaggattaggaaactgaggacttaggttgcagctttatttaatggctacttctgaagttagtggacaaaagccaccataattaacatgcttactctagggtggtccttaaagttacataaatccccaagccatacctaggacatcctcagggtaatcaaaatcacaaggtgttttcctttccccaaaagattttcaaaaaaagtatacatttcatattaagttattgccatccatttgttttttgtttctgagacagagtttggctcttgttgcccaggccgagtgcaacagcatgatctctgctcactgcaacctctgccttctgggttcaaatgattctcctgcctcagcctcctgagtagctgggattacaggcgcccaccatcacacccggctaatttttgtattttttagtagagacggggttttgycatgttggccaggctggtctcgaactcctgacctcaggtgatccaccgccttggcttcccaaagtgctgggattataggtgtgagccrctgcgcccggccattgccgttacttttaatgtcaaaaaccacagttacttttgcaccaaacccattaaaaggcagcattgttttcacccagacttctcattatgtgagataaattttttcatgataatgaaagaaagaggaggaaggaagaaaacagggagagaagggaggaaggcagacaaaaagaagaaaaaaggaaaaggcaagtagcctagaaatgaaaagtcatattcagtggcctgacaggtatgaaggaggaagcacagagtctgggtttccttgagggcttccagttaagggctaaatgtataatgctgctgttcagggatgcaaagatatttagaggccacctagttcaaccccatcgagaccatcctggctaacacggtgaaaccccgtctctactaaaaaaatacaaaaaaaaattagccgggcgtggtggcrggtgcytgtagtcccagctactcaggaggctgaggcaggagaatggcrtgaacccaggaggcagagcttgcagtgagccgagatggcaccactgcactccagcctgggcaacagagcgagactccacctcaaaaaaaaaaaagaagagacaggccgggcacagtggctcacgcctgtaatcccagcactttgggaggccgaggcgggcggatcacgaggtcaggagatcgagaccatcctggttaacacggtgaaaccccgtctctactaaaaacacaaaaaattagccgggcgtggtggcgggcgcctgtagtcccagctactggggaagctgaggcaggagaatggcatgaacccaggaggyggagcttgcagtgagccgagatagcaccactgcactcccacccgggtgacagagcgagactccttctcaaaaaaaaaaaaaaaaaaaaaaaaaaaaaaagagattmctactctgttgcccaggctggagtgcagtggtgtgatcacagctcactgcagtctcgaactcctggcctcagtcagtcctcccacctcagcctcccaaagtagctgggactgcagctgtgcacgaccatgcccagctaattttttgaaaaaattttttgtagakacaggartctcactatgttgcctgtctttggkttggattaatttgctaaagcagctcacagaactcaggaaaacacatttaccaatttattatgaaggatattacaaaggataccgaggaagcaatgcatagggcgaggtatggggcaaaggatggagagcttccttgccctctctaggtgcgccacactccaggaacttccacatgttcagctattccaaggctcgcagaaccctgttctcttgttatgtaagtttcagtacgttcagtacgtaggcatgattgattaaatcatttgcctttggtgatcaacttaamcttcagcccttctttgctccctggaggttgaggggtggggctgaaagtcccaattcttattctgaygttggtttttgaggtaaccagaccccactgaagctacctagaggctgccaaatttaagtcaactcgttagcatacaaaaagacacatcactttgaagattctaaggaggccgggcatggtggctcacgcctgtattcttagcactttgggaggccaaggcargaggttcccttgagcccaggagttcgagaccagcctgggcaacatagggagacactgtctttattttttttaayaaataaatagtttttttaaatgaagattctaaggattttagaagttgtgtgcccagaaacaagatgaagaccaaatatacatttcagagaaatcacaatacttaatgctgaattattgtattaagtagattggaaatagtgaatttatccttttgtcctatatatttagttgtgatatatataacataaaaatttgccattttaacaatacttaacaacttaagtattgttaaaatggcaaattttttttttgagatggagtcttgctctgttgcctaggctggagtgcagtggcacgatcttagctcactgcaacctctgcctcctgggttcaagcaattctcctgcctcaacctcctgagtagctgggattacaggcacacgccaccatgcccrgctaatttttgtatttttttagtagagacgggtttcaccatattggtcaggctgatcttgaactcctgaccttgtgatccacctgcctcagcctcccaaagtgctgggattacaggcatgagccactgtgcctggcctaaaatggcaaagttttatgttatatatacttatcacaactaaatatataggacaaaataataaatcaggaaacacaatggaaaagtttccttacaatagcaggagaaactagactacctacaaagactgcataaaactgtatgattgtataaaaagatataaacaaccaggtgcaatggctcatgcctgtaagcccagcacttagggaggttgaggcgcgaggatcacttgagcacaggagtttgagaccagcctggacaacacgatgaaatcccatctctactaaaaayacaaaaactaggccaggcatggtggctcacacctgtaatgccagcactttgggaggcttaggcgggygaatcacgaggtcaggagttcaagaccatcctggccaatgtggtgaaaccctgtctctactaaaaatacaaaaattaactgggcgtggtgtgcgcctgtaatcccagctactcaggaggctgaggcaggagaatcgcttgaatccaggaggcagaggttacagtgagctgaaattgcaccactgcaccccagycyggcaacagagcgagagtctgtctcaaaaaaaaaaaaaaaaaaaaattarctgggcatggtggtacacgcctgtaatctcagctactcaggaggctgaggcaggaaaactgcttgaaccggaactggggaggcagaggttgcagtgaactgagattgagccacggcactccagcctgggctacagagtaagactctgtctcaaaaaaaaaaaaaaaagaaaaagaaaaaccagctgggtgtggtgggtggtgcatgcctgtagtcccagctacttgggaggctaaggtgagaggatcacctgagcccaggaggcagaggttgcagtaagccaagattatgccactgcactccagactgggtgacagagcaagaccctgtctcaaaaaaaaaaaaaaaaaaaaggatrtaaaagaacacctggataaatggagagacagtctctggatcagaggactcaacataaaattaaaaattaaaaacaggaaaatctcttccaattaatctatgcattctgtgaaatacaaaggaattcttaacagtatttatgcatacacacatatactatagatagatatatagataatagatagagtgaaaagaaatccaaaatagagatgattatgtcagaggtctctaaaaaggagccaagagggcataaggagttgggagttgaaccccagtcacgtacacacccagaaggaatttgacctctttgaactgagccaaatttaaaacttctttaagaarcagctgyatttgatttgaactatttacaccaggtctaatcaccaacctcctgaggagacaactgtgctgaattaagctcattactgcctagagacatacaagctgtcaatcaaccattgtcaatcatggattgtgctaaaattttcaacttgtgtaaacttgcaagaaacctttataagcccctgcccagtcttgtctgaatggaacagatttgtgtctcctaaattgcaagtcatgaaagaccccaattaaaataccttttttttttttttttttttytgagacagggtctcttgctctgtcacctagcctggagcacagtgacacaatcttggctcattgcaacctccacctcccaggctcaagtgatcctcccacctcagcctcccaagctgggactacaggcatgcgccaccgtgcccagctaattttattttttgtagagacaatgtcttactatgttgcccaggctggtctctaacccctgggttcatgtgatcctcccacctaagcctcccaaagtattgaaattacaggcatgagccatcatgctgggctaaaatatcttctcttttgtttgctgatccacagcgttggttttatttcttattagtttatattacgtggtgtcagaagtgggatacagagcagttccctcttgatctctgatgccaccatggacccaagcaaaggtacctgcaggacgcttttgcactccattgatcttgatagcyctggaattcactgggtgagtcctcttrtgttctaaacctcctgacatggttcagattgaggccttttttcaggtgttttctgttgccacttttaattacaaggatggcttcattgttttggggagtgtctcaaataagaacctatgagggaaagaaaaaaattatattttctcctctacaatttgrcaactcagttgggaccaatagagacactccactcactccaagacctataagtggaatcctgggagaacttgcagaagccaatataaataggtaggatttttatgaaagtcagcttctcccagacttctttttttttttttttttttgagacagagtctccccctgctgcccaggctgtagtgtaatggtggcgtgatctcggctcactgcaacctctgcctcctgggttacagcgattctcctgcctcagcctcccgagtagctgggattagaggcacctgccaccacatccagctaatttttgtatttttagtagagacggggtttcaccatgttggccaggctggtcttgaactcctgacctcgtgatccacctgcctcggcctcccaaagtactgggattataggcgtgagccactgcgcccaactagcttctcccagacttctatttgtggtacctggtcaagagaggaaggtaaaaaatttccctgtttcttcttttccaggttcagattggcaggaaaaaaaaattacaaataaaaaacaattagttttttgaaatgtgactcttgtgaatctgcttcaggtactgttggttattgttctttagtttccaaagatggtctttatttcccttgtcgctctctttttgtagggcttctcataaggaggaaaaatcataagattctcctttcatcctgcttaatttcttgagaagcttggctttgtcaccagcaaatttattctccagtctctaccacctcagagagcgtacattgttgagcttatgtcagatggccagctgtgagtccagccgggggtctgaaatgtctgttttttcaaatgtgtcatctctcagggaaatttgtcttaattgtctcaaccttcattgccttgataatgagggtctttactttcttaggctatcttcagaagaaatttcagatcttgaggggaactgcatacttgcaccctcttcaggcataatttatgcatctgattatataccataaaaaggcttacaggttttgagtcccagttagaggtatacctttggaaatttattttgttttgttttgtttgagacaagctgcagaggttgcagtggcacaattacagctcactgtagtctcgacattccaggctcaagtgattctcccacctcagcctcccaagtagcagagacttatacatgcatgtgccaccatgcctggctaawtttttaaaaaaaatttttgtagagatggctttctcactatattccccatactggtttcagactcctggactcagagatcctccagccttggcctcccaaagtgctaggactataggcatgaaccaatgcacctggccaacctttggaaatttggactgttaacggctaaaacttttttttctggagagttctcctttaacacccgcagaaaattctttaaatgttcaaattgcctgctcaactttgctgcaggatttactaaagtcactccagcattttccaggcctttctcagtcctttggagatgtaaaccttaccatgtttttgaaatgttagcatttagggaattagctaagcagcattccakcgagattggatttgaaacagagctaaagttctccggaccaaccaaaaaattcctttcctcaggggatgtctttagctcaggggagaaacatttataagaattagcttggttaattgttttgaatttttggtgtgactcttgaggttttggggtgcccatttgtaattctttccacccccatgggcagcttttgttttcctcttttagtgactgtctcttctcattgtctgtctgctgggcacacaagggaaggtctgcctttgtggaaggtctggcagacactgggctgaaaagctgaggccatagagaatatggtgaacaaatgtggggttgcaccccaattgttgctagggaagctttctctaagctgtccttgggagggtctggatcctgtaagggctgctaacttttgctccctctttgggaaacttgattaaagccaagttttaatgaagggcttggtttaaaagggcttcttggtttgggtctcctgtgtgtttatttgtgttggttttctcatttgttcaggtatacctttgattttaaacatcggtttatattttaaatataaaatatttatatagtttatatttaaatttatgaaatttataaatttatgaaaactttttgttcctttgtttgttcagccttctctcctgagctaaatggaaccacatactcaacaagtttattaaaacatttcaaagacaacagctttaaatagtgattattctagtgctgggcatggtggctcacgcctgtaatcccagcactttgggaggctgaggcgagcggatcacttgaggcctggagtttgagaccagcctggccaacatagtgaaatcctgtctctactaaaagcacaaaaattacccaggcatggtggcacgcgcctgtagtcccagctattcaggaggctgagacatgagaatcacttgagcctgggaggtggaggttgcagtgatctgagaccgagccactgcactccagcctgggtgacagagttgtctcgggaaaaacaaacaaataaataaaatagtgattattctagacctctaataggcaaatatacccccacccctgcaaaaacaaacaaacaaaaaacaacaaaaacaaaaagcttcttcttggtgcaaatttcagaaatgaagccaagaaataggaatgtttgctatttgtccatctaaaatctggtcaaaagattttttttaagagctctacagtcaaaatcgacttttgacttttgactttttagagcatgagaatcccttgaacttgggaggcagaggttgccatgaaccgagatcgtgcccctgcactccagcctsggtgacagagtgagactctgtctcaaataaccaaacaaacagagccaaaagtatataagcttaaactcgaatttagtaattaatgtcttagcattatatcttatttggaaatgacctagatattcaatgactatccrtaatttaatttagcttagcaaaattctaaaggtaaccattttttattactgtatgttaggtaaatatcataaaagtaagaaacttaaagttaaatacatgcatgttttgctgacaactcaggagacataattgtttttattaaaccaacaatattaaactagccttgtctaccaaaagatttactaaagtcacataaacttaaaaaatatttcaacttatttatgagcactcatttatttttaagttaatttggtaccatgtagacaatacacaaacatatgtatagacatataaatacatgtagatacaacatatatcatacacatgtatgtgyctatttggctttgtttctttgtttgggacatggtctcgctatgctgtccaggatggcctcaaactcctgagttcaaatgatctttctgcctcagcgacctgagtacctgggattatagccatgtgccactatgcccaactcacatgtatgtatctaaaagccaaaaggatcaaggttaaatatgaaaaagagtagagagttagacctgagaggaacctatccacccacagctcttggggctctacgaggaaaacagtgatcctcccacccccagaaaaggaatmtgtggccttcaaggggtcctcaaggagacccaggactgttataagtcttcrttaccagctgggctcagtggctcatgcctataatcccagcactttgggaggctgaggtgagagtattgcttgaggccaggagttcaagaccagcctaggcaacacagygagaccctctttctacaaacaattaacaaaaattcaataatattaaacaaaaataataaaacatagttgttagttgccctcatgtggtagcaaaggtggcaagaggaaggagggatataaatggaagaacaagtcttagaggagccagtttgaggtcttgttcccaaaaagccaaataaattttacattatccttggcaaaattaatgtcaacaagaaaaaaagcagagaggtggagcacatatagtcagctggagtttaagaggagaggaattcaggctgggtgagatggcccacactttgggagaacaaggtaggaggattgcttgaggccaggagttcaagaccagcatgggcaacrtagtgagacgaagtctctacaaatatatatttttttgattagccagcatggcagcatgcatttataatcccagctatctggaggctgaggcaagaggatccctcgagccccagagttcgaggctgtagtgaactatgattacaccactgcactccarcctgggtgatagagtgagaccctctctctctcaaaaaaaaaaaaaaaaaaaagatttatatgtattatatatgtataaatacatagcctaaatatcaacttttacttaaattatacaggaggtatttcattgtcaaataagaaataacgttttaccttcttgaagttgtatttgtataaatgcatttttaatatgtgttccaaaattgtataaaatttctaaaaagatctgatatatcttggtatgtgttatcagtcataattctaattattgtgttaaattgttgacaccacagaaataaccatacttccttatcagttccatcattaatcatgactattctcttttgtcatccacaggcaattgttattttaccttgtttttttttttttttttttttttttgaggctgagtctcactctgtcgcccaggctggagtgcagtggcacgatctcagctgactgcaagcgctccgcctcccgggttcatgccgttctcctgcctcagcctcccaagtagctgggattacaggtgcctgccaccacgcctggcgaattttttgtatttttagtagagactgggttccaccattttggccaggctggtcttaaactcctgacctcgtgatccacccgccttggcctcccaaagtgctgggactacaggcgtgagccactgcacctggcctaccttgatcttgattctcttcaaaaggtggtttataatcagctacagtctaaaatttgctttttttttttttctttggagacagggtctcactctgtcaccactcaggctgraatgcagtggtgtgatcatagctcactgcagccttgamctcctgggctcaggtgatcctcccacctcagcctcccaagtaactaggaccacaggcgcatgccaccatggctggctaatttatttttatttttttgtagaaatgaggtctcactatgttgttcagsctgctctggaactcctgggctcaagtgatctgcccgctttgaycttgcaaagtactaggattacaggcataaaacacgacatgcagccccaaatttgctgcttcttcaaggaaattcatgaaaaaaaaccataacaagcattcttgaatacagattttttataatttttgagatcataccattggactaggtaaaaacttccagaactctratgagtaaactaaagtgttcatgaagattcctaatccgacatcaagaaaaacaagaattaattacatgggactcaactgatgaagaattgaaattttttatgagttctttttatctgaagcattccacattctttatattttgttcttcagagtcaaggaaaattttattcttctttaagctatttatagcttagatcaattgggtaaagtagacttttgtgagcagaattgaaacatttgcatttctgtctacctggtcccttcagaatttggaaaccatttgtgattaatcttcttttatggcaatatagtcatttgcataagttcartaacaatttgctgtctttgtaggaagagacattagacccaacaaaactccttagaatccctagcatgtgaaagattagataatagaagagtttcagattatttactcagtgctcaaggaggagtctgctatatccaacacctcttgttctgcttgggtaaataaaaaattcaaggctgggtgctgtggctcacacttctaatcccagcactttgggaggccaaggcaggcaggagttcaagaccagcctgggcaacatggtgaaactccatccctaataaaactacaaaaattagccaggtgtggtggtacacacctgtagtcccacctactagggggtgctgaggttggaggatcacttgagcctgggacgttgaggctgcggtgaactgagatcccaccactgcactccagcctggtgacgaygtgatagcctgtctcaaaaaataataataawaaaaaaattcaggtagtactggaaacctcgaagattccaagattagtcagatccttaaaaggtataccttctggtagtctttttaattgggttaatcttgaattttctgatcttttttgtttgcttcctacagttattggaaatattttaagatctgggttccaacttatcctgttattcttgtttgtgaccctagtcatgtttatcctcgttaaactatattcttgttaaatggctttgaggtagtcttgttgcctgaggtattacctggagctctttgtctcatgaccaagaagagtaaggaatgtggacaccaagggtgagtttagagcaaaagtttaataagtgaaagaggaaagctctccactgcagagaggggacctgagagggttgccatttcacaattgagtacaaaggctgttatgaggaacccagaggaaccagatgggtctgggcatttcatttgcataactgaaattgcataagttgtgaatttctggtagctccaccctgtacccctagtgtgctsgctgactggtggttgtctttagaaaaggcaccacttagaaaatggcatgatggtgtaaaggaccaactggagccttggctcacaaccagcctagtgttggagtgatgattcatagaggtttggctcacagtccaaagtatgcccaaaaaaggaaaggaatgtactcaccacagcccaccatctacatgcccacaraaggaaaagaaactatttcctggaaggctgctgcttacacaaagaacaaaggtgcttctatgttgggccttgcttccttatctgtgcagctatgggtatatcctaggcaagctgcctgtgctagtkcccttatctgtatctgtagcctgagttttcaggttgttcctttgtytgaaagaattctacwgagcacctgccctaaccgccttcctagctggttctttcttttctcctctctcagcttgatgccacrctgttgctgtcaacgaaactaaaattatggtggctcaacacattgaactgacagatyaggcctacaatcatgaatcctaccctaaccacatatgtgcaccacaattggggcccacatcctcaactcctccttgttgctcaaatttggactattccatttgacacagatcatccactatcattacyatgactccctcctccatgggacatgacttcctgggacaaatctattccagaaccaaagggcttactgaaataattgatctcagtggtttctaaggaaatatttaaatmaaaaggggaaaatctgaaaagaaatccaaaatggagatgattatgccagaggtctctaaaaaggagccaggagggcataaggagttggacccccatcacccatatactcagatgaaatttgacatgttcaaattggaccaaatcacaaacatcctaaagaagcagctgaatttgatgtgaactgtttacactgggcctgatcacaaatctcctgagaagacagctgtgccaaattaggtcgttcatcaccaagagacatctaagctgtcaatcagccattgycaatcatagactgtgctaaaattttccacttrtataaacttgccaggaacctttataagcccctgcccagcttgtctgtatggaatrtgatttagctgcttgctcgatttgtgtctctcaaattgcaatttataaaagatctcaattaaaataccttctctcatatgcttgtctgcagtgttggttttacttcttattagttgccaatagataaaaaatggacatgcacaaaaattgattctatatttatctaggatgaattgttcaataaatagtattgtgacaactgagtagccagctggaaaacgagagttgaactcctacagcttaccttccattacagttaattctaggtggctcaaagatgtaaacattttgcaaagttgtaaatccataatgaaaacmaggaaaagatgtacatcctcttcccaagcatgctaaagtcttaagcaggcattacataaaataggaattacaaatagcaaacagttaaagctgttatcccccatagtgaagaggaaagccacaaagttatctgtgttatccaccagaatgactgagtttattttatttatttatttatttattttatttttttgagacagagtctcactctgtcgcccaggctggagtgcagcagcgtgacctcagctcactgcaaactccaccttccgggttcacgccattctcctgcctcagcctcctgagtagctgggactacaagcgcccgccaccacgcccagctaattttttgtgtttttagtagctgggattacagttgcccactatcatgcctggctaagtttttttttttttttttttgagacagagttttgctcttgttgcctgggctggagtacaatggcatgatctcagctcactgcaacctctgcaaaayacaaaaattagctgggtatggtggcatgcacctgtagtcccagctactcgggaggctraggcaggagaatcgcttgaacctgggaggcagaagttgcaatgagccaagatcacaccactgcactccagcctggcgacagagcgagactccatcttaaaaaaaaaaatatatatatatatatatattttaagaatgtccatttcacctttgcaaaagccaaaagatagaaacaactcaaatatgatctatagaatatccatatagtgatacccaagaagctagaatattagttgcctttggagaagcaaactggatggctgagatgcagaattgggagtgtgattaatttttccttttattcttttgaccatgcctagattctaccagttaaaaataatataaattattaataaaaacatgaagagttgattaacatacatcacatattttgagtacagggataaatatgggagacatgctgtcccagatatcaaaatataaagctatcaaaacattgttggccaggcgtggtggcacatgcctacaataccagcactttgggaggttgggggaggagactggcttgagcccaggattgtgagaccagcctgggcaacatagtgagactctgtctcaaaaaaagaagaaaaaataacattgtcatatttaagcagggacaaattggccactgaaaaagaataaggtccagaaatagactcaagtgcatatgtatactatatagcaacctaaagtttcctttcaaattgtggggaaagatgaactattcaacaggtgctgttttgtttgttttcaagaaaaataaaaatccttacatcatatcaaataataaatacttttggtggcagggcaggggggatttaaaaattttaagccmaataaagatataaagctaacagaaaaaaaattttagaaaatactttcataacttccaagtgagaaggtatgtgtgtataaatatataccttaaatatgtatactctatgtatatttaaagaaaatgtataccaattctgtaaagaggtaaatgataattgcttgatttttttttttttttttttttttttttgagatagagtctcactctgtcgcccaggctagagtacagtggcgcgatctcagctcactgcaaactccgcctcccgggttcatgccattctcctgcctcagcttcccgagtagctgggactacaggtgcctgccacyrcgcccagctaattttttgtatttttagtagagacagggtttcatggtgttagccaggatgatctcgatctcctgacctcgagatcyrcctgcctcggcctcccaaagtgctgggattacaggcgtgagccaccgygcccagccaattgcttgatttttgataccatgccagatcattttccaagtccacttgcccgaatgtcacactcgtaagaaatgataagtatccatgtgggattggttctaggatccaccctcagttaccaaaatccacggatgcttaagtctcttatgtaaaattacatagtatttgcatatgacctactcacatcctcctacacactttaaatcatctctagattacttataatacataatacaatgtaaatgctatgtwaatagttgtaattctgtattgtttagggactagtgacaagaaaaaatagtctgtacatgttcagtacagaagcaatcttttttttttttttaagagacagggtcaggcgtgtatacaggcggcacatgttaataaactgtttcggccaggcacggtggatcatgcctgtaatcccagcactttgggaggccgaggtgggcagatcacgaggtcaggagattgagaccatcctgactaacacggtgaaaccccgtctctactaaaaatacaaaaaattagccgggtgtggtagcaagcgcctgtagtctcagttactgggaggctgaggcaggagaacggcgtgaacccgggaggcggagcttgcagtgagccgagatcgcaccactgcactccagcctgggccacagtgcgagactccatctgaaaaaaaaaaaaaaaaaaaaagacggggtctcagtctgttgcccaggctggagtgcagtggcacaatcatagctcactgcagcctcaaactcctgggctcaagcaatcctcccacctcagccttctgagtagctggaactccacaccactgtgctaggcctcttttttggtttggtttttggtttttttgagacagttttgctcttgttgcccaggcaggagtgcagtggcacaatctcggctcactgcaacctctgcctcccacgttcaagtgattcttctgcctcagcctcccaagtagctgggactacaggcgagtgccaccacgcccgactaatttttgtatttttagtagagacagggtttcaccatattggccaggctggtctcgaactcctgacctcgtgatccacccacctcggcctcccaaaatgctgggattacaggcgtgagccactgcaccccgccaattttttgtattttcagtagagacagggtttccccatgttggtcaggctggtctcgaactcccgacctcaggtgatctgcccgcctcagcctcccgaagtgctgggatcacaggcatgagccacckcgcctagcctgttttttgtttttttgagacagggtcttgctctgtcacccaggctggagtgcagttttgcagtggcatgatcccggctcactgcagccttaactgctcaggctcaagygaccctcccrccacaacctcccaagtagctgtgtcccacaggcacacaccacagtgcctaatttttttattttctgtagacatggagtctccccatgtactcaggctggtctcaatctcctgggctcaaatgatcctcccccatcttgttctcccaaagttctgggatcacaggcgtgagccaccgcccccaactrcttttttaaaaatattttgatctgcagttggttgaatcctcaaatgtaaaacccacaaatatgragagccgacaagaaccaacatctgacgaaggtacagaaaaactactgcactactgctctataagattagaaattaatctgtaaacattgatacattgttaggatgcttttgccacctgatagagacattaattccaaatgttccaggtctttattgycctgagaaagttaagcaatcttataactaatttagcaaatttgtgtaaggattttgcctttcaatatgaatgtatgttcaaagacaaaggtctggaaagatatgcacaaaataaaattaaacagtggttatttctggggaggaaagtaggaaattgaatttttgcaactttttgtacttttgtatttttcagaagttcttgtttttaaaatgtcaatgtaaaagcacacacacaataaatgtctccatsaactctttgtccacgactagagaaatggtttagtaaactatatttcttttccttggaaacatattcaatcattaaaattatgtttataaggattacattataacatgtaattaaagaaagggaaaactatgcacagaaaagttataggaggaaaaacaccagtgcattaattatattgataatattttatttttttaagtattcttatctaatgagaatgtaacatttttgtaataaggaaaatgttagtaaaaacaaaacacagcatgtttcagcatgccctgactcttctttgaggatatgtgatacaatagattggccttttgtgacttttacaaaaggttgtagtttttgttccctccacacttaagaattttatctcacatcatgaatatctgacttctggctttttttttttttttttttaaggtaagcaagctaacatttaaaactgtgattaaataagagtatctttcaaggtttggctaaggagagctaacatttccgtgctgtgctgttaatcaaaggaacttcttcagctggttttgttttgttttgttttgagacggagtttcgctcttgttgcccaggctggagtgcggtggcaggatctcagctcactgcaacctctgcctcctgggttcaggcgattctcctcctcctgggttcaggcgattctcctgcctcagcctcctgagtagctgggattacaggcatgcaccaccacaccgggctaatttctgtatttttagtagagacggggtttcaccatgttggtcaggctggttcctttttaactgaaacatgtcagagaggaaaaattttcctcaaccctcttatgttttgtaactgagggcctgcaaattaaactaataaaagacatagtaacaggagaaaaggcacaccatttttattaatatttgcatgcaaaagagttctcaggaaagaagtagttagacttgcggttttatgtacctttttaacaaaggaaagagggtttgagcttcaaggaactaattgtggggcactgagtaggaaacatgggggaattaatggaagataagggctattttagaaagatctgtttatgcaaattcatcttggtgttaattcccatctttggtaaaaatcactcttctctccctggtactgggtgggtggggaagcaccttcctcaatgggaaatttatgccctgcttttaggctctgtcacccaggctggagtgcagtgacatgatcatggctcacagcagcttcgacctccagggttcaagctatcctcccgccttagcctcttgtgtagctgggaccacaggctagcaccaccacactcagctaattaaaaaaaaaaattttggtggagatgttcccgaaccgaaccaggcctggctgtatgttctcacagcccaataatgagatgcagatggactgggaaagaagggagtttatttctgtaactggatacagggagaagatcagagattattcgccagaccaactcaaggtattacaattcttcccatgctcatacatgtttggactacatgcctacgtgcagtatcacatttgcctaagtttatcagtaattaattttgcttcaactagaaggtcagaggccaaaaatgccytctaaatctacctaatccgtgagggtcctcgtaccagggtgattaagaaatgtctcctaaatttacttaaggaggatcctggcaccagagcaattacttctactttatcttacctacggtttggtcctaagagttgctccagaccctcctccttaaaataaatcgtttcaaggactgtctatgttaccttgactcgccccagatgtcaacccgagacagatcctggtacaaggaatgtaaggctgtctccattatcttgacgtgctccaggttttaggagaagcctgtgcaaggcacttactgaacatatatttcatttctggttctgacgtccgagcattgattttccctagacttaattgttagcccaatattaaggcaagcgctgtggaaattcatctatgtaaatggagtgctatggagccctgtctgtgtgactgtcagggagaactggcctgccacagatatgaggtctcactatgttgcccaggttggtctcgagtttctgggctcaagtgatcctcctgccttggcctcccaaagtgctcggattacaaacatgagccaccgctcccagccacctgcatctcctgattctcaattaccttcagctcaaaattttcctatgacaatgtgtcatattttggggtcgcatattcagatccccttcaaacaaagatgaataaagtcaaaacacctatggggtaaaaattcctcattctgaaggcaccaggtaaagattatgctctttggagagacaagatagaaactgccattgcaaaattataactgagaaaattatgacagtaaaggagatctgagctaaccaactccatcttgcttcaagctatccaatttgactcctgggtgtacgtagaactaactcagggaggaactcaatttatagtttaactttccccaaacaaacttccttcctgcttggggactagactgcctttgtaggactaaaaaattcgccacgagatcagaaattatggtttaggagttatgcagctggaggctacaagattctgactgtcctcaaatttctcctggggataacattactattgtaaaacataagattagtgcttgagacattttgcagaccgtacacttgatggatcagctggcactaccyagcttggtaaactggctcatctaatcttgtagcccccgcccaggacctgactcaagcaaaaggacagctttgactccctgtgatttcatctctgacccaaccaatcagcacttgcaacccactggcttccccacccaccaatttatccttaaaaactctgatcaccacgaggtcagaagtttgagaccagcctggccaatgtggtgaaactccatctctactaaaaatacaaaaatcagccatgcatggtggagcacacctgtagtcccagctactcaggaggctgagtcagaagaattgcttgaacctgggaggcagagattgcagtgagccgagatcgtgccactgcacttcagcctgggcaacaaagtgagactccatctcaaaaaaaaaataaaaaataaaaaacaaaactctgatcaccaaatactcgaatgcttggggagactgatttgagtaataataaaactctgatttcccacacagccaggtcttcatgaataattctttctcaggctgggcgccatggctcatgcctataatcccagcactttgggaggctgacacaggtggatcgcttgagcttaggagcctgggcaacatggcgaaaccctgtctctactgaaaacacaaaaattagtggggtgtggtggtgtgcacctgtggtcccagctacttgggaggcttatatgagaggatcacttgaacctgggagatggaggttgcaatgagttgagatcatgccactgcactccagcctgggcgacagagtgagactgtcgaggcagcgagcaaggtgaacccactgggtggttacaagatggcacagagtttataagtagaaattctcttgactgcacagctttccatagtctagcaatgtgcccttgggaaaatgtattcatctcttygagctcaatgtcttcacctgtacaatggtgttctggtgaagatcaagtgagataaggcacacttagcaaaatgcctggcacatggcacaaaattttgtattcctcttcagatgtttatttcataagtrtatggamtcctactatcagtcagtttgaccagagaaacataaacactatgagtaacagagtatggtttacgatagagattatgaggatttatcatagggattagagtatagacagttgtgggagctgttggagaggtctacacaaggctgtcgccttgggttgtgggttgtgtagggtctgaagtcacccaggctggcagtcaggaaggctgaatgtaaagtagggaagagcaagacttgggatccatatggatagactagaaatcacaaggacaagcaatgacattgggcgacctgcaggagaagctgttgccctctgccacagaaccacccaatcacctggcccaggtctaagaaaagctgaaggaggagatatggtaggagcttgaggggccgtggataccaccgtgtagggaaaactctccctaactgtgtttttcccctactctcacacctcaacaatcaacacagaagacttctgtggccatgtgttgtgtggtttttttttctcacataccaagctgtgaagagcatgtgggtaccctctaattctgatgctatctacccagagatagtgtcagatgctacaggttgagggctcagtacccaagactgccccctcacacaaaccaatcacaagcctgcgcctctggaacttctgactggcttcaagttgaggttcccatgaccccctctttgggttcaattaatttgctggagtggctcacagaactcagggaaacacttactgatgtttacctgtttattatagaggatattgcaaaggatatagatgaagagatgtgtagggtgaggtttgggggaaggggcatagagcttccacaccctccctaggtgcaccatcctccaggaatgtccgcgtgtttgctatacagaagctccctgaatccagtcctcttggattttttgttcrtttgttttgttttgttttgttgagatggagtctcactctgtcgcccaggctggagtgcagtggcatgatctcggcttgctgcagccttcgtctccggggttcaagtgattctcctgcctcagcctctcaagtacctgggattacaggcacgcaccatgacatccggctaatttttgtatttttagtagagacagggtctcaccatgttggccaggctggtctcgaactcctgacctcaaatgatccgcctgcctcggcctcccaaagtgctgggattacaggcatgagccactgagcccggaccctcttgggtttttatggaagcttcatgatgtcagcatttcttcccccagggtgtacaagggtcttaagacccacaatcagaaaggagggaaacattagtgtcctgccttgaggcaggtgaaaggagggcaagagaagctcaaaggcccgcctccgaggtctgacacaccccatattacaacaagactgtaccaaggcagggaccatggatgaaaaccaatatacatcataatgccaccctgccccaccccagcaaggccagctagggaatcagcaacaataacgcctcactgcaataacgcctgccactatagccttactttcagcacaaagaaaatggcagatgcttcacttgtggcttctaaaacttgttcatgtttcttctgtggtcaactgcaactcagaatcattcagggaaggaagctgggacacttagtttgaatttatcyaagtcgacagagtacaaagccatcacacttttgtattacttataaccctggctactttagtctgaaactaaaaacttggaggcaaaaaacacacagcataacattcagactttttaagcccaagacttttattttgaaattcggggacttcttttttttttttttttgagacggagtttcgctctgtcgccatctcggctcactgcaagctctgcctcccgggttcacgccattctcctgcctcagcctcccgagtagctgggaccacacgcgcccgccaccacgcctggctaattttttgtattttttcagtagagacagggtttcgccgtgttagccaggatggcctcgatctcctcatctcgtgatctgcctgcctcagcctccgaaagtgctgggattacagacgtgagccaccacacccggcccgaaattcggggacttctaacagcaaagccagttaccttctcatttctgtgagatgaattcatagtgaaggagtgaaggatgtgccactccaaaatctgctgaattagtatactgattatttaagctaaagacactttagaaactgtagttgcagaaagggcgagctagccaggcatggtggcacacgcctgtgccacagctactccgaaggttgaggtggaaggatcacttgagcccaggagtttgaggttgcagtgagccgtgatcgtgccactgcactccagccttggcaaaagagtgagacactgtcaagaagaaaggaaagaaagggccaggtgcggtgggtcatgcctctattcctagcactttgggaggccaaggcgggtggatcgtttttgagctcaggagttcaagaccagcctgggcaacacagtgaaaccccatctctacaaaaaatacaaaaattagctgggtgtggcggcatgcactgtggtcccagctactcgggaggctgaggtgggaggattgcttgaacccgggaggcagggagacacaggttccagtgagtcaagaccatgccatgctgctgcactccagcctgggagacacagcaagaccctgactcaaaaaaaaaaaaaaaagaaaaaaaaaagaaaaagaaaagaaagtgagagagaaagaaaaaaagaaagaggtagctgacctgtccttttctacctgttacaatccataaaaattcctttgaggagaatgcttctttgtaccagggtgagaaaacaacccctatctccagagactgggaactgatgctccaacaggcctgtataaataaacttactaaactaacccttatcttccactagctttacacctctccataaatctcctagtgactgccctagaatttactactccggcccagatccctttgtcttgtcatttcttcacaaatttatcattctttatctgaaaagtaaaaaatcttcctacttttgtcatttctttgagtcttcactctcttgtgagggtccccatgtacatgcaaaaattaataaaacatgtatgctcttctctttttgatgtcttgtgtcaatttgatttctggaccctacttaagaaagtcctacttaagaactaagatgagtagaggtgacttttaggccctcctacaatagttcagaaaacaacaagtatggtggtggtgctggtagtcctagctacttgggatgctgaggtgaggaatcacttgagcccgggagtttgaggttgcaggggagctatgattgcaccactgcacttcagcctgggcaacagagcaagaccctgactcttaaatttaaaaaaaaatttgtttgcttcaaaagatgtaattttgaatgaattatatatcgcactaaatagaaatttgttcagataaaaactatcaaactcttgtgcagatttggcctgagggatggcgggatctgagcaaatctcagtgggttgtgacagcgtgtgtggcttgatagtttccytgtttgattctcacatagtgcccmcccacagacagcttttttttttttaaagatggagtttcgctcttgtcaccctgctgggttcaagcgattctcctgcctcagcctctgagtagctgggattataggcacccgccaccacacccagctaatttttgtatttttagtagagacggggtttcaccatgttggccaagctggtctcgaactccagacctcaggtgatctgcccacctctgccttacaaagtgctgggattataggcatgagccactgtgctgtgcccagccaatttttgtatttttagtagagacagggtttcaccatgttggccaggatggtctcgatcttctaacctcgtgatccacccacctcagcctcccaaagtgctgggattacaggcgtgagccactgtgcccagacagcagagtagtttcttgatggccaggggtgctgtcttaatttggaactggctggaaaccctgttgctgatcatctgaagcttgatggtctctaggcgagagaaaatgaatttggttaaaagatttaatgggaatttcaggggtggatacctatgctgtcagggatattataggaatgaattaaaacattctgttggccgggcgcagtgtctcacacctgtaattctagcactttgggaggcagaggcgggtggatcatgaggtcaggagatctagaccatcctggctaacccggtgaaaccctgtctctactaaaaatacaaaaaattagccagggttggtggtgggygcctgtagtcccagctactcaggaggctgggcgtgaacccaggaggcagagcttgcagtgagccaagatcacaccactgcactccagcctcggcgacagtgcgagactccatctcaaaaacaaaacaamacaaaacaaaaacaacgttctgtttaggccgggcgtggtggctcacgcctgtaatcccaccactttgggaggccgaggcaggcgatcacaaggtcaagagatcaagaccatcctggccaacatggtgaaaccctgtctctactaaaaatacaaaaattakctggacgtggtggtgcgtgcctgtagtcccaggtactcagaggctgaggcagaagaatcacttgaacccgggaggcggaggttgcaatgagtggagatcacgtctctgtgctccagcctggtgacagagcaagactccttctcaaaaaaaaaaaattgtttaattactacaaaggaagtgattccaaccgtttgaaagatggaaatcaatctgcaaaaaatataaaaacatggctactgttatccagcctacagtaacgatgcaacaaaacaccaaggaaaattggtaggcttcttcttctcttttggctgccttctaaacaggtacttcagggcttccacaggttcacagtgtagtggatgatgggaacttcaggttccaggtctggggcttcaggtatcgcagacttgatccttgaaagatgtattgaacgatctaatcccagtcctttgaccacagaaggtgtggccattaccactgaaaatggtcctttccatttgggttgcaattgttgagcaggtgatccctccttgcatgttttaacaagtaccttatcctgacttgattttgggttactggttagttcccagtatagggagcctttgagttccaaacttttgtaaagcctgctgaaattgacctaggttagctaggtattttactaaactggctgtttctgaatcagtaattagatcattagtgaagaatgcccttccgtataacatttcctatgagcttatattaatttctgctctaggggtattacaggtccttaagaaggctatgggcagtaggctgaccaaagtttctaatgtttcctgacatagcttagataacactcattttagagtttgrttagccctttctactttcctggaggattgaggccttcatgctgaatgtaaatagtatttgattctatgatggctaatattgagtgtcaacttgattgaaggatgcaaagcattgttccttggtgttatctgtgacaatgttgccaaaggagattaacattccagtcaatgaactgggaaaggcagacccaccctcaatctgggtaggcacaatctaatcagctgccagtgcagccagaataaaagcaggcagaagaatgtggagggattagactggcttagcctcccagcctacatctttctaccatgctggatgcttcctgcccttgaacatcagactccaagttcttcagctttgagactcagactggctgccttgcttctcaacttgcagacggcctattgtgggacctcaccttgtgattgtgtgagtcaatactccttaataaactcccctttatatatacatctatcctattagttctgttcctctagagaaccttgactaatacagattttgagagccttagcaacactgtgagttatttgggagataaaggtcaggccattatcactttagagactctgaggtaacctaaacttagggattatttctttttaagagaaactttaggctgggcgaggtggctcacgcctataatcctagcactttgggaggctgagkggggcagatcacctgaggtaaggagttgagagcagcctgaccaacatggagaaaccctgtctctactaaaaaatataaaattagccaggcatggtggctygtgcctgtaatcccatcactttgggaggccgaggcaggcaggtcaccagatgtcagaagattgagaccaatttggccaacatggtgaaaccsmatctctactaaaaaaatacaaaaattmgctgggtgtggtgacacacacctataatcccagctactcgggcagctgaggcaggagaatggcttgaacccgggaggtggagattgcagtcagctaagatcacgccactgcacttcggcctggcaacaaagcgagactccatctaaaaaaaaaaaaacttttatcctctacaagctggcacatgggtgaagtctaattgccagtcttcccctggctaagttcctctcctctggactagttctattaggggaggcattttgtgtcccgggttattaagtgcacccagtgagcagacttgacagacctgctaagttaggcccaatgaagagcctgttaaccatggccagggtggcatctctccccatatggaaggagtcaagcagggtttttacaattctccattgggctgtttgagggagatatgcttttgatcccatataccaccaggatccttgtttttgtcccccsctccgttattaactctacagtgtgtattcaggttctattgggaaatcatagaaaggaagtagtgctaggatctgttgggattgcaccctgaggscttcagcttttgcttctctatcagcctttctgttcctttgtgccataggagttaagttcctttgatgccccccacaatggattatagctacggcctttggcaggtgtattgttgctaataactgaataatttcaagcccatgctttataggacagtgtttgctagttagtagtagtcctctttctttccagattgtagcacgagcatgaaccacaaagaatgcatatttagaatctgtatagatgttaaggtttttcctttgtcccagcattaatgctccagtaagagcaatgatttcagccttttgtgctgatgtgccagggggcagtggctgggcttcaataatggtgttgtgatttactattacatatccagctctgcactccccatttgacacaaaactactgccatctatgaaccagtcaccctcagaatctggaagaggctgatttttttttttttaagacggagtctcgctctgttgccaggcttgagtgcagkggcatgatcttggctcactgcaacctccaactccctggttcaagcgattctcctgcctcagcctcccgagtagctgggattacaggcacccaccaccatgcccagctcacttttgtatttttagtagagatggggtttcaccatgttgtccaggctggtctcgaactcctgacctcaggtgatccacccacctctacctcccaaagtgctgggattacagatgtgagccactgtgcctggctgtgtccctttatctctaagactgactttacctgattgggggttagaacttccagcagttggcccaggttgattttagtggcttcctccactaacatagcagtggctgctattgcccgcaggcaacttggccatcaggaggccactccattcaacttctttgaaaagtgggcagttggggccaggcatggtggctcacgcctgtaatcccagcactttgggaggcagaagtgggcagatcacaaagtcaggagttcaagaccagcctggccaacatagtgaaattctgtctctactaaaaatacaaaaaaaatagccaggcgaggtggtgggcgcctgtaatcctagctaytcaggaggctgaggcaggagaattgcttgaatctgggaggtggaggttgcagtgagctgagattgtgccactgcacaccggcccctgcaacagtgtgagactccgtctcagaaaaagaaaaagaaaaagaaaaagaaaagaaaagaagyaggtggttggtctgggttctgatcctaatttctgggctagtactcccatagctatggccctcttctctgctacatacaaggagaagggcttagttagctctgggatgccaagagygagagcctgggtaagggcctgttttagcttggcaaaggcttctctcatttctggggcccattccattagctcattttcaggcccccttgttgcttcatatagaggctttgctatgagcccaaaatttggtacccatattctgcaaaacccagccattccccaaaaagaatgaagctgctgcttggtgttggaggcagggctcaaaccacatatggtcygtgctcattctggggatatttgccaggctccgggtgttaagacatatccaaaatattggaaccattggagggtaatctgagccatctttgtatcccgtattccaggaaattcaaagtttgtatagtattttggtcagaagccacccaggttggctacgcacaagaaggtcatccacatactagagtatactcccattctccaattgcagatccctcagatccctctctaagactcaggcaaagaaatgggggctatcccggaagccctgagggagcaccatccaagtgtattatttttctctggtactaggattttcccattcaaaagcaaaaaacctattgggactctgggggcagaggaatggagaagaaagcatcttttaggtctaggactgagaactattttgcatcccctggcacctgagccaagagggtatatatggatccaccaccaatggatggccagggataatggcctcattaattattctgagatcctgtgctagctggtattccctcaaagcctttagaacaggtaagatggggatgttgcaaggagaattgaagggttttcagagcccatgggtaagtaatatctcagctctggatagctcaactattttaactatgaagccttttcttgcttccagcttaaytggtttcttatttttgtttttgtttttgagacagagtctcactctgttgcccaagctggagtgcagtggcacaatctcggcttactgcaaccttcacctcctgggttcaagcaattcttgtgcctcagcctcctgagtagccgggattacaggcatgtgccaccatgcccagctaatttttgtatttttagtacagatggggttttacyatgttggccaggctggtctcaaactcctgacctcaggtgatccacttacctcggcctcccaaagtgctgggattacaggcatgagactccatgcctggctgggtatttttttgtagttgttgttgttgttttgagacagagtctcactctgtcaccaggctggaatgcagtggcgtaatctcggctcactgcaacctccgcctcctcggctcaagtgattctcctgcctcagcctcttgagtagctgggactacaggtgtgcaccaccacacccagctaagttttktgtttttagtacagatggggtttcaccatgttggccaggatggtctcgatctcttgacctcttgatccacccacctccgcctcccaaagtgctkagattacagccataagccactgcgcccagccctggcttggtattattttcaattgggaaaatagctggggtctttaagctgtgttttgactggmacttttgttttagccttccccggtttcccagtataccatgctagcaggttagcctgtttattaatgtggtctgggacattgtatttttgactattagcaatttcactgggtgatgcttaaattgtagtagtgcccctattttaaccataatatctcttcccaacaggaggactgggcagcttggtactactagaaattcctgttggaaaaattgtttctcaaattgacaaatcaaaggaggagtgaagaagcttgtttgtggccttccttccattcccataacactcattgactgggaggaaggttttcctgcacaagcagtaaggacagactaatttgctcctgtatcaaaaagaaactgaatttgggggcccatcacagccagagttacccggggctcctcatctaattcctccttttgtactgctagagctttgactgactgagcccctcagtgggaactggggcagtcaatcctccagtgccaggggtcataaccagtaccctcacgtttttggcaagggcctggcatatgcttagtacaattctttgcacaatgcccagctttcttgcatttgaagcaagagcccttgctggcattatccttatggctcttctggtttcctttggacactctttgggcattcacagcatcgccaatgatggcttccataattttggcttgccatttttcttttcttttcttttttttttttttttgagacagagtttcacttttcttgcccaggctggagtgcaatggcacaatcttggctcaccgcaacctccgcctcctgggttcaagtgattctcctgcctcagtctcctgagtagctgagattacaggcatgtgccagcaggcttagctaattttgtatttttagtagagacggggttactccatgtcggtcaggctggtcttgaactcccaacctcaggtgatccgcctgcctcggcctcccaaagtgctggaattacgggtgtgatccactgtgcccagcctgcttgccgttttattttgctccctttttccttccaccaggtcacgattgttataaaccataaaggtggtatcaagaagctgattttgattagtttgtggccccatctgtagtttttggagcttatgtctaacggctggggcagattggctaatgaaatgctgtgccattcctattttgcctttgggagaagaagggtccagattagtgtatttgttaaaagcttcctccagcctgccatgaaacatggctgaattttcctcctttccctgtgtaacctcccttactttatcataatttactgctttagttattccctttctcattcctccaaggagagcctaaagaaatttagcccagttgttcattcccatgggtgtgttatagtcccagttaggatcagtagtagggactgtgtctggtcctgggtgattgccctgagggtttcgggcaaataaattrtctgcttcctggcgggcagcctcaaggatgtgttccttttcaaaggaggtgtaacagattgctagaatgaattgagcgtccctccatgagagatcaaaggctaaggtcaaagtctggagcccatctatgaatttcctgggattctcagaacagcttcctcactttcccttatgttattgtatattagttatagagaaggggacctgcactaggactggccccttggcttctgctacttcctaaggggtagcagggctggagggagagttgaatgtgctgttcccctccgagtgtgagggggactgagtagggtccccagtgtttgggttttagcctcaggaacacttggcaagcggctatatggaggcagttgctgttcaccctgagagacaggtggcccttgtaaaagggggtcatctataatatctagttctgcctttggacttccctgtgggggaattattaggttttggtatagggccatgaaggcctatacatatgggatttctgaccatttgccctgccttttaaaaaayaggtctaattgcaggatggtgtcataattaaggctactattgaccacccattgttccaggctggrsagcttataatggggacaaacagtattggagaaacaaaaatcatacgttttctctttagattgtcagggtcaaattgatttcaatcccagaggatgcagccaagtggggaatcaggtggaattgatggagagttgcccatagtggtctagaaaagagaagagaactttgaaaagttgagggctcattaagtaaccgaaattttagctggggtatccccctggaaaaattctggcccctgattggggttcccagggggcatacccttaagggccccatcttagcctgtcagatgtcgctaaactcacatgggtgctagcaccactttggaatggttccctccaccactgatggcccactatgagctttccctcttgtccctggatgaaggccttgacttctagaattaatttgtagtcaaacctttggattttttttcctatcccacttaaaacaattatttaactctctacatttaggcaagattaaattgtatataaattccctcttatkaatccacccccatgactcacacagaccatctacaacatgcccaagccctctgacttgtccttagccagtcgagtagggaaggaaagaattcagcataaggaaagaaggtttaagtcacctgaaacmtgtatgagttagccccgggtgagcttccactgccaattacgtcacacatagggatcagggactataaccagaaaagatagaaaagagtccttccccgttccaggcaaggcagccatccccattcactccttggccttcaggtwacaccagagactggccccagccagttgccttcaattaccaacagtctactagaaaatggccgctgaaagaccgaaaaagtaaaggacttggtctcaagccagttggtggcggtcaggcgcttccacatggaaacctttcagtttcactggagagtggccctggccagaaacatgctgttgcctccatgcttaggcgctgtccaccaaggatcccaaattggaaaggaagagagaaagagaaagaggaaaaagagaaaaataaatcccaaactttgggcttacctcctggctggctcaccaaaatatgttaccagttgagggtagctgtcccagttcttggcattttaaacaaagaattggacaaacacacaaagcaagacagtgaaagcagagatttattttaaatgaaagtacactccccagggttggagccatctccagcaagtggttcacagtatcggttacagaattttctggggtttaaataccctctagaggtttcccgttggttctatgcaaataaagtagtggccaagaaccagtctgataggatgcgggaggggaccaatcagaagtaccttcacgtttcctttttttttttttttttttttttgagagggagttttgctcttgttgcccaggctggagtgcaatggtgacatcttagctcactgcaacatccacctcccaggttcaagccattctcctgcctcagcctcctgagtagctgggattacaggcatgcaccaccatgcccggctaattttgcctttttagtagagacggggtttctccatgttggtcaggctggtctcaaactcccaacctcaggtgatccgycagcttcagcctcccaaagtgttgggattacaggtgtgagccaccgcacctggctgtaccttcatttttcaactgccatgcaraaaaaggaggggttgtaaagggagtagtctctgatatccagtcagcaatcggccttaggttccctgcctctagaccctattttcctgcctcaaatctagaggcagaaaagtggtgttttcattcaagaatgagggctgagctgggcacagtggcttttgcctgtagtcccagctatgcaggaggctgagatggaaggtttgctgagcccaggagttcaagaccagcctgggcaacatagcaaggctccatctctaaaaagtaaaagaacaataaggtctgaatggcatgacaatgaggttaagtgaagctactaagattaartcttcagtggctttagttaactttgcagctgtaagtacccaaagagggtaggcaactgctacggggccaaatgagaagatgtaacaagaaacgggtctttgatgtccatcatgctgttaacacctctaaaatttctcctgattttttatacacaaatagaaagtagagtttataacaattagggaattcaagggtagtgagtttatttgggacaagaactcaggtgtgtcaactagttttgattatagaaagggggagccagtatagacaaattcagaatccagtgtctacaatatcaygagtccaagaaattctctaaattatgttctggtaattggccaggtaaaatcataaagagcttcctttctctgaaggaaaagagattttcccttttgcatgatgatgtcatgatcaagataattcactttagtctgataaaactggatttatggccgggcacagtggctcacacctgtaatcccagcacctcgggaggtcgaggtgggtagatcacgaggtcaggagttcaagaccagcctggccaagacggtgaaaccccatctctactaaaaatacaaaaattagccaggcgcagtcacaggcgactataatcccagctacttgggaggctgaggcaggagaatcacttgagcccgggaagcggaggttgcagtgagccaagatcatgccactgcactccagcctgggcgacagagtgagaatccatctcaaaaacaaaacaaaacaaaactggatttatcctttgagaagttatgtccctaattcttcaagatttggccgggcaccgtggctcacacctgtaatccctgcactttgggtggctgaggcaggacagcttgagcccaggagtttgagaccagattgggcaacatggtgtaatcctgtctcttaaaaatatatatataaaataaaaattcttcaagatcttctatctggagagcataagagaagatccattaattatataagagtttcatcatctctgaattctgtaaggagataaactcatggatagagattacagtatccatcctataaattcttttttctttttttgagatggagtcttgctctgtcgcccaggctggagtgcagtggcatgatcttggctcactgcaacctccgcctcccgggttcaagcgattcttctgcctcagcctcctgagtagctgagactacaggcatgtgccaccacgccctgctaatttttgtatttttaatagagatggggtttcaccatattggccaggctagtcttgaactcctgaccccgtgatccacccattttggcctcccaaagtgctgggattacaggcgtgagccactgcaccaggcctccatcctataaattcttaaaataatcctaaatccttcaatgaatttttctctttacgtaggaggatttagaaggttcttaactagattatgcaaacctgaaattgaccaaggtttaaaacaataagcttagctaagttggttgtcatcatcacttaggtgtaaggcatcacgaagggatactgtccagtgaaaggggggtgtttaggaaggagtaatggaggaaagcgaagaggacctaaggaagacacagcaggaagggaatgagtcaaagaaaggtgttatgggaagtcagggaccccgaacagagggacctgctggagccgtggcagaggaacataaattgtgaagatttcatcttaatatggacatttatcagttctgaaataatacttttataatttcttatgcctgtctttactttaatctcttaatcctgttatcttcgtaagctgaggatatacgtcacctgaggaccactgtgacaattgtgttaactgtagaaattgattgtaaaacgtgtttgaacaatatgaaatcagtgcaccttgaaaaagaacagaataatagcgatttttatggaacaagggaagacaaccataaagtctgactgcctgcggggttgggcaaaaagagtcatatttttcttgttgcagagggcctataaacggacatgcaagtaggaaacatatcgctaaattcttttcctaacaaggaatattaatattaataccctgggaaaagaatgcatccctggggggaggtctatgaacggccactctgggaatgtctgtcttgtgcagttgagataaggactgagataagccctcctctcctgcagaatccttaggcttactagggttgggaaaactcagcgctagtaaatttgtggtcagactggttctttgctctcaaaccctattttctgttgtttaagatgtttcatcactctcagctttcacctcagaggaggccaaggtgcaactttctttagtcatcccaaatccaggttcatctgacaccagccgcctccaccatgccaccgaagttcaaccctaatgagatcaaagtcgtatacctgaggtgcaccggaggtgaagtcagtgccacttctgcactggcccccaagatcggccccctggtctgtctccaaaaaaggttggtgatgacattgccaaggaaacaggtgactagaagggcctgaggattacagtsaacctgaccattcagaacagacagacccagattgaggtggtggcttctgcctctgccctgatcatcaaagccctcaaggaagcaccaagagacagaaattaatagaaaaacattaaacacagtaggaatataacttttgatgagatcgtcaacattgcttgacagatgcggcactgatccttagccagagaactctctggaaccattaaagagatcctggggacygcccagtctgtgggctgtaatgttgatggccactaccctcatgacatcatagatgacatcaacagtggtgctgtggaatgcccagccagttaagcacaaaggaaaatatttcaataaagaatcatttgacaactagaaaaaaaaaaaaaagatgtttatcaagacaatatgtgcaccgctgaacataggctcttatcagtggttctacttttgccctttgccctgtgatcgttgttggaccctaatcagtggttctgcttttgccctttgccctgttccctcagaagcatgtgatctttgttagactcttatcagcggttctgctttttgctctttgaaacatgtgatctttgtacctactctctgttcttacaccctctccccttttgaaacccttaataaaaacttgctggtctgagactcaggcaggcatcacagtcctactgatatgtgatgtcacccctggcagcccagctataaaattcctctctytgtactgtctctctttatttctcagccagccaacacttatgcaaaatagaaagaacctacattgaaatattgggggtgggctcccccaatagaaaggcaggaggaagttgagggccaggggtctaggatgtaagttaatcccgggttaggcaagagatggagaagagatttaaacgttggcttttaggtcctctatatttttattggccttttctaataagtccttaatagaagctattttagaattttcctttgagaggactcttcctggtcatttaaaaacgctaattattgaatatctgggaacatttaaccattgactgtaaggtgccaaaaacagattatcttattcacatccaaagttcaccagaacagccactaaagttctagaatgtccttagtaagattctgccataggatccaatatttaattctatttaccgcacaacattgagctcatattcaaataaaaagaacaaagaagaaataaatacacaggccccaaaawtctcttggaactatgagcccaggtcatctgtgagaaccttgagtagtaaaaacaaatcatatccagaggcttataccaaagacaataaaggtaacgaaggcttaagtggggctgggcatagtggcccacacctgtaatcccagcactttgggagggccgatcacctgaggccaggagttcaagaccagcctgaccaatatggtgagaccctgtctctactaaaaatgcaacaattagccaggcgtggttgcccggacctgtagtcccagctactcaggaggctgaggcaggagaatggcttgaacccgggaggtggaggctgcagtgagctgagactgtgccagtkcactccagcctgggcaacagagtcagactcagtctcaaaaaaaaaaaaaaaggctyaagtaggcacagtagctcacacctgtaatcatggcacttttagaggctgaggtgggtggatcacttaagcccagaagttcaagaacaatctgggcaacatggtaaaaccacatctctacaaaaaaatacaaaaattagccaggcgtgctagcacacacctgtggtcccagctaccctggagggtgaggtgggaggatctcttgggcctgggaggttgaggcggcagtgagccgtaattttaccactgcactccagcctggcaacagagtgagaactcatctcaataaaaaagaaaaaaaaaaggctgaggtgatgattcaaagttgtgagacggttggaagcagggctcattcagctgagcagtccctgtgacttgtaaaggagaaataaaaacatcttaggacccccaaacttgttatgcagcagtgctgggtcatgcagcactgctatccttttcccaaatagacagctattactttacaacctggtgtcaaagcatcatacattacccagaccctcacagaaaggcagaaggtctgataccatctccacatgatggccctcataaatttttcccaactaaactctttgctggcctcaaaacctttcaagatgtacatcctcccataaaacaagaaccatgtccattttaactttaggtctaccatctaagtctagctcctaaaactaaagtttgctagagtcacactgataatgtcaattacaagctgatcttcccaggagcagaacaaatcattcctccacctaccstgagatgtttgcataattgattcttcctctactccctttttctctgaattctttataatataatcaccttatctgtataaaatgtagatttactgagctctaattaattaatagttccacaaaagtataaccatttgcctcaccaccctaccccctccttcccacatgccttctcccctttaaagaaatgtataaatactgtattagtccgttttcmcactgctataaagaactgcctgagactgggtaatttacaaagagattgaattgactcatagttccacatggctggggaggcctcaggaaacttacaatcacgacagaagaaggggaagcaagctaccttcttcaaaaggtggcaggaagaagtgctgagcaaagggggaagagtcccttataaaaccatcrcatctcaagataactcactcaatatcacgagaacagcatgggggaaaccacccccataatccaattacctccacctggtctctctcttgacacatggggattatagggattataattcaagatgagatttgggtggggaaacagagcctaaccacattttacatatttgattttttaaaatatttgataactttcattttgaattaatttcctttgtaatctcacatattttattttatgcattcaaaagattattctggccaggcatggtggctcatgcctgtaatcccagcactttaggagaccgagacrggtggatcacttgaggtcaggagtttctgaccagcctggccaacatggtgaaaccctgtctgtaattagccgggcttggtggcccatgcctataatcccaactactcagggaggctgaggcatgagaatctcttgaacctggaaggcaggggttgtcgctgagatcgtgccactgcattccagcctgggygacagagcaagaatccgtcttaaaaaaaaaaaaaaaaaaaaraaaaaagattctaagaaggtgtccatgggctctaccaaactaccaaagaggtttatggtcaaaaaaacagagaagagttcctgccctcaggagttatttctttttttttttttgcatggttgaaattaagttactgccatttctacattccaatccaagcaaatgtaagaagagtttcacggtaagccattcccttaggcagaagttgcatataacatttctgcttatatgtcattatgagaactgaaacttgacaacatctagctgcaagagagacttgggggaatataatctctacttacattccaagtgactacatacaaactgactttgtacccagctaaccattactaacawgaaggggaaagaaacaaaaaagaaggggaggcctggcgtggtggctcatgcctgtaatcccagaactttgggaggctgaggcaagcagatcacttgaggtcaggaattctagaccagcctggacaacatggtgaaaccccatctctacwaaaaatacaaaattggccaggtgtagtggtgcggtcctgtaatccctgctacttgggaggctgaggcaggacaatcgcttaaagcagggaggcggaggttgtagtgagccaagatcatgccactgcattccagcctagatgacagagtgagggtctatctcaaaaaaaaaggaagaacgggaaacagattatagggagcaatcaagaaaagaaaaagaactaatgacctcatttacaacttaaatgaataggcatttttttttgcaaaccaaaataacttttactatagatatgttaatgatgtcattaaaacattttctaaaacatattttataagtttaagagttaacaagccttggccagtttcggtggctcacgcctgtaatcccagcactgtgggaggccaaggcaggtggatcacaaggtcagcagttcaagacaagcctggccaagatggtgaaaccccatctctactaaaaatacaaaaaattcaccgggcctggtggcgggtgcctgtaatcccagctactcgggaggctgaggcagagaattgcttaaacctgggagatggaggttgcagtgagccgagattttgccactgcactccagcctgggcgacagagcaagactccgtctcaaaaaaaaaaagacttaacaagccttaaggctaagtactatgctcatgaaagactcagatagcatctaagagagcctttgtttttgaatgctgggaaacatagggagaggatcccgtaatttatgaaagggagcatagtatggagcaatctaatctatgaggggaatctttcccaagcctgaccagttgacaaggctttctggcacactaggttgtaaatctcttagagagaagacagtgtaaagcttggctctygagtaaacaaactttcaggtccatgagattgcattctccctttgcaagtttcttactggtgaccatttaagactactctattgatgaatatcacttgtactttaagactgtgcaaagatcaaacacttttggaaaaatcagacaacctttacttacctagcagagagaggataaaatcagcacaagtacagacaaggatacatggcagagagatcagctactttatcccaaatgcttcccagacattaaatcctaacggacactaagccctccttaggctgtataggagtggggtccctatcagaatttccggcaacaaaagtccctctccttgggtttgtttttacttgctgacctgcgtggctaggtgctagaaaatcccttatctgagccaagtgtgtccagctatgttccaggaactgctcctagtgaggtatatgtactaattcatgtaactatctcaaaaattaaataaggtaagtattattgttatccccatttttcagaagagcgaaaaaacaaaaaaatgaagtgattttcccacaaagttctatcactagggagctgcaaaacaagattcaaaccttggggcatacttaagagcactgaacaggtttgagccaaagagccattagagggccagagccgggtcctgaaccaacaatagacggagatgtgctagacacactggaggtgctggggtataagggaccattgctagaggagcaagcccttatgaaggcagcagagtggactatatgtaggagcatatayggtataggattatatatataggcttttatacaggaagaaggtggtatatactgtaaaggaatagatatataaactatataaattcctatacaggatatggttaggctttcaaataaaatcattatgcaacttggaagaaagtatgacttctgctggaagagatgatctagagagcttccagcttgaggtaaatgatttttttaaaagaaatggcatgtccatattctgtactcatatcaggagatactaaagatcattttaaaaaaggaggactggctgggtacaatggctcacacctgttatcccagcactttgggagaccaaggtggacagattgcttgagtcccaggagttcaaggccagcctgggcaacatggtgaaccccatctctacaaaaaatacaaaaatcagctgggtgtagtggtgcatgcatgttgttccaactacttgggggcctgaggtggaagaattgcttaagtcaaggaggtcaagcccacagtgagctgagatcgcgccactgtaaataaaaaaatataaaaaggactgtttgaaactcctattatttttaagtacagaacttgaagcttcacagatattacagaacaagaaacattaaaattctcaattagataaaaataatgaaatttatcaggaagttcaagttctgtgtgataaccttggtgtacccaagtaaacaacttctgacattctggttatgctaaaccaagtggaatcaaaggtgaaagacaggcaggacgcagtggctcatgcctataatcccagcactttgtgaggcagagatgggaggatctcttgagcccaggagttggagaccaatttgggtgacatagcaagatcccatcttatttcaaatttttaaaaattgttaatttttttattaaaattaaagaaaaccactctgctgaaaattaatttaaatttgaaacaggcagaacaactggaaagagtcaatgatgctctttcctgtgaacatgagtgcctctagcgaatgttatgaaacaattagatgcggcaatacagtccgttgcacggtgtgatacagccaaggtaagaaaagatgacacagcaagaatttaccagcctcagtgttatgctttgtcacccaagacagcgattataatggtgcatctacttgctgctcatgataatctatccaagatcattaggacaagcagtggagccagccagatgatggcatgtgccattaataaggtgctgatgggaagggtgcctgacaggggaggctggccaaatgaaattgaaccaccaccctctgaaatgcccccttggcaaaagagacaagaaggcagtggcggaaggggtggttggggtggtggttgtggaggtagaggtggtagtagaagaggctgtgggggtggaggtggaagagttggctggggtagaggaggatgggaaagtggtgggggagagggaggaggtgggatggaggtggtaaaggaggtttctaaggcagaggagatgatggtgggaggggagattatggtggaaaagattatgtagatccatatggaggaggtggtgatggtggtggatataggagatactgaagactacaaaaattaaaaaccaaaaccaacaaacctcaagcgcaaaggaatagtctgccctcttatgtcacaagcactaactaaccacctctgccctttctcatcccttaatcattcagacaagatttccttgtttacttcctcctataaaaaccctaagtctatttcaytttctttgaaaagattcctctgcattaatggatgttgtccttactacaatagcatgaaaaaaaaaaaaagtctccttaatgcagcttagcaattttccaggcttgatatcagtgactccatcttgggctattgactccatgctgagctgctgctaaactttgaggcccacgaagaaactgtgaaaaatatttccttcacaaacaactgttataaataaagttttggtgttgcaaaagaaatagcactcgaatataaattttctttttaattctcagcaaggcaatgtacttcttttttttttttttttgagacagagtcttgctctgtcgcccaggctggagtgcgtgtcgcaatctcggctcactgcaagctccgcctcccgggttcatgccattctcctgcctcagcctccggagtagctgggactacaggcacctgccaccacgcccagctaattttttgtattttttagtgttagccatgatggtcttgatctcctgacctcatgatccgcctgcctcggcctcccaaagtactgggattacaggcgtgagccactgcgcccggcggcaatgtacttctatagacgggtgcgccctcacagatggagcaatggtgagctcacacctgggcaagggaggggaaggggttcttattcctgatgcacgtggcctctgctgctgtgtcgttcccctgttggctagggttagaccgcacaggctaaactaattctgattggctaatttaaagagagtgatggggtgagcggtttggcaggaaaaatggttaaggcggggcaggaaatcggaatgagtcagggtggagcaggtgattgaaatgagtcagggtggagcaggtgatggaaaaaggttgctttacgaggaagttaagtttaaaagtaaaaggcaaagattgaccatactgacatattgattctttgaagagaaatttagaattcatatctaacacaaccgtttttgcaacaacacacaacccaagaaagctggtctcaatattattattattattattattttccgagacaggctcttactctgtcacccaggccggagttcagtggctcaatcttggctcactgcaacctctgcctcccaagctcaagtgatccccccatctcagcctcccaagtagctgggactacaggcgcatgccaccactcctggctaattttttttgttttttgtatattttttgtagagattgggttcaccatgttggcaaggctgctctctcaaactcctggcctcaagtgatcctccccaaagtgctgggattacaagcataagccaccacgcctgatccccaatctttttttgtttgttttgtttcatgagacagactctttctgtggcccacgctggagtgcagtggcgtgatctcggctcactgcaacctctgcttcctgggtttaagcaattctcccgcctcagcctcccgagtagctgagaattacaggtgcccacaaccacgcctggctaatttttatatttttagtagaaacagggtttcaccatgttggtcacgttggtctcaaactcctgatttcaagtgattcacccacctcagcctcccaaactgtcaggcctctgagcccaagctaagccatcatatcccctgtgacctgcacgtatacatccagatggcctgaagcaactgaagatccacaaaagaagcgaaaatagccttaactgatgacattccaccattgtgatttgtttctgccccatcctaacagatcaatgtattttgtaatctcccccacccttaagaaggttctttgtaattctccccacccttaagaaggttctttgtaatctcccccacccttaagaaggttctttgtaattctccccacccttgagaatgtactttgtgagatccaccccctgcccgcaaaacattgttccgcggagcctctcccaaaacctataagaattaaagataatcccaccaccctttgctgactctcttttcggactcagcccgcctgcacccaggtgaaataaacagtcttgttgctcacgcaaagcttgtttggtggtctcttcacacggatgcgcgtgacacaaagtgctggggttacaggcctgagccaccacacctggccacccccaatctttaagaatattctggccgggcgcggtggctcatgcctgtaatcccagcactttgggaggctaaggcgggcggatcaagaggtcaggagatcgagaccatcctggctaacatggtgaaaccccgtctctactaaaatacaaaaaattagccgggcatggtggcgggcgcctgtagtcccagctacttgggaggctgaggcagcagaatggcgtgaacctgggaggcggagcttgcagtgagccgagatcgtgccactgcactccagcctgggcgacagagcgtgactccgtcccccccccaaaaaagaaagaatattctgtatgtagtttttttgttttgtttctgacagacgcaaacgcactcttctagtaatgactaaagacttcttcgtttaattcaccaatgaactaatctgacaatttatgtaacaaataaattcctataaacataagctcccttgcccctctccagtggcacaatctctgatttgccatcctggttgcaaccttcattactaagtaaacgcttacgtaaaccttaataatgagattcgggcaatatgattaaatattggtttatttgagtgcaaagtttgaggatggcgacccggtaggacacagactccaaaagatgggggtcagtgcttcgaaagggagaagtttgagggtcgtttacacaggcagggtctgggaagcttaacaggatgtcaacattttccatagaaggttaacgcatagcaatttgattggttcaaggcagtgtttctttttgggaagggtctatttaacattccacattaaggatgtaatagtcaagcggtcatttatcttattcaatgcgtattttatctcagatgccatctggtctgagctgggaacaagaaaataagggagttaatctataacaaaaggtcggcaattaagaggtcgtgcttcgtgatctggtctccaaagtcaactttcctcagggactttcagaatccccaaatagactayccactttctttcacacttatttsyctctaacttgttgatttcttttttttttttctgttttttaagggttaacaatctcttgggtgcactctgacttccatgcgctttatagaaaaaattggtcctgaggccagcagcaacagtcggtctcaggaacttgttagaaatgcacatttttcagccccaccccaaacctactgaatcagcagttttgctggtggttctcaatctctctttaacgtgccctctgggtgctgcggatgcacgctgaaggtagaagatcgctgcaggagatttccgcgtcgggcagatgaaagcgctctgcaagcccgggtgttatctgcgggccgggtccgcggcttctctggtggcactaggaccgcggcggcgcggccctcgcagccaccgcctcgggcgtgaggcggagcstagctgttcctggatcctgggcctggctcctcgacccgcccctggaggcggaccccacttgacttaaactctggggcccgggaggccgccggttttctccccgcttgccggggtggtcctcttccctttgtcggtaagtgtgagacgagcaccccgaggtccctccgccttccggggtccgggcggggcgggggccgggagccgggagccagaggcactcgcggtccgggcctgcgcgcggcgcagagcgcttttgttctgcggcaaagacgcagtcgcgggcggccccggaacccgggcctcgggccccgccggctcgcgcgtcccgccgtccgcccaccggagctgggccgggccgccgcgcttgcttctgcccgccgcrccggggccggccctgggcctccgcggatgccgagccttgcaccggagggcgggcctcgctggctgttttccctcattgcctggctctgcgcggtagaggtcgcgagtggcgaaggctaggacgcattttgtcgaactgcgaggcgcggctggtgaggcgggtgggtatgagagctgcttatgtttttaaggctttcctgtcgctggagtgaaaaagaaaaatctttttttttttttgctatttcccgagggttctcctcctccccggccctcttaagccgaagcctcctggaacagaattgctgtactggcatctatctccaagtggtccgcgaacgcttctgcgccggcgatggtttctgttcctcagcaatagttccttgaggcatttttaaatgcacaaacgcatacccatcttaggtgttctcgagggacacggattccctaagcaaacgtccttagggtcctgagttcagcagcaaactttcggggaatcatttccgtgaaaacaatttatttgtagtacatcgagtgcatactgtcttaacataaggatgtgtatgagcttgaggcgcattttcatttagtggcgggcgggtgcatttcagtaggcgggccgcagagcttgtttggggattgcatttttctgctaaatgtgttagctttaatcatgtttcagtcactgttaatgtgcatgcatgttaaggttttaggttttttcccctgtgcagtcggatttttttctgtttaatattaatccaataaagacaagtgcagagataaagtattattgttttgcagtgatactacaatagcggacctagaggagcgcacataaattctaacttaagtgaatggtattttcaggccagacctagtttctatttctgttacttaggacacttaataagaattcagtaaacttagcatgctttcagtgcagccataaaagaaaacagttttgcacagcagtgtcatatctagtaaacacattagcatgtgctcttttattataaaatgtttcttgctgtccctaggaccaaagaagtaaacactgtgtggagagggactgacgtgtttggagggaaatgggaatgtacacgataattaaagagtaaagttgtgctcaacggtaagtgtatcacctctaagaaacccgccctgatttaaccaggcggttattcacactcaactatggagtaattcacctattaccgaataaaattactagctcagtgaatcaacatcggttttaaattaaactgtgggtcacaatggaattgacagcaaagcttgagaagaaatgttgttggcatagtactgaaaaatcagttgttaatcttagcaaaataaggaaagaggtctttggtaagggaattgtggtggaagttacctgggcagaggtctgcttctgtctgtgctgtgtttatttgattgtttttattatattttattactgttggtggcacataggggaatgtggcrcagagcaccactctggraggatgcttcccgtgcagccaaagtgatcatgtccagggctttcatctgtaaccacaaagtgtgttaggaagtctcacctaatgattaagaccatggtccctgtaaccacactgctttggttcagatcttggctgtagcactcagccaaccctggaaaataaacctctgcctgttctctcatctataaaatggggacaagcactaatgtcataggattgttatggtagagttacatgagtttcatgcatatcacagttaaacagctcctgatgcatggtaagtgcccaataaatgttagctattgtcatgttagaggaaatagattttgtggcctgggacatgtaatgctgccttagcagaaattcagctggttcatttaagctctaaatttatgagctttttattgattaaacccatcactgtagatcctcttagattctcttttttgtaggtcttgttttgttaggaagtacctgtcactactggtccacatctggatttacctgcaggcttgtttggaataaaaaatgcctccaaattcctaggcaggacaaacttgccccaaagctttgttgttctacattatctctgtgattgtacaggaatctctcttccctcctagattatcagtgtcttggatataattggagctcaaatgcttagggaattgatttaatgttgcttaaaacgtatttgtaggccaggtgtggtggctcacgcctataatgccagcactttaagaggctggggcaggcagatcacttgaggccaggagttcgagaccagccctggcctcaagttggccaacatggcaaaaccccatctytactaataataacaaaaattagtcgggcgtggtggcacatgcctgtaatcctagctactcaagtggctgaacccaggaggtggaggttgcagtgacctgaagtcaccccatcgtactgcagcctgggtaacagagcaagattctgtctttttwaaaaaaaaaaaaaaaaaagcatttgtgaaggtgaatttcaagaatctaatcaggcctccctccctcccccattagaggcacactctattatgtaaaacagacagggagtgtattcattttgagataagtccaggataacagttgactaaccctggctatagatacgcaagttaaacattcactttggaagaagattgtgaagaaagaatcttggaccttgaggaattctaaatgctttgttgggtggcaactatgcaatacttacactattcctaataccttaagtgtacttgtaagtgaagagcaaagttggaggctgttgaggtaaataatctcaagtgagattggaactatacrttttatgctcctggttttcatgatcgcaaagatttaatgacagtaacttaagattctcttgatgtatcaaattacaaggtttcatttgtaaataaggtgattaaaatgacaaagtgtattaaaagaaattgtattgtccagtgaagttttaagaaacagaaaccataaggtgattattatttttcaagccccaaaggagaattcattagatgacatacttttaaagttcatggatcagggtcgggtgcggtggctcatgcctgtaatcccagcactttgggaggccaaggtgggcagatcacctgaggtcaggagttggagaccagcctggccaacatggtgaagctccatctctactaaaagtacaaaaaattagccaggcgtggtggcacatgcctgaaatcccggctatccgggaggcagaggttgcagtgagctgagatcgcgccactgtaccctagctcgggtgacagagtgagactctgtcttagaaaataaagtccatgggctggtcgcagtggctcacgcctgtaatcccagcactttgggaggccaaggcaggtggatcatgaggtcmggaaatcgagaccaccctggctaacaggtgaaaccccaaaattagccaggtgtggtggcatgcgcctgtagtcccagctaactcaggaggctgagataggagaattgcttgaacccaggaggggaggttgcagtgagctgagatcacaccactgcactccagcctggacgacagagcgagactgtctcaaaaaaaaaaaaaaaagttcayggagcgcaacctttgggttttgatggatccaggatctaaatccaaaagagagttttaaagatttgggacactgtatctttgagctctgctgtcctctgctttggttttcaggcagaccatccctccactgggcagccctgacatctccagatgcaagcagcttcaagttgttcagagcatgccttttgtaactatagttagagataaaattcataagccatttattcactcatttacacccagtgtacagtttcagtggtttttagtatattcagagttgtgcacccatcaccacgtcaatttaagaatattttattacccccaaaatatctccatactcaatagtggtaactccccattttctccaacgcacctttccctaggtaaccattaatctacttctgtaggtttgcatattctgaacacttcatataattgaagtcataatatttttcatccagcatgttttcaaggctcatttatgttaacacatgtatgttacttcattcgtttttattaccagatattccgttgtatggatatgccacttttgcttattcttccatcagttaacagacgtttgacacgttttcactctttgactactgtgaatagtgcagctatgatcattcatagtgtttatgtagacgtgtatttttatttcttttgggtaaatacctaggagtggaattccttggttatgataactgtttaacattttgaggaactgccaggctattatccaaagtagatttaccactttattttttatttaacttttgttttatgtttgggggtacgtgtgtaggtttgggggtacgtgtataggtaaagttgygtcatgggggtttgtggaacagattatttaatcacccaggtattaagcctagtacccaattagttgtttttttttcaaatcctctccctcctcccacgctttgcctgcctataggccccagtgtgttgagcccctctacatgtccatgtgttctcatcatttagctcccacttatgtgtgaaagcatgcaatatttggtttcctgtgttagtttgctaaggataatgtcctctagctccaagctcctgcawaggacatgatctcattctttttttatggctgcatagtattccctagtgtatgtgtactgttttctttatgcggtttaccgttgatgggcatttaggttgattctgggtctttgctattgtgaatagacatgcacaattttatacagcaatgtttgagagatggttggtctacatccatagacacttaacttttatagccatagaagtgagcctgaagtggtagctcattgtggttgtgatttgcatttacctgatgattagtcatgttaagcatctttttatgtgcatgttgatttctttggagaagtatctattcaaaacttttggccttaaatttgtgttgtctttggattgtcaggttgtaagtttttaagatatcctggattctgatccttccttactagggaccataaatgtgagggtttactcctgggttctaggttctrttccattgatcaatgcctgtcctgtgtcagtactatatggtcttgtttattgtagttttgtcgttttgtttttttgttttttgtttttaagactgaatctcactgtgttgcccagaatggagtgcggtggtgtgatcttggctcactgtaacctccgcttccgattcttctgcctcagcctccaaagtagctaggattacagacacttgccaccacaccgcggtaatttttgtatttttggtagaggcgaggtttcaccatgttggccaggctggtctcgaacttctgacctcaagtgatcagcgtgcctctgcctcccaaagtgctggaattacaggcgtgagccactgctccctgccggctactcccttttcaacccctcctttttctgtgtcaaagttgctgagtggcagtcagaaaatgaaagtacctctgattggtcccctcccacaaccaatcaggctagtggctggccactacttcatttacataacgtgaatccatggtaaacctctagagagtatttaaactgcagaaaattatgtaacttgactgtcttgagccactgctgcccccgctcccaccctgtggagtgtgctgtcctttaaaataagtctctgctttggctgccttgcttgtgtggtttgttcagttctttgttcaagacgccaagaacctggacarctaccctcaactgcatggtttagaggaactcttctgttccactgaaggcattttgtctatctccagtggcagaaaattgactcactcataataggagcgatgaagaagcgatacttctggccaacatggtgaaaagccatctctactaaaaatacaaaaattagctgggcgtggtggcgtgtgcctgaaatcccagctgctggggaggctgaggcaggagaatcgcttaaactcaggaggtggaggttgcagtgagccaagatcacgccactgcactctagcctggtgacagagcgagacttcgtctcaaaaaaaaaaaaaaaaaaagaagtgatacttcgaatacagtttttacctcaacacagtgttgtcttaatatggtttgtacccgcctgccacacactgatgtgtcatgtatacttgggggtgcttgtcagcgcttttcagatatttaagatcaccagacctctagtacacggtgtgtccaatcttttggcttccctaggccactttggaagaagaattgtcttgggccacacataaaatacactaacactaacaatagctaatgagctttaaaaaaaattgcaaaaaawaaatcycataatgttttaatcatgcttatgaattagtgttgggcctcattcaaagccgtcttgggctgcatgctgcccatgggccgcggattggacaagcttgatttagtagatgtttccttgagttgggtatccagagggctccgaaatgaattacttggcagaattctcgtagggtaactggcttccgcttcatgtgttctctgttgtctttaattcccattttagggaataatacaaatagaaaacatggtctaaaatttgtctctggcttctctgctctgaaggcacaacagactagtgtcagtattctagcctgaatgatgatagtctgttgcattggtctgaacttcctgctggccagtcaagatgtgtgattgccagcacttcatgctgtacctgtgttaacgagtcagaaaaagtagagcaatttatttctcccttttttagggagaaagccctgtggctctcactggtgaagcttggtagttgggatatatttagcttacttggctctgcatggggaacgtttggtatgtcctccacaataggtgtgatcatcctgctgggaatcacgattgcaggcactttttaatccagtgttgcctaagacaaagtacaatggattaggatatctgattggatggcctgtggttctgaatagagtttgtagctggatacatgaaagatgggaaggcagagttgtaggtgaacagcttcaccgtggtgccctgatgacttgctcttctcatagaccatggaggcaaagcttaggcttaatcacaggctgacccatattctggcaggacaaccctgcaggtcctccaagaacaaagtgagagaaaagcagccctgtgagaaacagtcacaaagcagtttctcatctgcctccttggtttcaattgtgcataggactttaccaccttggggggtatacttgctggctataaaatggccacagtttggtgttctcatctggcttggtgtcatcccgtggggctggggatactgatcttgattttgctgttggacttagtaatatatgaatccatttggccttttgctgactgcagttacagaagcatagagaactgttctgccccttctaaccactgtgctgcaagagggaggattgckagtctttgttaatttgttgtgatacttaaatgagataaaagtatatgaagcattccacatagttctttacatacagattttcaaatgttagttgtttatagtagtacagatgtacctcagcttacgatggagttacatttcgatwacctgtattaagtagaaaatgtaagtcaaaaatggggttttatagacatgatgggatgggaaaacacaacatccaaaaaacttagctaacacagtacaccattgattggttttttgttttttttaatgtgccgtgggaggggcagccctgcacgcccgcccacccccaccccccacaacaccagcctgcctccgcaggggggatttttgttttttttgtgtgtgtgtgtgtttttcattgattgttaatgctcatgatcacgtggctgactgggtgctmtggcttgctgccaccacccagcgtggaagaatatcatactgcctatcacaggcccgggaaaagatcaaaattcaaagtacaatttctgctgaatgcctgtatcacttttgcatcattgtaaagtcaaaattattaagtcataccattgtattgtggtccaggaccatctgggcttagaaaaatggattctagaaagcctatttaaggactgataggctaattttttctgtgactaaggtgacagaaagccagagctagtacaggttgaataaattgtgttacatttggaattcctgaaaagtggctttttacactgaattgttagtattggtggtttgttaactttctacaggtatctctaatttttcgaatgcttatgttgcaagtcaggttttcaatgaaaaatagactttactcagtttaaccatatcagtggatactcttcaaataaactttcctttgtggaacataagaagtggaactttaaaagccataagggaagttttcaatttaaaataccagagcgaatttatatattttaggtataagaatagtattttaatgtatattatttatttcttaagtcctacgtcttttaggtactkaaatgcttacagatgaaatcatgctatgtctgtggttggcatagatagaaaaggaaacagaagtggtcaggactttttcccatctataagtttacattaggacttctcttttttttttttttttgagayggagtctcactctttcgcccaagctggactgcagtggcgctatcccggctcactgcaagctccgcctcttgggttcatgccattctcctgcctcagcctcccgagtagctgggattacaggcgcccaccaccatgcccggctaattttttgtatttttagtagagacggggtttcaccgtgttagccaggatggtctcgatctcctgacctcgtgatccgcccgcctckgcctcccaaagtgctgggattacaggcgtgagccaccgcgcccggcctaggacttctctttaatggggtgttcagataatgtttgtttattcagcaaatactgaaacctgctagacattatctacatgcatgtgtcttttgggttggcctgaaagacttttatgcctgtcgtattggctgttaatagtacttwgattcactctgatgatgttccacttacctttaataaattgtcaacccacttttctttcccttttttgagacagatcttgctgtgtcatccaggctggagtacagtggcactaccatagtccactgcactctcgacttcccatgctcaagtgatccttccatctcagcctcccaagtagctgggaatataggcgtgtaccaccacgcctagctagtgtttctatttttatttttatttttttgtagagactgggtcttactgtgttgcccatgctggttttgaactgctggactctgcctcagcctctcagcatgctgagattataggtgtgagccaccacacctggccagtggtaacccctgtgtataaaacaattcttaggctgagatggcttgagcctcaggagttcaagaccagcctaggcaacatggagaaacctcatctctacaaaacattaaaaaaattagccacacggtggcattcacctgtagtcccagctgcttgggaagctgtggtgagagaattgcttgagcccaggaggtggagttggcagtgagctgagatcgtgccactacactctagcctggatgacatagtgagaccctgtctcaaaaaaaataaaccaaaattcttgctgtggctcagtttatacttccatattctatttcttgctgttttatctgacctacagcagacctggccaccatgccatattcacaatattaggttcattttctggtttgtttggttttcttttgtttttgagacggagtcttgctctgtcgcacagtctggagtgcagtggcatgattcccgctcaccactgcctcaaccccctgggttcatccaatgcctcagccccccaagtagctgagaatacaggtgtgtgctaccacaatgctgcccaggttagtctcgaacttctgagctcaagtgatctgcctgccttggcctcccaaagttctgggattacaggtgtgagccactgtgcccagcctaggtctattttcttatrcttctttctattcatgtgtatgtgtgcttgtgcatgtgtgtttaacatggatagtaatatggttatttcctataggtataattttagattattttttgctttataattttctgtagtaagcccaatttacaaataaaggaagctgctgggttgacaacttttcagttatttgcattgtgtggatatagaatattttttaaatttcacagatattgttaatcttagtgagatctttaatatgaaagtccacatccataattatctttatgctttcttgcagctgtttacttctaattatttcctgattcacaaattaatttttgcaattcacaacttcaagaatacttggactattggattcaatccatagtaatctgcaaaagaagagaagcagaattatacctagaagtctactaatggacagttagtcacccacctacatgttgaggtactctggacctttttctttcacctcactggaagggaatgtgggtgggaatttaagacatctacttccttgttgattttccacctatttgttctattcattgttgaaagtagggaattgaagtcttccactcttattggtgaattgtggtttttgcttcttgtattttgatgctcttttaggtattaataacctacagatcacatttgacagttttaagtaaacaagcttccagattaacttgctttggggaggtattgtgatacaagatggtgacatcctgtccttgagtaaagaatcttacacattcctcaaatgggtatactgattaatgcataacctaacactcaaaagggtgctgctttatttgtaaatcaggttttattgatgcaagttttcttgcacttagacattttagcctatatgttgcaatcagtagccaatgattataacctcagtattgtatcctccaacgaaaaaagacaatttgagtattaggagtccccctcccttctcctataatttcatataaaagccttccaacttgtagcggactccagaacactttgaactctgttggtatgtcttcccagattgatcctcacatttggcctccagtaaacctttatcagattatttctacctcaagaaccttcgttttagacaacagtgcatatatgtttgtaattgttaccttgatgggttgatccttttatcattataaaatgcatctctttatcagcattttttgtcttagtctgttttgtctgatactagtataggcattcctgctttctttttttgagacggagtttcactcttgttgcccaggctggagtgcagtggcacaatctcagctcactgcagcctccgcctcccggattcaagtgattctcctgcctcatcctcccaggtagcagggattacaggcatgtaccactatacctggctaattttttgtatttggtggagacggggtttcaccaggttggtcaggctggtatcgaattcctgatctcaggtaatccacccacctyggcctcccaaagttctgggattataggtgtgagccactgtgcctggcctgcattccagctttcttgtagctatttgtgtgataytttttcatcattttactttcagtctgtgtttttggatctaaggtatatctcttggaaacaataacatatagttggatagtttttaaaatccagactgacattctctgtcttttggattgtgatattatgaaatatatctctggtctttatccctgttttcaggcatacactcctaaaattcgagcagtctccaaagtgataaatgtcttttttgtatgctaatgagttgacttatggctgacatcccctagtttcagaatggagggctggtcacctgaaagaccaaggcccgattaaagggttgggacttttcagccctacccctaattcctggtaccaattgtctatcttagtccattttctgttacttatagcagaataactgaaacaggggcctttatgaagaaaaggaattcatttcttacacctttgaaggtgcacctggttgagagggagggggtgaggttaagttgatcaccaatagccaatggtttaattaatcagatctgtgcaatgaagcctccataaaaccggaaaggatagagtttagaaggcttttcaggttgctgagcaggtggaggttcctagagggtggcgtacccagggagggcatggaaatgctgtgccccttctcatgtgaccttgccttctacatctcttgaactgaatccttggtaatatactttataataaactgataaggtgtttccctgagttctgtgagctgctctaacacgacaaaccaaaggagcgggacatgggaatcccagtttacagctggtcggtcggaagcacaggtaaaataacctgggacttggtgttggcatcagaagtggggggcagtctcggctgggcacagtggctcacgcctgtaatcccagcactttgggaggccgaggtgggtggatcacgaggtcaggagatcgagaccatcctggctaacatggtgaaaccctgtctctactaaaaatacaaaaaattagccaggcgtggtggtgggcaccggtagttccagctactcaggaggctgaggcaggagaatggcgtgaacctgggaggcggagctcgcagtgagccaagatggtgccactgcactccagcctgggtgacagagtgagactccgtctcaaaaaaaaaaaaaaaaaaagtgggggcagtcttgcaggactgagccctaaactgatgagatctgacactatcttcatatagatagtcttggaattaaaatgaattagaggacacccacctggtgtgtacactgcagaactgattgcttgttatgtggggtgagacacccacacatctggtgtcagaagtgtgagaaagtttattcctacattctcagaattgtttatataaaaatgttattttttatataattacatttacctctaatgttttactttttgtttttatgtctcgtctttttattcctttcttattccttagtggggttkattttgcataaatgagtattttctaatgtagcattttaatttctctttgttttttctgtttttaatttctttaacgatattttcactgtattttttgtaacttcatggaagcacaaattctttttaaaagtattttttatattaaastatcagtgatggaggctggcagagatcttggggcgagaatttattytctcagagaaatggtagtgatggaccatggaaacttgtctatggtaatctgtgttagaatatattcttgaaagttctaagaatacattatatccacaagtagattatgccatcctagagactgcagctgacccttgaacaatgtgagtttgacccatgtggatccacatacacatggatttgacttttttttttttaagagatgaggtcactctctgttgcccaggctggagtgcagtgtacagtcatagcacattacagcctcaaacatctgggctcaaacagtcctcccatctctgcctcctgagtatctgggactgcatccacacactaccttgtctggctacacttggagtttcttctgcatctgccactctactgccaccctaagtcgtaatccctatgttgttcaagggtcgattgtattttcctttcacagtctatttgtgtagctagtaggcaatcttccaaaaacttcaatttaggtcgttccggagtgcttttcgagttttcagttttcttctatgccagtgaaggagagggatggaggaaaaaaaaaacccaaattaacataaagatagtttcccttcctacccatatgctctgtattaattgctagggctgtgtttgagataggaaaaccaaaacttcttcacacaactgaccacttcatctctggtcaccagaatgtatttggatttcttcccatccgcaaactgttttccagctgacaacaactgggtgtcctacaattcaattacatgttggcatcatctacctggagaaagcttcagatcccacaggttgaggactcagtcccacaagactgcccctgacttcgccagacctgtacttttgaccaacctgttacaaagaggggattgtcaagactccctccgtggatttgattaatttgctagagctcacagaactcagggaaatagtttacttattataaagcctattagatgaagagccaggtggaagagatgcatgggggaatgcatatgtgagcgcttccatgccctctccaggtgctgccccaccctacggtcacctctatgttaccagacactcctgttactcaggagattacaaaggtctcaggagctctgtgtcaggaaccgggttcaaagaccacgtattagtgcaaaagattgtataccccaatctacaagagttttaggtgccccgtgtctggaatcatgggcagagaccaagtatgtatttcttatcgtgggctactatgacagtaatgccacagactgggtggagaaatttatttctcccagttccggcggctagaagtccagggtcaatatgtttgatttctgttctcttgaagcttctctctcagtggcttgcaggtgactgtcttcttgctgtgtcctaacgtggtccttcctctgtgggccgacatcgctggtgtccctcttcctatgggggatactagtcggattagagccccactctaatgacctcacttaaccaattatctccttaaaggccctatctccaaatacactgagggtcagggctttcacttatgaattttggggagggtacaattcagttcatgagactctctcctccaagttgacgtaaaagccaggggacagtgagggggacgggcagttatgaagcatcattaattctccttagaagtgctgcttttcttctgtcagtgaacactgtgacccattctgcttccaaccttgtggactagtcaaagtagtgagaggaacagagtcctaacgcctgagagttgtaaaatgagtgtcagcatgtggtggctgccttttttttttttttttaacrgatagactttattttctagaagagttttaggtttaaagaaaattgaggtcaggcatggtggttcacgcctgtaatcccagcactttgggaggccaaggcaggcagatcatgaggtcaggagtttgagaccatcttggccaacatggtgaaaccccatctctagcaaaaatataaaaaatgagtcaggcatggtggcgcgcgcctgtagtcccagctactcgggaggctgaggcaggagaatcgcttgaacccgggaggtggaggttgcagatcgtgccactgcactccagcctgggcgacagagcgagactccatctgaaaaaaaaagaaaaagaaaactgagcttatagtacagagcattcccatrtaagagctttataggaacctcccatctccaaaactctaaggttccactattagcaacttggattagtcatactgatatgttattattaaagtccatcactaacattagagtttactctgtatccaatgggtcttatgggttttgataaatgcttaatagtatgcatctactattataagagagctttaaaaaataactttatgaaatcaaaacatacctaagaaagggtacaaatggtaagtgtataatgcagtggattatgtagggaacacacwtgtgtgtaagtatcaccctggtcaaaagcagtcttcatgctacttaactaccaattgctattccatcacactttgtaaaaagtaccactacagtccctagatggttggttttgtctgtgtttcaatctttatataaatggaatcatggattattctttaatctctggcctttttcactcagtcttgtgtttgttagattcatgttgcatatagccttttatttttgttactatagtgtttcattaatatgaatacatttctattttgtttgtttccagtttttgcttactgcacctaatgctgctggcagtgttataattatgcatttctgtttggtacatacctaggaatgaaacttctaggtctcagggcttgcatttattaacccttggtagatgatgccatacgtctttccaaagtgttggttactttaaggatcatgatatactcctatcaccattgtaggagagttccatttgttccattttcttgccaacatgtggtattgagagttgaaaaaattctagccattgtgtatagtattaccaccttatggttttcatttacatttctgatattcataatggatttagcacttaccaaaaattttgccatttaaatatagttgaccattgaataacataggaattaggataactgactcttgtgcagtaaaaaaaatccacatttaacttttgactccgccaaaacttgatcaacaatagcatgctgttcagtggaagccttaacagtaacatwaaacagttgataaacacatattttgtatgttacatgtattatatgctgtattcttagaataagcttgagaaaaggaaattttattaagaaaatcataagggattgggtgyggcggatcacaaggtcaggagttcgagaccagcctggccaacatggtgaaacccygtctctactaaaaatacaaaattagcctggcatggtggtgggaccctgtaatccctgctgctcgggaggctgagacaggagaatcacttgaacccaggaggcagaggttgcagtgagccgagatcgcaccactgcactccagtctgggtgacagagcgagactccatctcaaaaaaaaaccaaaatcataagagaatatatttactattcattaagtggaaatggatcatcataaaggtgtttatcctcatcacatttatcttaactaggcggaggaggagggaagagaaggggttggtcttgctgtctccagggtagcatagacaaaagaaaatccacgtataagtggacccacgcacttcaaagccacgttcaaggatcaactgtagtgtctcatacagtgtttaattaagcttcatgcttattttttattgagttgtctacatttttctttttacgtaattccctatataggctggatatgatctctttgctatgtattgcgaatataatcttctagagagtgactttactttttcacttccttaatggtgttttttgataaacagtggtgattaattttgatgcagtccgttttatggaccttttttcttattgttcattgtgccctgttataggaaccttcccctatcccgagggcataaagatattctcatgtttttttgagatggagtttcgcttttgttgcccaggcttgagtgcggtggtgcgacctcggctcactgcaacctccgcctccctggttcaagggattgtcctacctcagcctcacgagtagctgggattacaggtgtgtgccaccacatccggctaatttttgcatttttagtagagacgggggcttcaccatccatgttggtcaggttggtctcaaacttctgacctcaggtgatctgcccgcctcggcctcccaaagtgctgggatttacaggcgtgggccaccatgcctggcctgtttctggaaactttaaaacgataatctacctgggattgatttgtttgtatatgtctcttgstgtgtaattggataaggcttattttcattcgtggcatatagataaccaattgacctagcttcatgtattgaaaagaacttttttcctaactttgtcataaaacaartgtctatatataaaagtgtgtgtatgtcttcgctattcatgcttgttttgcatttccatggaaagtttataatcaagcttgttaccccaaaaaatcaaaaaatccactgggattgtattgactcttaattactttttctttctttctttyttyttttttttttttttgagacaagagctcattctgctgcccaggctggagtgcaaatggtgcaatctcagctcactgcaacctccacctcccaggctcaagtaatcctcccacctcagccttccaagtagctgggacaacaggtgtgcacacctggctaattttttttttgtatttttgrtagagacaggatttcaccatgttgttcaggctggtcttgaacttctgacctcaagcagtcgcccagctcagcctcccaaagtgctgggattacaggcaagagccactgcgcttgacctaaattttgagattattggcatctttaatgctgtcttcaaatatttgaacatggcatatctttacactcagctgtttgttagagatgtgacacatccttcattttctaagtatttttttaatggtattttaaaagattactgctgataatattcttgcattttgaccttatttttgggcattgtaataaacagtaaaacaaaaagatctctacatagttttggattttctgtataacatctgatactcagttttgtgttttcctctctgcttatactcctaatatttttttctttataccagctaggatctccagtaaaatgattaatggagggatagtggcatcttccatgttactatttaattgttttagctaccatttatcaaaagaagtttccatctttataattttttaaatatgtaggtatttggggtttttttttgttttttgttttttgttttgagacgggctctcgctctgtcgccaggctggagtgtagtggcgcaatctcagctcattgcaacctccacctcctgggttcaagtgattctcctgcctcagcctcctgagtagctgggactacaggtgcccgccaccacacccagctaatttttttttttttttttttttgtatatttagtagaggccggggtttcaccgtgttggccaggatggtctccatctcctgacctcgtgatacccctgcctcagcctcccaaagtgctgcgattacaggattacaggtgtgaggcactgtgcccggcagtatttgattttgtcagaaattcttatcttagatttttgaaatgatctcatgatttttttttttttttttgaaacggagtctagctctgtcacccaggctggagtgcagtggcgccatctgggctcactgcaagctccgcctaccgggttctcaccattctcctgcctcagccttctgagtagctgggactacaggcacctgccaccacacctggctaattttttgtatttttagtagagacggggtttcactgtgttagccaggatggtctcgatctcctgacctcatgatccgcccaccttggcctcccaaaatgctgggattacaggcgtgagccactgcacctggccccacagtacttctgacaccagatgtgtgggaattttttcccaactgaccaattctctccacataccaactgggtggcttgtgatttgattcagttctgacactgtctacctgatgttaccatcagaacccacaagttaaagggctcagtcctacaagactgcccccacttgaagctagtcacaagtccaggtttgtacttctgaccaactggctataaagcaaacaaggtatgctttctctgaggtcactaccttcccagcacttcagtgtgttctgttcaccagcccagaagctcggctcatcacatctcaatgttcaagagttttgttttttaaaaaaaacagccttactctgtcacccaggctggagtggagtggtgccaccatggctcactgcagcctcaacccccaggctcagatgatcctccctacactgccttctgttttctgagtaggtggctgggactacgggcatgcaccaccatgacggggtaatttttttttttttttaattttcagtagagacagggtttcactatgtttcccaggctggtcttgaactcctgggctcaagagatcttcctgcctcagcctcacagactgctgggattacaggcatgagccaccacacccagccaagactttttatagagtccaatctccagctccccccaccactttatggaggtcagtggttagaactaaaagttccaaccgtctaatacttggttttcctggtgaccaccagctgtatcctgatggtatctaggggcccccactttaagtcaccttagtagcatagactcaggtatgtgcatacagagttcattatgaataacaaaagatatttatgaattagtgtttgcttatgccagaaattttcttttccttttttttttttttttttttgaaacagagtcttcactctgtcacccagactagagtgcagtggtgtgatcttggcttactgtatcctccacctcccaggttcaagtgattcttgtgcatcagcctcctgagtagctgggattacaggtgtgcaccaccacaccccgctaatttttgtatttttagtaaagatggggtttggcatgttagccaggctggtctcaaactcttggcctcaggtgatccacctgcctctgcctcccaaagtgctaggattacaggcatgagccaccgcacccggccttatgccagaaatttactgagttcattaaggtaaccttgaatagccctggggagtttagactttgcgaatgaacaatgagaatgtttttaaccatatgtttgaacttccctttttttttaaattctcatttttattgtcatgttagcttttttaaaaaatgcagttagcatggattacttagaagaaagtctgttaaaaataagtaaaaacagaaggtgattggcatttaaatgtaacaaaaagctagctgtcattgtgtggaatgaatttctgttaaacacgttagaaatttcattgacacttgccttatttattgttgtatcctctattgctcctcttcttcccaaattaaagatgaggctgctctgaagattcagtaattaggatggacagtcagctactaattttcttagatattctatctaggcaaaacagcattttaataaaatatctttatttcttacagattcctgacattcagacaactgacttgtaactgacttataactgacttgtaatacactgctactatatcaaaccgacaatgaattggaatgaaaaaccaaagagtgctacattaccaccactgtatcctaaaagccagccaccttttttgcaccagtctttaataaaccaaattaccacaacatctcagagttctttcagctatcctggaagtaaccaagaagcatgcatgtatcccggtaattcaaatccartttcacagccactgctgaatatccaaaattatcctcaacaaatttctgtttctgataygcataatgggacagttgtggcctcacacacttcagtagaaagaataacatatgcaaatgttaatggacccaaacaactaactcamaatttgcagatgtcttcargagttacccaaaaygtatggttgaactcaccaatgaggaatcctgtgcattctcatataggggcaactgtatctcatcaaactgattttggagctaacgtacccaatatgccggcactacagagtcaactgataacatcagatacctattctatgcaaatgcagatgatcccttctaattctacacgacttcctgtagcttaccaaggaaatcagggacttaaccagtctttttcagagcaacaggttgattggacacaacagtgtrtatctaagggactgacttacccagattacagaccacctccaaagctataccgttactcaccacaaagctttttaccagattctaccattcaaaaacaaaactttataccacatacatcattgcaagttaaaaatagtcagcttcyaaattctgtattaactttaccatcaaggcagacctcagctgtaccatcacagcagtatgccacgcaaactgacaaaagaccwcctcctcctccttacaactgtagatatggaagccagcctttgcaaagtactcagcatattactaaacacttgtctatggaagttcctcagagtcragaaatgctgtcatctgaaataaggaccagctttcaacagcagtggcaaaaccctaatgaaaatgtcagcacaattggaaatttcactaacttgaaagtaaataccaacarcaaacagccttttaacrgwcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatactwcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagacycatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccwtgtccactgaggaatataaatcaaaaattcaaaatgaaaataygctacttctygctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacarcwmcttttgcagtggacaagaatcctcaacaaaaggaatgcctgctaaaagtgacagtagctgttccatggaagtgctagcaacctgtctttccctgtggaaaaagcarccttcagatactgcaaaagaaaaggagtgtgataaactcagaacaaacacaacagcagttggaatttcaaagcctgctaacatccrcgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacartgtatcccgttattaaagaaggcagtgtttgtagtttacaaaatcaattggcagaaaatgcaaaggcarctgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacrttacagattgacaatatttgttctctggttgaaggtgatacctcttacaattcccaaatagcaaagatattcagctctcttcccttgaaaatggttgagccacagaaaccttctctacccaatcagcaagggattggcwgcagagaaccagaaaaacaattagataataccactgaaaataaagactttggttytcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatamgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccttatggcattgaggctgtgaatacacgtgaaggttctgtgggccagcaaactacataccagacctcagaagatcaaactgctgataaaaccagttctgactccaaagacccagcagatcaaatacaaattacaatattaagctcagagcaaatgaaagaaatatttcctgaacaggatgatcaaccctatgtagtagacaagttggcagaacctcagaaagaagagcccatcacagaagtagttagccagtgtgacctgcaggcacctgcagctggacaaagtcgtgattctgtgatactggactctgagaaagatgatatccactgctgtgcattgggctggctctccatggtttacgaaggagtaccycagtgtcagtgtaattccatcaagaactcatcttcagaggaagagaaacaaaaagagcagtgttstcctttggataccaacagttgtaaacaaggagagagaacttctgatagagatrtcactgttgttcaatttaagagccttgtaaataatccaaagactcctccagatgggaaaagtcattttcctgaactacaagacgacagtagaaaagatacacccaaaacaaaacataaaagcttaccaaggacagaacaagaattagttgctggtcagttttcatctaaatgtgataaactaaatcccttgcaaaatcacaaaagaaaaaaattgaggtttcacgaggtaacctttcactccagtaataaaatgacagcatcttatgaacaagcttctcaggaaacscgacagaagaaacatgtaacacagaactcacgtccactaaaaacaaaarcagcttttttgccaaataaagatgtgtataagaagcatagttctttgggacagtcattatcaccagaaaagataaaattgaaactcaaatcagttagcttcaaacaaaaacgaaagttagaccaagggaacgtattagatatggaagtaaagaaaaagaaacatgataaacaagaacagaaaggaagtgtgggagctacattcaaattaggtgactctttgtcaaacccaaacgaaagagccattgttaaagaaaagatggtatcaaatactaagtctgtagacacgaaagcgagttcatctaaatttagtagaattctaactcctaaggagtatttacaaaggcagaagcataaagaagctctgagtaataaagcatcgaagaaaatctgtgtgaaaaacgtgccatgtgattctgaacataygagaccaagtaaacttgccgtgcaggttgaaagttgtgggaaatcaaatgagaaacacagcagcggcgtgcagacctctaaagartcattaaatggcttgacaagccatggtaaaaacctcaaaatccaccattctcaggagtctaaaacatacaacattctaaggaatgttaaagaaaaagttggtgggaagcagcctgataaaatatggattgataagactaaattagacaaattaaccaatataagcaacgaagctcaattcagccaaatgcctccccaagtaaaggatcaaaagaaattatatctgaatagagttgggtttaaatgcactgaacgtgaaagcatttctctcaccaaattagaaagttcacccaggaagcttcataaagataagagrcaggaaaataaacatmagacctttttaccggtgaaaggtaacacagaaaaatcaaacatgctggagtttaaattatgtccagatatcttactaaagaatacaaactctgtggaagaacggaaggatgtaaagcctcatcctaggaaggagcaagcccctctgcaaggtccagtatgattttcttggtggtgtctacaayattgtaaagagtcgtaggtcaatatttgggctagcacctctcatgctgtctgggctgctgggaaagactttaatgtgttatgccactacctagtatttgttttgcctggtaaaccartgtttcattgggcaatatttgttttgtgttcattgccaccttattgtaaattgtagaaaattggtcgtcatgacgagctatatgtaaaacttgccagatagaaatatttcagttagtaccaagaaggctgtactgtgaaaaacattccacattccttgtgggaatgtcagaaaagtgtcaagtagctagtaatgtaagagtcttggttttgttaattctcctttggacttgtaatttgaaagccctgtgaacttgaaattttgttctgaatgttagaggataagtaatgatgaatactgaagtctttttgttcatatggaaatgggtcaactaattgtcctctttgaaacagttgatggctgtgttatcactatagttaaaatggtaacatctagcctactcataagatagaagaaccttgaaagcagtattgtccagtgttataatttaaaatctttaaagccaagctggcagctatgaatattaggtagcttaatggtagacttctcaatgtagtgcaggaaggaaggagaaaattgataactagttgttcatggtactaagggaacatttagacatagtggatattatatgtaaagcattgtgctgagaaagattggaaaactaaaggatttgaatggaaattgaagtctttgctctgcttttctgactatatttgttggggttcataaaacaatagcataaacaggatatgttttcctggaaaagaagatagggatatattcattttgtaaaaaattggtgatttcaataggttctttcatttggatccttggaacttgaggtggggatataatgggaacattggaagtgggtgggggcaatgtagttttctatctcatgtgtcctttaatatctggagatgtattaacctcttcagttcatgtgaggggaacataattacrtagtaaagataaactcattttttaattgaggtaagcatttcaaatagaaatcatttttccagtcctttttttagagttgtgttacatgtggttatatctagggcctttcaaaatctattttcagcttacrtgattttcctttgttatagtactaaaggagatgattagcaatatctagagttctgaaaatgaatatttaaatagtttcaggaataaaaagtacaaaagaagactggttaaaatttgttgctacaaagaaaaggacacagaaagacagccaagagagaggtaaagtcatctttttaaatcttcattcacttatctccctatctggtatatggaaattggattatggttatgatatgattgtaaagtatgattttatccatgttcttttttttttttcagtcattcagtgtttgtgtttgagtggtaggaggacatttttgtgttgtcgtgctgtggaatgaaaggctgagctttattttattttaataggaaaataagtcttatcacaatgagttagctaagaggtttgcatattttacctgtataggaccagacagcaaatactttaggttttctgggtcataaggtgtctgtcctgactactcagctctgactctgtttcagggaaatggctgcagataatatgtagatgagtatcagctgtgttctgattaactatttatttatttatttatttatttattttgagacagagtctcactctgtcacccaggctggagtgcagtggcgtcatcttggctcactgcaacctctgcctcccaggttcaagcgattttctccctcagcttcccaagtagctgggactgcaggtgcataccaccacgcccagctaatttttgtatttttagtagaggcagggtttcaccgtgttggccaggccggtcccaaactcctgacatcrggtaatccacctgcctcggcctcccaaagtgctgggattacagacatgagacaccgtgcctggcctctaattaaactttatctaccaaaataggcagcaggctggacttagtttgccagaccctggattcaattatttacatgttaatttgattaatcttcaatacaatttaggcaaggatatttccattttatagatgagaggttacatcatttgacttaagtttcattgctagtgactgaatagggacttgaatctggtcccctcttttcaaagtccattaagtgtggttgaggtatagtcagccctccgtatctgcgtgttccgtatctgtggattcaagcaactgtggatccaaaatatttgggaaaaaaattaatacaaccataaaaatagaaacttaaaagacaatatagtataacaactgtttacatagcatttacattgtattaggtattaaaagtaatctagaaattatttaaggtatgtgtggggggtatgctttaggttatataaaatatactatgccattttacataaggaacttaagcatccccagattttggtatctatttgggtggatgctgcagaggtgtcctggaatcagtccctcttcaatacccagggatgactgtattttaataatgagaccggtcctagctgtgttatttgctgggaagggatttgggctgaggaccaactagaaaaagtagagctttgagtatttgatttttttttgagacggcatcttgctctgtctcccaggctggagtacagtggcacgatctcggccttgctgcaacctctgcattccaggttcaagcaattcttctgcctcagcctcctgagtagctgggactacaagcacactaccacgcctggcttatttttgtatttttagtagagactggatttctctcactrtgttggccaggctggtctcaaactcctgaactcaggtgatccacctgcctcggcctcccaaaatgctgggattacaagcatgagccaccgtgtccacccgaatatatgatttaattagtggagtgaaagtaccttgttgttagggtttggctttgaaaactaaaagctagagctcaagagtttttgtcttagttttggttcattaaatgggcaaagagggggctgggcacggtggctcacacctgtaatctcagcactttgggaggccgaggcaggcggatcatgaggtcaggagattgagaccatcctggctaacacggtgaaaccctgtctctactgaaaatataaaaaataagccgagtgtggtggcgggcacctgtagtcccagctacttgggaggctgaggcaagagaatggcatgaacccaggaggcggagcttgccatgagccaatatgtcgccactgcactccagcctgggtgacagagagagagtcttgtctcaaaaaaaaaaaaaaaaaaaataggcaaagaggggttcagagcctcaaaaatggagagcagcagaaactcaccaagagaaacaataagaagcacattttataaaaggaattgacaacggttgtgaagagagcttcaaacaaatacttagaagcaggcgtgtaaaaattgagtagaggccgggcgaggtggctcacgcctgtaataccagcactttgggaggccgaggcaggcagatcgcctgaggtcagaggttcgagaccagcctggccaacattatgaaaccccatgcctactaaaaatataaaaattagtcaggtgtagtggcacatgcctgtaataccagctattcagtaggctgagacgggagaatcacttgaacctgtgaggcggaggttccagtgagctgagatcggaccactgcactccagcttgggcgacagagcaaaactctgtctcaaaaaaaaagtcagttagcattgaaacatgcatatgggaaaaacttgcatcaatgaagaaatatactcttaatcagaacaggacaaataacctaaagaggagggaatgaagagcagtgagaggcctgacagtgggaaaacaatgcctctcgggttggaaggcagaaagccaaaaatgcgaaagatacaaatgggtacgaagattggagtaagaaraaagctccttggaaacaggagagacatgattatctcaaagagaaagcgagaggcatgtttggaatctgaagctgaaaacactcaaaagacagatacacagattgaccagaggcttcagagataggcatgagttgaatgacatgtgcagacagcacagcaggatgagcamtgcacggtgaatgtgaggctgaaatactcagaatcatgatgaaagaaaaacacaaaccaggtacactaaggcaaagctgggtgagacagtccaggagacaagtcatayagctttgtcatggcacaacaagacgcaaataggtgagacctaagggaggagaaaaaaatctcaggtgatggctacatgggcatttttatttacttatttttatttatttatttattttattttttagacagtctcgctgtgtcgcccaggctggagtgcagtggtgcgacctaggctcactgcaacctctggttcctgggttcaagcgattctcctgcctcggcctcagcctcctgagtagcgtgaaccacctcacctggctgattgttgtatttttagcagagacagagtttcaccatgttgtccaggctgatcttgaactccaacctcagtgatccacccacctcagcctgccaaagtgctgggattacaggygtgagccactgcgcccggccacatgggcattttttaaatgcctattaggggcgagtgaagctggttctggagaagggatctctgggaaatagtgaattatataccttagacaaagaggctggagaacagtgaaccaacyatgaagtgagagaaaaatgccatgaactcccaatctgctataaagaaacatacatctggcctggtgtggggcccatgtgtgtcatcccagcacttgggaggtcaaggccggaggatggcttgagcccaggagtttgagaccagcttcggcaacatcaggagatcccatctctacaaataactttttaaaaaattagctgggcatagtggtgcgcacctgtggtcccagctgcttggcagactgaggaaggaggatcacctgagcccaggagttgaggctgcaataagccctgatgcagcactgcactccagcctgggcaacagagccaagaccctgtctcaaaaaaaaaaaaaacccacaggagaaacagatgtctaaattcagtagcaaaggttgcagcaaacttgaagtcctaagttagggtaaagagatgaagaggaaatgacaagaatttcttggaaagcaacttagagacccatctggggcttcagtgttactaattctgaaagaaagcaarcgaaaaagtggaagactgcagcagatctaaagaactaacaggacagaatactccacccattcaggtagaaaaagacaaaacaagaccccattattcagaagaaaatagctgcagcaggaatgaaatgtacagatagtccctgacttggcagtggtttracttaggatttcttgactatgatggtatgaaagtgatacacattcagtagaaagtgtatttcgcatacccatacagcaattctgtttgtttgtttgtttgtttgttttttgagacagtctcgctctgtcacccaggctggagtgcagtcgtgtgatatcggctcactgcaacctctgcccagctaatttttgtatttttagtcaaaacagggtttcgccatgttggccaggctggtcttgaactggcttcatgtgatctgcctgccttggcctcccagagtgctgggattacaggcgtgaaccaccatacccagcctcaacatattttcaataggtgatgggtcattatgaaaaaaggacactgaagctaatgtaacactgaaatggtctmaagaaacaggaaactatagacatgttttagaatatccaatacatggcaagaccaaaatatgaaacctatccttttcatgtattgtttgggactgactcatatttgtactctttgtattgctaatttacatagctgtttaaaagrtcacattcatactaatgatatgcaatgatacattttattgagccaagagtaaggtagaacagaacagcccagggcaatgaggatggggcaaggaggcaggagtagaaaacagcccccaaaagaarggcaagatgtcacgtgtatataacttacaattctataagtgaagagctatggttctgaaacttttgcttaactccttgccttaattttttatccctccaatatatattttccctctgaattttgattatatattgatcacagctaacattgagaaataaagtaagtaaagtttttatttcccttagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcycactttcattgtatttcattgaaagtgcttaattaaaatggcttgagaactttgggtagccatgtgtaagaratggatggtattcacmggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaatgcccactgtgatgtsaatgtcaaaatatattcttaagtgttttataactaattgtaaactttttttcagaagtcttattttatacttgtgaaactgaacacaattttgggacaacgtttaaacattacttttcatacttgaaataaacatttattttttaaaaaactaatttgaaaccttcacagctcagtttctttttggtttcctacctttaaaaggacgcattttggaaagtgctttcaaaagctgaaatgcgaggtggcttatgcctgtaatcacagcaccttgggaggctgaggcgggcggatcacaaggtcaggagatggagaccatcctggctaacacggtgaaacgccgtctctacttaaaaaaaaatacaaaaaattaccaggacaaggtgggaggcacctgtagtcccagctactcgggaggctgaggcaggagaatggcgtgaacccgggaggcagagcttgcagtgcgccgagatcgcgccactgcactccagcctgggcgacagagccagactccttctcaaaaaaaaaaaaaaaaaaaagctgaaatgtcacagcagttgtgccagtaggtatttttagattgcgttcacatgagaacacaaaaaaatttactaggttcaggaaatttcaagaaactggaaggcaagatataactttatttctagttttactttatgactacgagaaaagggttggagtttttgttttgagacagggtctcactctgtcgtcaaggctggagtactgcggtgtaggatgaatgttcactgcaatcactgctcctgggtttaaataatcttcccgtctctgcctcatgagtagctgggactacagtgtgctaatacacctggctaatttaaaaaaaaattatttaatttgctaatctttgtattctagtgtgctgccaaagtgagcacataattttgtttttttgtttgtttgtttttgtttcttaatgtttggagaatttttgtggtttttttgtttgttctttgagacgtactcccgccctgttaccctggctggagtgcaattgcgcgatctgggctcactgcaacctccgcctcccgggttcaagcgattctcctgcctcagcctccagagtagctgggattacaggcgcccgccaccacgcccagctaatttttgtatttttagtatagatggggtttcaccgtgttggtcaggctggtctcgaactcctgacctcaggtgatccgcccaccccagcttcccaaagtgctgggattacaagcatgagctactgggtccagcctgtttgtttttttttgagacggaggcttgctctgtcgccaaggctggagtgcagtgacgccatcttggctcattgcaacctccgcctcccgggttcaaggattctcctgccgaatagctggaatcacaggtgcccgccaccacgcccagctaatttttgtatttttagtagagacggggtttcaccatgttggtcgtcaggatggtcttgaactcctgacctcgtgatctgcctgcctcagcctcccaaagtgctgggattacaggcgtgagccatcttgcccaaccctgagcacataatttaaaaatacatacatttttggagacatgagattctaccctgttgtccagactggtcttgaactcctgggctcaagtaatcctttggccttggcctcccaaagtcctgggattacagatgtgagctaccacgcccagagcatgttggttatttttataaaatcttaatgttgtatatatatatataaaattttcatttgaaaactatgtacaaggtagaccaatggattttaatgaaacattgcaatttcttgtgcttttagctttcatattacaaccaacctttaggaaacaactacggtcctctgtcatttaatgacagggatatgttctgagaaatacatctctaggtgatttttttttttttttttaaatggagtctcattcttttgcccaggctggagtgcagtagcacgatctccactcactgcaacttccgcctcctgggctccagcaattttgcttcagcctcccgagtagctgggattacaggcacacaccaccatgccttgctaaagtatttttagtagagacagagtttcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttttaaatagtaaaaatctataaatattgtcatgccaaaataaaagattgattcacctcaggtgatctgcctgccttggcctcccaaagtgctgggattacaggtatgagccactgcacctggccaattttggtcttgtgtgactatcctagaatgtactaggtttgtgtaaacctagatggtacaggttgaatatcctaaatctaaaatccagagctgggcacagtggctcatgcccgtaaaccccagcactttgggaggccaaggcgggcagaccacctgaggtcaggagttccaagaccagcctgaccaacatggtgaaaccccatctctactaaaaatacacaattagcatggtgtggtggcagatccctgtaatcccagctacttaggaggttgacgcaagagaattggttgaaccccggaggcggaggttgcagcgagtcgagatcacgccattgcactccagcctgggcaacacaagcaaaactctgtctcaaaaaaagaataaaatccaaaatgttccaaaatctgaaactttgaatgccaatgtgatactcaaaggaaatactcatttgagcattttggattttgcatccttggattaaggatgcttaggtggtgagtataatgcaaatattccaagatccaaaaatatctgaaatattttcagtcccaagtatctctaataaggtgtagtcaacctagatgtcctactgcatacctaatcactatggtgtatcttattgcttataggctacaaatgtggacatcatgttactgtactgaatgctgtaggraattataacaatagttaagtatttgggtcttcaagcatagaaaagctactgtaaaaatgcagtataaaaaaaaatgatgccgggcacagtggctcacacctgtaaacccagcactttggtaggccaaggcgggtggatcacctgaggtcaggaattcgagaccagcctggccaatatggtgaaacctctgctctcctaaaaatacaaaaattagctgggtgtgttggcgcatgcctgtaatcccagctacttgggaggctgaggcaggagaatcacttgagcctgggaggtggaggttgcagtgagctgacgttgtgccactgcactccaggttgggctacatgaacaaaactccatcttaatgaatgaatgatgtacctgtattgggcacttaatatgaaccatgaatagcgcttgcaggactggaagttgcttgcaagtcagtgaattggtctgagcaagtgaatgtgaaggcctaagacattactgtatactactatcaactttatgaacactgtacacttaggcgaccctaaatttatttttattttttactgcaaaacggggtctctgttacccaggttgaaatgcagtgctgtagtctcagcttgctgaaacctccgcctccctgtttcaagcagtcctcccacatcagcctccagggtagctgggaacacaggcacgatccagcatgtccagctaatttttagtaactaaatttattctttaaaacttaaatagaacttagcttatggtaactatattaactttttaaacttttaacttaattttaattttggttttggttgtttttttgttttttttagacggagttttgctctgcctcccatacaggctggagtgccgtggcacaatcttagctcactgcaacctctgcctcccaggctyaagctattctcctgcctcagcctcccaagtagctgcgattaacaggtatgtgccaccacgcccagctaatttttgtattttaactaaagatagtttcaccatgttggccaagctggtctcgaactcctgacctcaggtgatccacctatctcagcctcccaaagtgctgggattacaggcatgggccactgcatcaggccattaattgtaattttttttattcatttcaagacagggttaagaaactgctaattttgtatttctggtagagacaggrttttgccatgtttcccaaaacagtctcaaactcatgggctgaagcaatcctcccgcctgggcctcccataataaagtgctgggattacaggtgttagccactgtgcccagccgccaaatttttagctttttaactcgtaataacatggcttaaaacacaagcacactgtagagctgtacaaactttttttttgagacagagccttgctctgtcacctaggcttgagtgtactggcgtgatcttggctcactgcaacctccacctcctgggttcaagtgattctcctgtctcagcctcctgagtagctggtattacaggcatctgccaccacgcccaggtaatttttgtatttttagtagagatggggtttcaccgtgttggccaggctggtctcgaactcctgatctcaggtggtctgcccgcctcggcctcctagtgctgggattacaggtgtgagccaccacacccagccttttcaaaattttctttatactttttgtataagctcttttttattaaatttttttttaactttttttcaaattgaaaactaaaagatgggcacagtggctcaccaaggtcaggagatgactggacacagtgcctcatgcctgtaatcccagcactttggtgggccaaggtgagcagtattgcttgagtccaagagttcaagaccagtacaacatgctgaaacccggtctctaccaaaagtacaaaaattagccaggtttggtggtgtgcacctgtaatgccagctacttgggaggctgaggtgggaggattacttcagccctgtctccaccccgcccccmcaaccaaaaaaaaaaaaaacagaaccaggaaaacattaaccttggcttccacgtagtcaggatcatcagtatcacttgtcttcctcctctacatcttgccccattggaaggtcaccaagggcagtaacacgcatggagctgtcatctcctgtgataacagtgccttctggaacacctgaaggacctggctgaggctgttttatagtttttgttttgttttgtttttgagacggagccccgctttgtcgcacaggctggagtgcagtggcgcagtcttggcttgccgcaacctatgcctcccaggttcaggcaattctcctgcttcagcctcccgagtagctgggacaacaggtgtgagccaccgcacccaagcctattttttaatttatttaaatttaaaaatattttttagttttttaaaaagtaggaagctgggcacagtggctcacgcctgtaatcccaacactttgagaggccgaggcaggcgaatcacgaggtcaggagattgagaccattctggccaacatggtgaaaccccatctctactaaaagtacaaaaaattagctgggcatggtggtgtatgcctgtagtcccagctactcgggaggctgaggtagaaggatcacttgaacccaggaggcggaggttgcagcgagctatcacaccactacactccagcctggcgacagagtgagacttcgtctaaaaaaaaaataagtaggaataaattaacgtacataaaaagcataacatactaaacacaaaccagtaacagtcatttatcattgtcaagtattatgtactgtatatatttttaagtcagatttgtaaaaatataaaactgccaatcttttctcattctcctggtaagtatttttcataaacatttatttggctgggtgcagtggctcacgcctgtaatcccaacactttgggaggccgagctgggtggatcacctaaggtcagaggtttgagactagcctggccaaaatggtgaaaccctgtccctactaaaaatacaaacattggtgggctcggtggctcatgcctgtaatcccagcactttgggaggccaaggctggtgaatcacgaggtcaggagttcgagaccagcctggccaacatggtgaaaccctgtctctactaaaaatacaaaaattagctgggcgtggtggcttgggcctgtagtcccagctactcaggaggcagaggttgcagtgagtcaagatcaagccactgcactccagcctgggcgacagagtgagactgtctcaaaaaaacaaacaaaaatagaaaagttaactgggtgtgatggcacgtgcctgtagtctcagctgctcaggagtctgaggcagaggttgtagtgagctgagactgcgcgccactgcactccagcctgggagacagtgagactcagtctcaaaaaaaaaaaattatatgaatgtaatgggttcatcattttaaaatgaagtatcttcaaaatttgtttcaagttctcatggaatcgatattgataaatatatcttggtattcttcagtttttaaggttgtaaaaataaatacttttttggagatagggtctctctcacccaggctggggtgcagtggtgcgatcttggctcactgcaacccctgcctcctgggcttggacagtcctcccactctagccgcacaagtagctgggaccacaggcccgtgccactggcctgctaatttttgtattttgggagtttttttgtagataatagggtttcgccatgttgcccaggatggtgaactcctgggctcaagcaatctgcccacctcagcctctcgaagtgttgggattacaggggtgagccgctatgcccggtcccaaagtcagtctctaacctaatctctgaaatgatgtgtcaattttgctactttctatttgctagaagtgagtcacagaattccagcccatactcaagggggttatccaagggcataaatattaggaaatgtgctttttaaaagtttctggaggctgggtggcgtggcttacgcctgtaaccccagcactttgggaggctgaggtgggtagattacctgaggtcaggagttttgagaccagcctggccaacatggcaaaaccttgtgtctactaaaaatacaaaaattagccaggcacggctgggcacggtggctcaatcccagcactttgggaggctgagacaggcggatcatgaggtcagaagatggagaccatcctggctcatatggtgaaaccccatctctactaaaaaatgtaaaaaaaaaaaaaaattagccaggtgtggtggtgggcgcctgtagccccagctactcgggaggctgaggcaggagaatggtgtgaacccgggaggcagagcttgcaatgagccaagatcgcgccactgccctccagcctgggcgagagagtgagactctgtctcaaaaaaataaaaatgtgtatctctgtcattgggattcctataagcttgtgcctagacaggatagttattttatctttaagaccctgttaaagcctgcctgaggtcttatctgcattcccctgtgggctgactcagcacctggttgccttgtattctcctgattatgaatctttcaacctctaggacatggaccattaacgtttagtatacttggctgtagctactttaagcttagatatctgccttcgaatattctaccttttttaaaataaaatataaatgtctagtgattctttcgttgttgtttttattktttggagacacggtcttgctgtgccacccagactcgagtgcaatggtgtggtcacagctcactgcagccttgaccttctgggctcaagtgatcctcccacctcagcctcctgagtagctgggactgcaggcgtgcaccaccatccttggataattttttattttttagagaaatgaggtctccctgtgttgcccagtctggtcaggctcaagcaatcctcccatgtcagcttcccaaagtgctggattacaagcataagccaccatgcctggctgtatcctgctttctgttataatagagtggattttgtcatcttgatagcccacacaacgttggtccgtttctttgatgatattatgctaattggacctgacaagcagaaaataataaacatcctacaagacttaataaaacacatgcatgacgggatgggaaggaaatcttgaataaaaattcatgattgaccacattcgtaaggtttttagggtctgattgtagtcttgtgtatattgtaccatctaccacaaagagaaatgtttgatgagcctgtgtgaagtttggagggaacatacaccatctatggacatgccaccttatggacgtgtcaccctaagcaatttatcaggtaacacacacacagctctaatttcttttttttttgagatggagtctcgctctctcgcccaggctggagtgcagtggccccatctcagctcactgcaagctccgcctcctgggttcacgccattctcctgccttggcctcctgagtagctggggctacaggcacccgccaccacacccagctaatttttttgtattttttagtagagacggggtttcaccatgttagccaggatggtctcgacctcctgagttcgtgatctgcccgcctcggcctcccaaagtgctgggattacaggtgtgagccaccgcacccggcccacacagctctaattttatgtgaggcctcaagcaagcaaaggctccacagcaggaccaggctgtggtgcaagctgccctgccccttgggcctaatggcccagcaggcccaatggtacagggaatttctactgtgtgtgaaacctcttgcttttaggagaatcctagtaaaccccctatgaccttttctgacaagtacattccatttgaacacaaattgtaaaacctgaactgttgatgaatttgatgtcatctgattccaaaaaccataaaatttgactcatgcagcagcatttcattgttaaatgaaaatgtatatgtaagactagcccaagcagttcctgaggacacaattaaaacatacaagcggccgggcacggtggctcacgcctgtaatcccagcactttgggaggctgaggtgggcggatcacgaggtcaggagatggagaccaccctggctaacccagtgaaaccctgtctctactaaaactacaaaaaaattagccgggcatggtggcgggcgcctgtagtcccagctactcgggaggctgaggcaggagaatggcrtgaacctgggaggcggaggtggcagtgagccgagatcgtgccactgcactccagcgtgggcgacacagcaagactccatctcaaaaaaaaaaaaaaaaaaaaaatcaagtagcttgctcggggttccataacacctcttccttctgtttctctggctttccctcagtccacayataaggcttcatgagagaagacacgaatggatataaaccaatgggaataaaccaagacaagtcctggtttatgaattggtctgcacagtatactggctccagctggaagtattacatagcctcacttagagatgaccctaagagacagtgataaagccaacctcatatcttgctaccagaagcacatgagaataattcttttaagaggctttaaaatcccagctactcaggagggtgaagtgggaggatcccttgagcatcggagcttgagaccagcctggacaacatagtaggacactgcctcaataaaaaattaagtaaataaatagatagcttttgagttatctatactgtgatataatacaccacaccctttacaagagcaaattctggggcatgattaaatgaaaagcaaaggtagtacttcatagcatctgcaaactggcatagtgcagacaggcaaaaagcaatggtaaataactactggaacatatgtagaaaatgtcctgtttggcatctactgcagagtaggctctcaatcagatgggtaagatagctagtcctatggatgtcagcctttttccccagccaccctggtgcttaataggcccatttataaagtgccatggcaacaagaaaggaggtctgcatggacttctcactgaggcttctctgcccatgcaccaagagtcaaggctrtgctgggcccctgactgatcacaccattctccagggaaccaatgagcctcttggtggtagattgatacattggaccctttctacacagaaggagaagcaatttgtgcctttgggaatagaaacattccaaatatgaatttgcctgccagaaatggtcctgctggcactaagcagaaggcctattcattgctgtgatattccatacaaatcactaagcaacctgtctacagtgaaggacacgatgagagagaattacactgatamaatttactagcactaccacaagccccaaggacccagaagcatctgacttgacaaaatggcagaatgcctgctaacagcttagttactacattagctggagaaaattagctggaggattagaaggctgtcttacagaatgaatatatgacttaagccwgtagctaatatttggtgacgtctcccgcatagccaaataccgcatgaaccgaataaccaaggggtggaggtttggaatggcccctttcactttttccctttttattttaatttatttatttgaggagttgctgtgttacccaggctggagtgcagtggtgtgagcacagctcactgcaacctcaacctcccaggctcaagtaatcctcccacctcagcctcccaagtagctgggactacaaacatgcgccacyacccccagcttatttttgtggttttagtagagaaggggtctcactatgttgcccaggctggtctcctactcctgggttcaagcaatcaacctgccttggcctcccaaagtgctyggattacaggtgtgtgccactgcacccagccaacattttccctttttaaagaaaagaaacataattcagacatacatataaagcatacaattcagtgatatttttttagtatatttataaagttgtacaaccatcaacactatctaatttcagcagattttcatcatctccaaaagaaactccatatccattagcagttcactttccattcacaccaccctacccctagcacctgacaaccactaagctactttctgtctctatcaatttacatattctgtgcattttatattaataaaatcatgtaatatgtgaccttttgcatctggctcttttcatttagcataatgttttcaaggcttatctgtgttgtagtatgtatcaatatttcattccttttggccaggcatggcagctaacgcctgtaatcccagcactttgggaggccgaggtgggaggatcacctgaggccaggagttcaagaccagcctggccagcatggtgaaaccctgtctctactaaaaatacacaattagccaggaatggtggcacatgcctgtaatcccagctactcaggaggctaaggcaggagaatcacttgaactcgggaggtagaggttgcagtgagccgagatagcgccattgcactccagcctggcgacagagtgagactccctctcaaaaaaaaaaaaaaaaaaaaaaaaagaaaagaaaacacaacttcttcctttgctatgctgagggcctactgatgggcaagttttagcacacatttttaggaggcttagctacaactacatttaattacaatgacttggaggagtcccacttttctggccttctcataccagatgaaattccaaaacccgggctggatgcagtggctcatgcctgtaatcccagcactttgggaggccgaggtgggtggatcacctaaggtcaggagttcgagaccagcctggtcaacatggtaaaaccccatctctactaaaaatacaaaaaattagccgggtgtggtggcgagtgcctgtaatcccagctactctggaggctgagacatgagaatcgcttgaacctgggaggcggaggttgcagtgagccgagatcgcgccactacactccagcctgggcaacaagagcgaaactctgtctcaaaaaaaaaaaaaaaaaaaaaaaaatatatatatatatatatatatatatatgtatgtatatatatgtgtatatatgtatatatgtgcatatatatgtatatatatgtgtagatatatgtatatatgtgtatatgtgtatatatgtatatatgtatatatgtgtatatatgtatatatgtgtgtatatatgtatatatatgtgtatatatgtatatatatgtgtatatatgtatatgtgtgtatatatgtatatatatgtgtgtgtatatatgtatatatgtgtgtatatatatgtatatatatgtatatatatgtgtgtgtatatatatgtatatatatgtatatatatgtgtgtatatatatatgtatatatatatattagctgggcgtggtggcaggctcctgtaatcccagctactcgggaggctgaggcaggagaacgcttgaacccaggaggcagaggttgcagtgagccgagattgctccattgcactccagcctgggcaacaaaacaagacgccgtctaaaaaacaaaaaaaattccaaaagctcctgtggrcagaaggattcttccccagctttttkctgtcttggcttatctctgttgctgacctgctgtcttaaccactgccctccagttgccgcatgcctgttgatgataagagtgtcctggcacatgatcagtaagcaccttcaggaggctggtgaggcttatcggtctcagcctgctgctgccacgaccccctggactaggcctcaggcaaccggaatttaagcytctgcaacatckagaagcataagttctcttcttcagtttcttcacctataaaaaaaacagagtttcactctacgatttttaaagtttgttgtatcatctaattccaaagggattaggccttcagaagatgacgtggaaagttcaaaagaaattaaaaatcatctaaaatcccatccattagcagtaacaatgattaatatctggctatatgtcaaatagctcgtgtctagggcccattccaaagctctaagtttcttctcacggatgcagtggacatttgtgtaagtttacttcacttcagttacactggccttttttgcagccctcaagtgttctccttctttttttttttttttttgagatggagtctcactctgtcgccacgctggagtgcaatggcacgatctcagctcactgcaacctctgcctcccgggttcaagcgattctccgacctcagcctcctgagtagctgggattacaggcacgcattcatcatgcttagctaattttgtatttttagtagagacggggtttcaccatgttggtcaggctggtctcgaactcccgacctcaggtgatycgcccacctcgcctcccaaagtgctgggattacaggtgtcggccactgtatctggccctcaaatgttctaagcagactctacctcgaggcctttgcacagacttatctgtctgtctggaacaatatctgcctagatagctacatagacactcccttcatacaggccccaaatgtcatttttcagagataccttctctggccacctgatacaggttacacccgcatccttgggctgatttattttttctcacagtgtctaacacaatcctcagtggaggattaataagtttatytgtttattgttctctcctactagaatttaaatttaaatctatgaggacaggaactttgtttttttgtttgtttgtttgtttgagatggtgtctygctctgtcgcccaggctggagtgcagtggtgcgatctcctctcactgcaagctccacctcccgggttcaagccattctcctgcctcagcctccccagtagctgggactacatgcgcccgccaccacgcccggctaatttttttgtatttttagtagagacggggtttcactgtgttagccaggatggtctcgatctcctgaccttgtgatccccccgccttggcctcccaaagtgctgggattacaggctgagccaccgcacccggccggaactttgtttttttttttccaagtggctacttttatttatttgaaaaaaacaagccccagagctgccaaggggctgccttctctgtcttgtggagacagtgcttgatcctggagagcagccatgttgaraaaaagatattttgagccctaaaataatgagaaaacaggacagagagaggtgttctgagccagttccagattttgccaactgttgcaagaactctagaatctttatgttagtaaaatgccaaaaataaaagtctgcattgaaagaacgtctaaccacttactataatccaaccttttaggaagaatgcaaaatggcatacatgaagaagagggaagaatccagaaaaactggaattcctacaaagaaaagtctatagaaacgtcccaaaagcaagtaagcaaacagataacactcaggacctctcatattcatggaagtcatttatagtataaatccccttaaataatggactcaggaggccgggtgtggtggctcacacctgtaatcccagcactttgggaggccgaggcgggcggatcacaaggtcaggagatcaagaccatcctggctaacatattgagaaggagtctttctccttcacccagactggagtgcagtggcaccatctcagttcactgcaaccttcacatcccaggtttaagtgattcttatgcctcagcctcccaaatagctgggattacagacatgcaccaccacgcccagctaatttttgtgtttttagtagagatgaggtttcgccatgttgtccaggctggtcttgaactcctggcctcaagtgatccgcccacctcagcctcccaaagtgctgggattacaggcatgagccaccgcgcctggcctgctctgtaactttaactcctggtgtattccttgaggtctgttgaagtctggatcacagaccattgtgggaggtggcaactttctaatgcattaattagattgaaagatttgaaagaaaaagtttacatttttttttcctgggattacatcaaattaaataacctctgcacaacaaaggaaacaatcgacaaaatgaaaaggcaacctatggaataggagaaatatttacaatctgtatatctgataaggggttaatatctcaamattttttttcttttttctttatttttcttttatgtccacttccaagctcaaatatctcaaatattatgtaagaaactcacatagctcaatggcagaaaaccaaataacccaactgaaaaatgagcaaagacctgaatagtccttttaccaaagaagatacacaaatggccaacgggtgtatgaaaaggtgctcaacatcattaattatcagggaaatgcaaatcaaaactacaatgagtatcacctcacacctgttaggatggctattataaaaaaggcagcagccaggtgcagtggctcaggcctgtagtcttagcactttgggaggctgaggtgggtgggttgcctgagctcaggagttcgagaccagcctgggcaacatggcaaaaaccygtctctactaaaaatacaaaaaattagctgggtgtggtggcacatgcctgtgaccccagctaggaggctgaggcatgagaatcgtttgaacctgggaggcagagattgcagtgagccgagattgagccactgcactctgtgactctgtctcaaaaaaaaaaaaaaaaaaaaaggccaggcacggtggctcatgcctgtaatcccagcactttgagaggctgaggtgggcggatcaccggaggtcgggagttcgagaccaacctgaccaacatggagaaaccccgtctctattaaaaatacaaaattagccgggtgtggtggcrcatgcctgtaatcccagctactagggaggctgaggcaggagaatcacttgaacccgggaggtggaggttgcggtgagccaagatcgtgctgttgcactccaacctgggcaacaagagcgaaactccgtctcaaaaaaaaaaaaaaaaaaaaaagtaactctgtgatgtaaagaatatatcaattagtttggttgtggtaatcatttcacaacgtgtaccaaattttgatgttgtacagcttaaatatatataattgttctcaattatgccttaataaacctgggaaaaatttttcctgaaggtttatgaatttaaaatgaaaacacacacgaggccgggtgtggtggcttacacctgtaatcctagcactttgggaggccaaggtaggaggattgtttgcggcccagagttcaaccaacctgtcaaatatagggagacctcatctctattatttatttatttatttatttatttatttatttatttatttttattttttatgagacagagtcttgctgtgtcgcccaggctggagtgcagtggcacgatctcggctcactgcaacctccgcctcccaggttcaagcgattctcctgcctcagcctcctgagtagctgggactacaggcgcccgcctccacgcctggctaatttttcgtgtttttagtagagacggggtttcaccgtgttagccaggatggtctcaaaagcatgacctcgtgatccgcccgcctcggcctcccaaaagtgctgggattacagcgtgagccaccgctcccggcatatttatttatttatttgagacggagtttcacacctgttgcccaaaatgggagtgcaatggcgcgatctcagctcactgcaatccccgcctcccgggttgatgcgattctcctgcctcagcctcccaagtagctcggattacaggcacatgccaccacacctggctaattttgtatttttagtacagacagggtttcacaatgttggtcagatggtctcaaactcctgacctcaggtgatccacccatctcggcctcccaaagtgttgggattacaggcatgagccaccgcccccggccctgtattttttataattaataaaataaaatgaaacgaacaggagtatacgttagaacagaatgcaaatctgcacaaaaaatttaagataaaactggggcatataaagacatgttttagccaagcatggtggctcacaacttaaaatcccagcactttgggaggctgaggtgggaggattgcttgaacccaggtgttccagactagcctgggctacatagtgggacgcccccctccccccatctctattttttaaaaataattttaaggccgggggcagtggcttacgcctgtaatcccagcactttgggaggccgaggcaggcggatcacgaggtcaggagctccagaccaccatggccaacatggtgaaaccctgtctctactaaaatacaaaaaattagccaggcgtagtggtgcgcgcctgtagtcccagctactcaggaggctgaagcaggagaatagcttgaacccgggaggcggagattgagccgagatcgcaccgccgcactccagcctggcagcagagcgagactcagtctcaaaaaaaaaaaaaaaaaaaaaaaaaagacaggttttgcctggagtgcaccctataatggtcgagagggaagcacattcactctttaaraaggaaggccctaaggagaaggcacttcactgggaaagctggaagatgggggtgcttacagcagaggagcaggaggaaggaagaaagaaagagcaaataacccgggccacaraaagccaaragttttggctgttgcagtccacagtattatcttgttcctagtattagcttgctcctagttccacaacatcaacaatggagcatgaaaatgtaaacacctaaccaaatatttgcaccttttggatgatttcccacttctaraaaatgaaaaatatttggttgtttacagtccccatccatttatctgttcccttccttccagttttttgctaaracagtgggacaccctggctggagagcaatattcagtttatagcttgattttgtttacccctgagaccaaggacaattttatctatgtttttaaaggcagaagatagaaataaaatctaaataacttgtccttgagcctgacctaaagcctagacagtggaacagaattcgggaktaaggagcctggagagggtggagtaagtttattcaaattaataaatgctaaatcagaattatttaaaaaatttaggcagatgattactcactctccctgtctttggaatgttttagagaggtattaatgaacaatcttattagcacagaccaggactcttcttgattcaattgcatgaaattgaaaagaatttaaagatactttctcatgtgatttcatgccttttccttatactgatgcccacatgttgtgaaacatataattctcgcaacaagcctgtattataatcctgttttagatgaagacagctgaggccaagaagggttatataatttgcccaggccaggtgcggtggctcatgcctgtaatcctagcactttgggaggctgaaaagggtggatcacttgaggccaggggttgagactagcctgggcaacatggtaaaactctgtctgtactaaaaatacaaaataaacaaattagctgggcgtgatggcccgcacctgtagccccagttactcaggaggctgaggcaggagaatcgcttgaacctgggaggtggaggttgcagcgagcagasatcacatcactgtactccagcctgggcaacagagcaagactctggccactccaccccaccctscaaccaaaaaaaatcaaaaatcaaaaaagagataaaaataatacataaaataatttgcccaaagacacatggatgacaagtgtcagagtcaggttataaacacaggcaagaagataacactgcctcacactgctattttgtgtattttgaagttacgagtaagaaaggatgtctcctatacttcattaacttttttttttttttttttgagacggagtctcgctctgtcacccaggctggaatacagtgatgcgatctcggctcactgtaacctytggctcccgggttcaagckattcccctgcctcagcttcctgagtagctgggactacaggcgcctgccaccacggccagctaattttttgtatttttggtagagatagggtttcaccctattagccargatggtcttgatctcctgacctcgtgatctgcctgcctcagcctcgcaaagtgctgggattacgggcgtgagccaccgcgcccggccttcattaactttttactcattcttcagcaatcatacattgatgaaggaactgaaaagggggtaagaaggttgtgtgaaaggaaaataaatcttggcgtcccaaaatcactaagctaaaaggaaaaaaaaaagtcaagctgggaactgcttagggcaaacctgcctcccattctattcaaagtcatccctctgttcactgagataaatgtgtatctgattgcctcctttggagaggctagtcagaaactcaaaagaatgcgaacatctgtctcttatctacctataacctggaagcccccttccctcttcttgttgtcccggttttccttctagttgtcccacctttccagatggaaccaatgttcatctacatatgttgattgacatctcctgtctccctaaaatgtgtaaaaccaagttgtgctctgaccaccttgggcatatgtcatcaagacctcctggctgtgcacctgtaatcccagcactttgggaggtccagatggcagatcgcttgaggccaggagttccagaacagcctggccaagatgatgaaaccctgtctctactaaaaatacaaaaattagcccagcatgatggctcacgtctgtaataccagctactcaggaggttgaagtaggagaatcgcttgaactcaggagttcaagtggaggttgcagtgagctgagatcatgccactgcactccagcctgggtgacagagtggagactccttctcaaaacaaaacaaaccttctgaggctgtgtcatggacacaggaccttaacttcctaaattgactgagatctgtctcagatttgggggttcccagttctaattccatatgctcccattctgaagtctccctaaaaaatgtttcttctcgtttgaagatggcttttgattattttatttttctcacttgtaagacaacttactcttgatgttaaaaacatcttactcggccatacacagtggctcacgcctgtaatcccagcacgttgggaggccaaggtgggtggatcacctgaggtcaggagttcgagaccagcctggccaacatagtgaaatctcatctctactaaaaatacaacaattagctgggcatggtggcacgcacctgtagacccagttactcggcaggctgaggcaggagaactgcttgaacccgggaggcggaggttgcagtgagccaagattgcgccatttcactccagcctgggcaacaagaaaactcaaaaaagaaaaaaaatcttactcatcttgtagggagggaaagaaccctttttcttctgccctcctggggtgggggctgcaaattaaactgaaaaaaaccagaytgacatgtaaacatgtggaaactcagtgataaacaatgccatcaaaggagtggttagaatttgggtttaacaaaagaataagaaatttgtaaagaagtgaggagacaaaggtgaaggtttcaggcttccaggggtagcaaactgggaagaaacaaatggaagatcagggttgttttagtaaggtttcttatgcagattcttctcagtcttcctggacagagtctagagttttcaccagtgattatcaatctaagtctgtttttaagcaaatgaaggaaagagtaggccttgcctgcctgcttgtctgtctgtctttctttcttttccttctttctttctttcttttctttctttttctttctttctcttttcttcctttcttcctttctctttyytttctttctttctttctttcctctttcttctttccttcttttccctccctccctccctcccttccttcgttcmttccttccttccttccttctctctttctctctttctttgcatctgctgttcctgaatcatcttcagctcaaaacagtccttatttaggggtggcatattctgatcccctacaatataatttaacagaaactgtataatcagagaaactgtataatcagaaccatttcttctggacagtattataaactaactgcaaaaagtaaaaacagaaattatttcattttgttttgaacattcagaatatagtgttctagcagggattatgtccatgagcaaatcagtaaataatttggagctgtgataaaaatgataaaaatgtctctcttcctcaaaaaaaaaaaaaggttaagaattaaaaggcaggccgggggtgagccgcagctcatacctgtaatctcagcactttggaaggccaaggtgagaggatcatttgaacccaggagtttgggatcagcctgggcaaaatagtgagaccctgtgtcttctaaaaatatatattgtaggccgggcacggtggctcatgcctgtaatcccagcactttgggaggccgaggcgtgtggatcacttgaggtaaggagttcgagaccagcctgaccaatatggagaaaccccgtctctactaaaaatacaaaaattggccgggcatggtggcttgcgcctttaatcccagctacttcggagactgaggtggaagaatcacttgaacctgggaggcagaagttgcaatgagccaagatcgtggcattgtactccagcctgggcaacagagtgagactccatctcaaaaacaaaaacaaaaacaaaacagacacacacacacacacacacacacacacacacacacacacatatatactaaataaattaaaagaaaaaaagaattgaaaggcaatctccatctcacatagaggactgggccttgatgtataaagaacatgaggaacaatgcacatgtccatcagctggtgagcaaataaacaaaaggtggaaaatgtatgcattggaatattattcaacaatgaaaagaaatgaagtacttatacaacctgggcgaaccttgaaaacattaattatggtaaatgaaaaaagcagtcacaaagtgttacatattgtctgattccatttatatgaaatgcccagaataggcaagtctatagacccagaaagtagatttgcggtttcctagcgcttagggcaggaagggttggtgaaaggattgggggtgacagccaaagagtatgtggtttcttttggagatgataaaaatagtctaaaattgactgtgatgatggatgcacaattctatgaatacactaaaaaccattgaattgtatgctttaaatggacgaattgaatgattctgaatcctatctcaataaagctgttaaaaaaaaggttttatgggccgggcatggtggctcatgcctgtaatcccagcactttgggaggccgaggcaggtggatcacgaggtcaggagatcaagaccatcctcgctaacacagtgaaaccctgtctttatgaaaaatacaaaaaattagctgggcatggtggcaggcgcctgtagtcccagctactcgggaggctgaggcaggagaatggcgtgaagctgggaggcagagcttgcagcgagccaagatcatgccactgcactccagcctgggcgacagagcaagactccgtctcaaaaaaaaaaaaaaaaaggttttatggctgggcttggtggctcacacctgtaatcccagcacytttggaggctgaggtgggaagattgcttgagyccagaagtttaagaccaaacaaaacaacaaaaccaaaaaagccagacccagtggtgcccaagtgcctgtagtctcagtgactcaggaggctgaggtgggaagatcacttgagctcaggagatggaagctgcagggagctgtgagggcaccactgcactccagcctggatgacacagagagatcctgtccccaagaaaaaaaagtttcgtataatttaggtaattgttagtaagagtgaaatgacatttgttggtgttaactatcaaatctgaaagaagatcagaaaattaaactgttgatcaagtaaagctgagtttagattcacggcagcaagggagaataccaccttaacagaatcttagttgtgtctcagaagagggaactgtgtctgcacacacacacttacacataggctaaaaaactgtgactaggccaggcrtggtggctcacacctgtaatcccagcactttaggaggctgaggcaggtggatcatgaggtcaggagttcgagaccatcctggctaacacggtgaaaccccatctccactaaaaatacgaaaacttagccgggcgtggtggtgggcatctgtgggcccagctacttgggaggctgaggcaggagaatcacttgaacctgggaggcggargtttcagtgagccgagattgtgccactgcactccagcctgggcaacagagcgagactcttgtctcaaaaaaaaggaaaaactgtgactagttcttgtttatacgattggggcaaagaagtttctccctcgcctttgggaagtttgctgaaaaatcacctaataataaggcagattgagaggaaaagcatacaaattaacttgaccatgcacatggagaaaaccagtgtgattgctcaatatcccaataggacacaaataataataataattattattatttttaattttttgagacasagtctcactctcttggccaggttggagtgcagtggcacaatcccagctcaccacaacctccgcctcccaggtttaagcaattctcctgtctcagcctccagagtagctgggattacaggcgcccgacaccacacccagctaatttttatatttttagcagagatagggtttcaccatgttggccaggctggtctccaatgcctgacctcaagtgatctgcccacctggacctcccaaagtgttggaattayaggcactagcctcagcacctggccccaaacacttatataacctcttttcagaggggtgggggagatggggaatataggtagttcagtagaggggcattaagtgatgatttaggtgaataaatggatgggggaacacagattgacttgcaaatagttttctttggaagttaaatgaacctgagagacagacattattttgcaaaaggattgggcctgctctggttaccttcctcaccttctttcctgcaatagataatgagataacagggaagggaagaaaaagcaattgttctcttgggggctctgggtctttatgtagattggggaaaaatctcttccaaggcctgataatctctaagagtttttattttatttatttatttattatttwwtttwtttatttatttatttatttatttatttatttatttatttattttcagacagggtctcactctgtttgttgcccaggatggagtgtactggctcccttgaggctcattgcagcctccacctcctggatcaaaggatcttcccacctcagcttcccgagcagctgggataacaggtacacatcaccatgctcggctaatttttgtatttttttggagagacggcatttcatcaagtttcccaggctagtcttgaactcctgggctcaagcaatctgcatgccttggcctcccaaagtgctgggattacaggcatgagccaccaggcccagattatttatttatttatttatttatttatttattatttttattttttgagacggagttttgctcttctcacccaggctggagtgcaatgacggggtctctgctcactgcaacctccgcctcctgagttcaagcgattctcctgcctcagcttcccgcgtagctgggattacaggtgcccaccaccacgcccagctaagttttgtatttttagtagagacagggtttctccatgttggccaggctggtcttgaactcctgaccttaggtgatctgcctgccttggcctcccaaagtgctgggattacaggcgtgagccaccatgcctggccaccaggctcagtttctaagaattttttgtttgtttgtttgtttgttttgagacagggtttcacttctgtcatccaggctggagtgcagtggcgcgatctcggctcattgcaacctccagctctcaggcggctcattgcaacctccagctctcaggctcaagcgattctcctaccttagcctcccaagtaactgggactacaggcgcacaccactgcacacagctaatttttgtatttttatttttattttattttattttattttattttattttatttttctgagattgagtctctctgtgtcacccaggctggagtgcagcagcgcgatctcagctcactgcaagctccgcctcccaggttcatgccattctcctgcctcagcctcctgagtagctgggactacaggcgcccaccaccacacccggctatttttttgtatttttagtagagatgcggtttcaccatgttagccaggtctctatctcctgacctcgtgatctgcccgcctcggcctcccaaagtgctgggattacaggtgtgagccactgtgcccggccttttgtatttttagtaaagatggggtttcgccatgttggccaggctggtcttgaactgacctcaagcgatcttcccaccttggcctcccaaagtactgggattacaggcatgagccaccattcacagaagagtgtttaattcaaaatattcattatacaagggagtcatattttggggtgaaatttccttttctccttcaatacaataattaaaagaaggaatactgttgttacttttatggtttagtcaatttacattttcagtgggttactgtgtaattcaataaaattattaatccttaaaatacatttgttggccggacgctgtggcttatacctgtaatcccagcactctgggaggccgaggcgggtggatcacctgaggtcgggagtttgagaccagcctggccaacataaagtgaaaccccatctctactaaaagtaaaaaattagccaggctcagtgaagtgggcctatagtcccagctactcgggaggctgaggcagaagaatcgcttgaacctcctgaaaagcggaggttgcggtgagccaggattatgccactgcaattcagcgtggtccagagtgagacaacgtctcaaaaaaaaaaaaaaaaagtcaactgtrttaggtattataagtaatccagagaggatttaaagtatataggaggatgtgcataggttatatgcaaatactacaccatcttatataagagatttgagcactcacagattttgttattcaaggaggtgctggaaccaatctcccacagatacatagggaacgacgatgttctggctttgttatagttcacgcatctatcttcccgtttattcaactcaaaaattattagacatcttttgtgtacctacctctgtgttagagcagggcatacagcagcaaataagataatgtccctggttttagataagttaaaatttagcaggaaaaacaggtattatattttacaaattaaatctcatatttttaagcatattttaacaagaaaaaaattckctgtgaattccattgtaacgttttacatataaaactctccctcttaagtctctaaacttttttttttttttttgagacggagtctcgctctgttgcccaggctggagtgcagtggtgcgatctcagctcacygcaacctccgcccctccaggtttaagcaattctcctcctcagcatctagagtagctgggattacaggcgtgtgccaccacgcccagctaattttttttgtatttttaatagagacggggtttcaccrtcttggccaggctcatcttgaactcctgacctcgtgatccacccgcctcggcctcccaaagtgctgggattacasgcgtgagccactgcgcccggccttaagtctctaaatttttaaaaaatgcatttaatactaaggtctcaaacagttttctakacatgtaaatcaaaaacccrtttaattaattaagatcctggggggaaaaaaaggttacttgctgaacaaaatgaagtttacttataggaaatagcactataggaaagtagacagcatttttcaggagttgtccatgaatgtatctttttttttttgtaatttaaaaaaatacaaaaaagtacgtagaataataaaacacacctgctggagaaatggaactaaaaacaaaatctccaataagtctttccacaaagatagtagaaaaataattttattattgaataagcattaaatcaaaatgtgatattcaccacaggcaatccactaagagattacaaaacagaatgtaatctgttttgtaaaagtctcccttttatgtagctaagcagacacaacccttaacatagatgttcttgagataagctgcaagtcctaagtaagctgacctgacagcactatttgtaacaaatagttcattctaaattcacctggtaattaagggtgaccatctgtggtaattggtaaagttasctgaaaggggtcctgattcagaccccaagaaagggttcttagctctcgcacaagaaagaattcgggatgagtccatagggtaaagtgaaagcaagtttattaagaaagtaggccaggcacagtggcttacgcctgtaacctcacaactttgggaggcygaggccagcggatacgaggtcaggagttcgaggctagcctggccaacatggtgaaaccctgtctctattaaaataacaaagattggcccagcctggtggtgtgtgcctataatcccagctaattccaggaggctgaggcaggagaattgcttgaacccgaaaggcagaggttgcagtgagccgagatcacaccattgcactccagccttggcaatagagtgagactctgcctcaaaacaaaacaaaacaacaaaaaaagaaagtaataaagaatggctaccccataggcagagcagtagcatgggccactcagccacttaaacttattgttacttcttgattatctggtaaaccagaagtggattattcatgagttttctgggaaaggggtgggtaattcccagaactgagggttcctctcctttttagaccatgctgggtaacttcctgatgttgccatagcatctgtaaactgtcatggcgctactggggctgtcttttagcatgctaatatattataattagtgtatagtgaacagtgaggatgccctgaggtcactctcattgccctcttggttttgctaggttttagccggcttctttactgcaaactgttttatcaacaacctgttctatggtctgtatcttgtgctgacctcctatctcatcctgtgatttagaatgccttawcctcctgggaatgcatcccagcaggtctcagcctcattttacttagcccctattcaagatggagtcactctggttcatacgcctctgacagtgttacataaaggaaaaataaacttctcctatctgtatgggttttttttgttgttgtttgtgtttggttttttgttttgttttgtttttgtttttaagacagggtctcactctcactcagactggagtacagtggcatgattacagctcactgcagccttgacctcctgggttcaggtaatccttccatctcagcatcccaagtagctaggactacaggggcgcatcaccatgcccagctaattttgtatttttcatttttgtacagacgaggtcttgctatgttgcccaggctagtcttgaactcctgaatgaaagtgatcctcctgctttggcctcccaaaatgctgggattatagctgtgagtcattgcgccaggccaacttctcatacctttgtgagaggaggtagtttggcaatttggagcaacattctcaccaacgttaggctcctgcctcccacgggaactggtgctgtaggagttattaagaaattattttaggtatatagagaagaaaaggggtccttgggaagttttcgggtttttttgtttgtttgttttgttttgttttgagagggagtctcgctctgtcgcccaggctggagtgcagtggcgctatctcggctcactgcaagctctgcctctcgggttcacgccattctcctgcctcactcagcctcccgagtagctgggactacaggcacccgccaccacacccggctaattttttgtttttgkttttktttttkttttttttttagtagagacggggtttcaccgtgttagccaggatggtctcgatcttctgacctcgtgatctgcccgcctgggcctcccaaagtgctgggattacaggcgtgagccaccgcacccagctgggaagttttctttaaagcatcttcggaaaagtttcttgtatagccccggctcttagagccaggctggcaacctttgatatgtaaatgcaagccattagaaactaggtccacccaaacatggtgattcccctgccttcttgccctttccccacaagttcctggcaacatggccgcccccatgtattcccacgtgtgttagaacatcatggtgccccgcttttgcatattaaaaggctatggtgggagggccagctttttcgcagatatgtgaatgayatgcctagtcaaaccaatcccctgagccctatgcaattcagacaccgcctcctccagcctctgtgtacatatatctagctggtatctgtggcaggtcggggttcccctctctcagctttggagcccccctccctctgtctctttacaggggagcttgttcctcctcccttccttcttgcctcttcttgcctattaagctctcaagctctccactccttaaaaccactccacgtgtgtctgtgtcgttttatctaaactggcacgaggaccaagaaccctggtgttcctccactcatcggagctgtatcactggtagataggagcactgccatttttgatgcttacatttcaaagagatctcaagtccttgagaaagacattcctgggttttacacatttacaagaggcttttagaaagatttatatacatctggggccaggcgcgttggcttatgcctgtaatcccagcactttgggaggccgaggcggttggatcacgatgtcaggagatggagaccatcttggccaacatggtgaaaccccatctctactaaaatacaaaaaattagccagatgtggtggcgcgtgcctgtaatcccagctacctgggaggctgaggcaagtgaatcacttgaaccccggaggcggaagttgcagtgagctgagatagcaccactgtaytccagcctgggcaacagagcaagactccatctcaaaaaaaagaaaagaaaagaaaagaaagatttatatacatctcacaggggcagagagaatttacaatgacaaatcctctaaagaaaatgctttaagaaaagggaaagaatagtcttttccctaattttttctttttgcttttgtttgtttgtttagagacggggttttgctattgtaaaccaaaaggtatctgagacaggtcttaatcagcttagtttattttgccaaggttaaggatgtgcctgtgacacagcttcaggaggwcctaacgacatgtgcccaaggtggtcggtgtgcaacttgcttgtatacattttagggagacatgagacattaatcaatatgtgtaagatgtgcattggttcgttctggtaacgcgggataacttgaggcaagggcttccaggtcccacataggtaagagacaaaargttgcattcttttaaatccttgatcatctttccactgaatacacaatttaggctggctcagtgaatctgcatttttacataaacaatagggcaggggaagcaatcagatatgcatttgtctcaggtgagcctcctcagagggatgactgagttctgtctgtcccttgtccacaaggaatttccttctgggcaaattgtgagggaggtatgtagcttttttttgagacggagtcttgcttattcgccaggctgaagtgcagtggcgccatctcggctcactgcaatctccrcataccaggttcaagcgattctcctgcctcagcctcctgaataactgggattacagtcacgcaccaccacgcccagctaayttttatatttttagtggagacagggtttcaccatgttggccaggatggtctcratctcttgacctcatgatctactcgccttggctttccaaagtgctggaattactggcttgagccaccacgcccagcggtgtgtagctttttatcttttttttttttgagatggagccttgctctgttgcccaggctggagtgcagtatgcgatctcagcactttggggcgggggcaagatgaacagatcgcttgagttcaagasttcaagaccagcctgggcaacatgtctaaaccccatctccacaaaaaaatataaaaattagctgggcgtagtggtacccgcctgtagtcccagctactcaggaggctgaggtgggaggatcagttgagccagggaggcagaggttgcaatgagctgagattgcatcactgcactccagcctgtgtgacagagtgagaccctgtctcaaaaaaaaaaaaaaacttaaaatcttttttttaattctctcaatttcaatctcacttacttcttctttcaaagccaccactgtctgaacctggkgcccttccttctgattatagttttcgttgttgttactgtgttttgtttactttyacaattttggaatatgaaaatatctttcttttgtaacgacaaatatggaatacaaacattacaacttctttttttgcccatcctggattaaaaaggaaataatagatgaaatgccttgcaaagaggacaaaatattttggggtctaaaatgtgctttgcccaggatcttgccttgtaatgataatgactctcccttagtgatccaaacaaaggaatgtggtcaactgtatgaacaaggttcagtgaagtcctgagtcacatgacaatctgtcctccccaagcctctgtgcttcaraagctggaaagtcgttctacccttgggcacagggtacatgtgcagtagcaataaatagcaccaggaggaataggagcaacaagtgttactggtagagggtcttgactacgagttgtccaggtccttggcattttgaacaaagaattgaacaaaacgtacgaagtagcagagaaatgaaatgcaggaatgaagcaacgagagcaggaattcattaaagcgagaaagcacttcacagggtgggagtgggcctgagcaagcagctcaagggtgcagttacaaagctttctgggctttaagtacctcatttgaggttcttatctagatgaaggatttggtctgtggcaaattaaagactgaggtgaactggcgccctgtgcagataaagggatggtccctgcttcgccagggccaatccaaggcactctccttttccatcccagcactttgggagcctgaggcaggtgatcacttgagctcaggagttcaagaccagcctggctaacatggtgaaaacctgtctctactggtgctctcgccattattccatctgctatgagcccctttctgcataaagtaaagtttgccttgctaagagaattaaatttatgtttgaatgttatttctttgtagcactggggaacaagcattctatttctaaataaacatttttacatataagaaatggtggtccgtacagggatacattttcctctggggtggtctctagtcctctcatgagggggtctcccactgcctcatygtggtggcctcaggggtagtaagaaattgagacccatctggtgtgatgaatagacccggactctcaacaaggcagaagaaactggccagcaatctggagtaaatgatcctcacatatgatgtggaccaggcgacctcatgcatgagccaagaaaggaaacaaaccagaggagccgtacaccagcacctgcctggaaaccacatcctcatcaaaagatagaaagaagaaaaactcgaggcagcctaagaaccctaccttgtgctgctaaccaccgagactgccgttcgcacagcagaaaaggatagacacatcatacccaagtcaaaaaagcgtcatcaccatcaaagtyataggtcattgttccagggtcaagccctaccaagttaaagctaagaaaactttatctatcttttctttcctttaactactccccatcttattaatgtaactaaatctaactcacctcaaattattacttttaatgcctgttcagttatcactcctctcataccaaatgacaaaaccaaagtctttgtagtaaaagtaaaaaaatctaaagcaaaccacagcaattaaaacaagatatcaagatgtaaatgactagctaaaatacattaaatattctgtccgcactctaaataaaagcaattgttatgcttgtgcacacagtaggctagaagtccaagttatcccctttccactcagatagtcctctaatcgacaaggcatggactgcatggtagctccttttcttcttttgtctttttttcttttttttatctgagacggagtctcgctctgtcgcccaggctggagtgcagtggcgcaatctcggcttactacaagctccacctcccgggttcaagccattctcctgcctcagcctcccaagtagctgggactacaagcgcacgctgccaagcccggctaactttttttttttttttttttgtatttttagtagagacggggttttaccctgttagccaggatggtctcgatctccatctcctgacctcgtgatccgcccgtctcggcctcccaaagtgctgggatataggcgtgagccactgcacccggccggtatcaaaatcctgcagcctaagatagtaaagtgtgccaaactctctctactatttcctaaagtgcagtaccctgagggtcagccccccgagggccattcagcctccatcttccaagaccaattttacctcgtgtctccaacgataaaaggaaaatttagcgtacyttgaagacttaacatgatacagcgaggtcaggcacttccaaaagctaacccatcagtccacccttattcatccccaagcggatgcatagtaatactgtaaaaaacctttactagacactctaccaaataattagagcagcacttatgctctagttcaattagctatcccttttaccctggcatttcatcaatcagaaaaagagaaattacgacataagcaaataaaagaagcctcaaaagaagcagccccttacagctattttgattcccatgtctattcagatgcaattagaggtcctcacagagtaccaaataaatttaaaaccagagatcaaatagctgcaaggtttaagtcaatgttgttttagtgagtagcaattaataaaaatgtagattaaataaactgcatttattactaccagcagcaatttattaactataccaaagatgctgttaaagaaatagctgaacaattaaaacccacaagtcaaatggcctgagaaaataagataactttaaatataatattaacaaagaaaggtagtgtttatattataatcaaaactcagtgttgcacctttattccaaacaacactgctcccaatgggagcataacaaggaccctccaaggacttactgccttattaaataagttagcaaaaaattccagcattaacaactctatttcaaattagctcgagaaatagttcagccaacagaaagagaccatggcctcagtccttacttctctagcaactgtaataagtatacttctccttattagatgtcatgttatgttataccatacatttaaaagctaatcaaaacaactaagccaagacatatttaaaaaaaaaagtttgaagaagaaaactataaaaacaagacaaggaaattgtagaaagtaaaaagttcctcttcaaagtttcccttcttgttcaagaataaatcataagtgttagaaatagtagtttcttttaaagactaactgtatgctagacatgcgcacaggcctgtcccggctcgcagcctatgccccttccttatttaagaatgttattacctttctaagtcctttcgtaagtaacttcctcttttcctttgtctttctattgcctttgcctatttagaaaagttttaaactgttagctaatcaggttttagtttagattgtgaggtctggctttagccaatggagacaggacacagtagcagggacaaactgcgtaaaggataaaaattacttccctccattgttcaggtgtgctcttgccattattccatctgtggtgaatacttgactttctgcaaaaagtaaagattgccatgctaagagaattaaatttatgttcgagtgctatttcttcgtagcaccaaggaacaagcattctatttctaagtaaacattttttacatataaccaacaaacaaacaaaaacctgtctctactaaaaatacaaaaaaattagcaggacgtggtggtgcacacctgtaatcccagctactcaggaggctgaggcaggagaatcatttgaacccgggaggccggaggttgcagtaagccaagattgtgccactgcactccagcctgggtgacagagtgagacttcgtctaaaaaaaaaaaaaaacagataaaaatgtgttatttgtaaattagctgggtgcagtggtgtgggcctgtaatcccagctactcatggggctgaggtgggagaatctcttgagccaaggaggcggaggttgcagtgagcccacatcacgccacttcactccagcctgggtgatgggagtaaaacccggtcttaaaaataagtaggccaggctctgtggctcatgcctgcaatcccagcactttgggaggccgaagtgggtggatcatttgaggtcaggagtttgagaccagcctggacaacacggtgaaaccctgtctctactaaaaaaaatacaaaaattagctgggcatggtggcgagcacctgtaatcccagctacttgggaggcttaggcaagagaattgcttgagcctgagaggcagaggtcgtggtgagctgtgatagcaccaywgcactccagtctgggtgagagagtgagagaccctgtaggaaagaaaagaaggagggaaggagggaaggagggaaggaaggaaggagggagggagggaaagaagaaaagaaagaaagagagagcgggagggaggcagggaggaagggagggaggaaggaaggaagggaagggaaaggaaagaaaggaagggaaaggaagaaaggaaaaggaaagagaaagaaaaagaaagaagaaagagagaaagaaaggaaggaagaaagagaagaaaggaagaaaggaagaaaggaaagaaagagggagaaaggaaggaaaggaaaggaaagaaaggaagacaggaaaggaagaaaggaaaaggaaagaaagaaagcaaaagaaagaaagaagaaaggaagaaaggaaagaaagagggaggaaggaaggaaaggaaagaaaggaagaaaggaaaggaagaaagagaaagaaagaagaaaagaaagggaagaaaggaaggaaagaaagaggccctgtgcacagcctcacacctgtaatcctagcactttgggaggtcgaggtgggtggatcacttgaggtcaggaatttgagaacagcctggccaacatggtgamaccccatctctactaaatatatatatatataaaaaatttagctgggcatggtgatagatgcctgtaatttcagctacttgggaggctgaggcaggagaatcgcttgaacccaggagggagaggttgctgtgagccaagataacaccaccacactgcagcctgggctacagagtgaaactctgtctcaaaaataaataaataaaaataaattaattaataattgtatttattgctgctatttttgaagttaattaaaggtattttaagctgggtgtggtggttcacacctgtaatcccagcactttgggaggccaaggtgggtagatttcttgaggccaggagttcaagaccagcctgggcaacatcgtgagccctcatctctactaaagataaaataattakccgggtgtggtgtcatgagcttgtagtcctaactgctcaagaggctgaggtgggaggatcccttgtgcctaggaggtggaagttgcagtgagtcgtaatctcaccactgcactccagcctgggtgacagagccagaccctgtctcaaaagaaataaataggccgagtggggtggctcacgcctataatcccagcactttaggaggccaaggcaagtggatcacatgaggtcaggagttcgagaccggcgtgggcagcatgctgaaaccccgtctctactaaaaaaaaaatgcaaaaattagatgggcgtggtggcacacgtctgtaatcccagcgacttgggaggctgaggcaggagaatcgcttgaaccccggaggcggaggttgcagtgagccragattgtgccattgtgctccagcctgggcaaccagagcaaagctctgtctcaaaaacaaacaaacatttgcttttttgtttttaatattactattttactaatggtacaatactcccccatttaccacaagtgatagattttctgtcaggttttcttccattccatgtaaagccatttgtctcctccatcaaattattttactgctaattctgcctttagtcatctgcattgtaatcttttacctctagttttgtatgaattcaacagccttaaataactgcacggagtgatgcaacttatttatgattagaaaatgcttgttaatgaaccacatgcagtcatttttgaaattgtaaatggcattaacaatttttcttcttttcttttttttacttctttttaaaataacttgggtactctcttttccttattcttgccaagcatatatattagtgaaaacctatgcgggaagtggcaatttggtctcctcttcctcctgtagttgttagttatttgaataaggtgatttgagttatttctaattctggctgtattctcttgggttcccacagacacacaccctgagaaaggatttgaaagcaagtattaataattcactgggaggtgatctcaggaaacactggtggaggactggcgacgtgagataaggatggaagggaaaagcagttaagaaaagggtgagctatcaatccagctgccactgtgagcaactgtagctgcatcttgctgcagaaccctgggactcagtgtagagagcatgacccagasttacccacaggatgagtgagggagctggttatgaactgctgggggagtgttacagttcaggctgccagagcaaaccttgtcatggaaatcagccrggcatacactacagagtcagaagtagggatggaggcactgaagatggcaggcacaaacacagtgcaaaattttcatcatcaactctatgttttatatactttgaaagatttagataactggcatcaacttatttatcagagaagagttgaagagtgagaccatttaggaggcttgagatagtccaggtagcagcttagacttgattgtatggaaataaagaccacctacaggagaacaaataaaggctatctawtcagagcttgctatatagcaagagagagagccaccatcatgtgcatttggtaaaaagtcaaagtcaagcagaggactgcgaaaacttgatagtggaaaaagcaaaaagtttcaggtctaccctgattggasgctgtcgacctggagaagctgtaggcagctaactagaagaggcgcatcctatgggattggttaggggtgcatatttggctttctcctgtgggtcctaaattggaagctgggacagaaatgagagaagctggcagttacttgagacagggtctcactctgttaccctggctggagttgcagtggcacgatcatggctcactgtatcctcagcctcccaggctcatgcagtcctcccacctcaacctcccaagttgctgggactacaggcatttgccaccaagcctggctaattttatttttaattttttgtagagatgagatctcactgtgttgcccaggctggtctcaaactcctggggtcaagaaatcctcctgcctcagcctcctaaagtgctggggttatagtcatgagtcccgtgacaggcaaagctggcagctatcagggcatacttgaaaccttctctttttccactataaaaatttcccactcctctgcctgcctttgagtctttgccaaaacacaagtgactgtgactgacgctcttgctgtagcaggctctggataaatagcctttgattgttctctttcggttggtctttgtttatgtccatagatcaaaccatttttacttgcatcttcttgctcctgtcatatacttgttttgtgccagccgtatgaaacttctcactttccttcaaatcagcttgccagtccctagaatgtgcaagctgctcatgttgctcatgttgtatgtgtcstgtatmtagaaaacccttttactgcttctccagctgacggaaaaaatcctactcgctttactccaaaggccagctcaagtatcacctcatctgtgaagcatttcctaactcttccagggagaattaattgagccctacttctgagatcctattacactttactcatgctggtagcaggacccgattgcagtcatagctttcaggcagtgtctgcatcacctgaggaaatgtcaactcctttagggtagggggccttcatattgctcctgactcttagaagatgctcagtaaatgtttgtgaaatgaagttgaataaaatccttactctcaaaactcatttttgctatattctatacaaccaaaggtaaatgggargattggtagaagttttccttggaccggcaaacctttcccttgtcccattttaaaaaaacataaaccgaggcgggcagatcacgaggtcaggagattgagaccatcctggctaacacggtgaaatcccttctctactaaaaatacaaaaaaattggccgggcatggtggcgggtgcctgcagtctcagctactcgggaggctgaggcaggagaatggcatgaacccrggggacggaccttgcagtaagcagagatgcgccactgcactccagcctcggtgacagagacagactctgtctcaaaaaaaaaaaaaaaacaaaaaccataaacagggtattgttaatagtgttatcaaaattagctgggatgggtttggtagacttgcactttgcacttctagcttctatcatggtctcatttggtggtgtgtgaggcacttgtgctgtgagctctctctctctcactctcactctattttttagagatagggtttcactatattgccaaggctagccttgaagtcctgggctgaagtgatcttcctgccttagcctcccaagtacctgggactacaggcatgcggcactgtgccaggttcaggttcatttcaaatggaaaagacaatctttcttcccttcccaatccttgccagacctcatttaactaatagcttccttttcaaggactgcaggcagaggcagagtgcttgctgttacatgaagtgtgctccagtgctkstggcttgggacaatgaattcatgcagatctcaggcgatggcaggagaagtattggatgctcctgatcagttggtacatctgtatatgaaatacaggaggaaacaggccgggcagtcctgcccgctgtacagagaaagtggtygacacagcaggggaatttaaagatcacctctaaccatctcagttcttaagtggcatctttagtkgggcctaggaattaaattgacataaggcagattaacagaagaaaagcacacaagttttattaatttttacctgtacaaagggacacttacaagagagtgaacacctgaggaaatggccaaagcggaaagcttttctactttttagataaagaatggtaaatctgtgaagaaaggactggacaaagggatccaggttggggacagtaaattctaggggagtcactaggagatttatggggggatgtaaacctagtggaagataakgatttattaagtaagtttatctgtacaggtccagctcagtggcagttcccagtccctggagataagggttattttcttgccctggtaccggaaaggcctcctcctcaaaggaatttttatgacttgctacatgtaggaaaggacaggtcagagagccctttctgcaattacagtctctcaagtactttcagcttgaaataatcagtacatcacatcagccrattttggggtggctcatccttaactcctgcaacactkttgcttagtggttttatcattatatattgyataaatatatatatatwgtatacatctataaccatttatttattatactyacattaatttttttcmtatagactcttccagcaagaataaggtttttttttgtttttgttttgagagggagtcttgctctgtcacccaggctggagtgcagcagcatgatctcagctcactgcaacctccgcctagcgggttcaagcgactctcctacctcagcctcccaagtagctgggactacaagcacccaccaccatgcccggctaattttttgtagttttagtagagacggggtttcatcatgttggccaggctggtctcgaactcctgacctccggtgatccgcctgcctcrgcctcccaaagtgctgggattacaggcatgagccaccccgcccggctgcaataatattttttttaaggttttttttttttgcctttttgtagggtttttatttatttattttggtgggttttttttcctttctttttcttttcttttcttttcttttttttttttttttttttaagacagggacttgctctgttgcccaggctggagtgcagtggtgcaatcacagctcactgcagccttgacctcctgggctcaagtgattctcctacttcagcttcctgcgtagctgggaccccaggtgctcacaaccatgcccagctgacttttattttttgtagagatgaggtcttactttgttgcccaggctggtctcaaactcctgagctcaagcgatcctccagcctcagcctcccaaagtgctgggattacaggtgtgagccactgtgcccagacacaaaagttcttaagtttcagaccacttgtggttttgttttctttttggatgttttagttagctatggataaaatctccacaaggtgtccctaagctacagatatgaaaatgtcctgctcagaacacccytgggagtccccatccccaaactccacttaggcaactgattagtgaaatccaattagatccagcatctctcccaagatactttgactccaggtaaattcaggatgaatggagaggaatggcagcttcactcaccaccacaaggtgctgcctcctgctgtgttccagacagtcccaaagccccrgaagcacagcgcagggactccagagtgagactgaatgaaaacatatccacacgtaagtgccactcacacactctgtgtccggggcgtggaataggccaggagaaccttggtctgaaaatacgaagagctcrtttcttcctcttaatctatcactagtaccacaatactgagttgagatcattattgctatattacctcaagccaatcattaatgtcaatgrtattaactttttctcatttgtaaaaatgatmaaacttsgtttaagatgttccgtatagtcccttgaaattacttttgtttgtttgttcatatctatctataaaaacaagctgatgtagcattttttgttttgttttgttttgtttttgagacaaggtctcgctctgtcacctaggctggagtgcagtgacacgatctcagctcactacagcttcgacttcctgggctcaagcaatcctcccatctcagcttcctgaatctctggggctacaggcktatgccatcatgcccagctaattttcgttgttttggytttttgttttttgttttttgagacggagtctcactctgtcgcccaggctggtgtgcagtggcgtgatctcagctcattgcaacctccacctcccgggttcacgccattctcctggctcagcctcccaagtagctgggactrcagatgcccgccacyacgtccggctaatttttttgtatttttagtagagacggggtttcaccttgttagccaggatggtctcgatctcctgacctcatgatccgcccacctcggcctcccaaagtgctgggattacaggcgtgagccactgcacccggcctaatttttcatakttttttgtagagatagggtttcgccrtgttgcccaggctggtctcaaacccctgagctcaagtgattggcttgtcctcccaaagtgctgattataggcgtgagccactgcacccggccatgttttttctttatgcatacttaccctctttatttcttactggcttacctaaaatatgtgaagaggctgcttgccaggaggtgagagaaactggaggagagtrgtaatgcaatgagttttggatttcttttttttttttttttttgaggcmgagtctcaatctgtcacccaggctggaatgcagtgagtggtgcaatcttgggtcactgcaacttctgcctcccaggttcaagcgaatcttctgtstcagcctcccaagtagctgggattacagatgtgcaccaccacacctggmtaatttttgtatttttagtagacacggggtttcgccatattaactaggctggtctcgaactcctgacttcaagtgatctgctcgccttggcatctcaaagtgctgggattacaggtgttagccactgcacctggccgagttttgtgtttcaaatgccagacttgggacagctgaagactcctcaggtgatatggactaccaataatactgattggtaggtaaattgcggggatggaactaagatctcaaagcctgacctgtagctatctaagacatttagtatcaactgacttctttcttccttcccttcaggtaactattagggatttcctaggccagttctcaaagaaacacagcttatcttatgacccaggacacaggcacacagacacacatacgtgactgaattaatacttagccttacaccattgcactgttttattttctttccttttcctttttttttttttttgagacggagtcttgctctstgcccagcccaggctggagtgcagtggcgcaatcttggctcactgcaaactctgcctcccgggttcacgccattctcctgcctcagcctcccgagtagctgggactacaggcacccaccaccacgcctggctaattttttgtatttttttagtagatacagggtttcactgtgttagccaggatggtctcgatctcctgacctcgtgatgcacccatctcgccctcccaaagtgctgggattacaggtgtgagccaccgcacccggcctcttttttttttttttttttttttgagatggagtttcgctcttgttacccaggctggwgtgcaatggtgccatctcggctcactgcaacctccgcctcccgggttcaagcaattctcctgcttcagccttctgagtagctgggattataggcatgtgccaccacgcccagctaattttgtatttttagtagagacagggtttctccatgctggtctcgaactccygacctcaggtgatctgsccacctaagcctcccaaagtgctgggattacaggcgtgagtcaccgmgcctggctgttttcttttcttttctttgtttagagatagggtctcactctgtcacccaggctggagtgtagtggtaaaatcatagctcactgcaacctccaactcctgagctcaagaaaccctctctcctcagccttccaagtagctaggaccacaggtgcacaccacyacaccaagctattttcacaaatttttatacagacagcatctcagtatgttgcccaggccggtttcaaccccctgggctcaaacaatcctcccaccttggcccccaaagtgttggggtttcaggcatgagccrctgcgcccagccttgttattttctattctattgttttgtttgcttatcattcttggcttccaacagcaatttttaaaaactgttttggggtagagggagtatggctaacagctgttttttccttaaatctgcgctgtggatcttagaaccagatgcctgttattcactcccaagcctcctaggcaayccgccagtgagatcgtcccgccagtgagatcgtcccgctgttagtctttgagttgatggccagtcagccctgggtcttagtgggtgggaatagaagtgggggatgcagagagaaagctcattaaacatggccttgccctaggattcagaatgcagtgcgcctgcactgaatcaacctgtcagagaggctgttctttgaaaagaagtttgggtctgtcatttaaaaaaattaaacaatttagaaatgtagtcctctcctgcttaacatcagtaatctattactgaaaattggttgttctgcatraaaatgctaaccttcagcytatttattttattttaaacagaaaaattatactatgtcaaccccaaaccctcaatcaatttcttaaaaggttaactaaagcatggkaaggtrcctaaatataattcttataaaacraaacatctggtcagttgtgaaatgtktaaaacattgcttcttgatcaccaaataattaatatggtgaataacasatakgggcttttgtgcagtagaagattcaagaccaagacaagctcatgtttccctttaggcrggcttcctcctgagggaggcccctgacctccctcttcttagagcatttgctttaraaaacttgtaaattttctctctgatacttcgagatgccaattttttttttttttttggkcattttacytttagtcgatgcataatctttaaaaaagctttgtcagttttacaacccaggaaagtctttctccaagacctgggaactatttctttgaaatgcaatcagcaggacatagcatccttatctctgtttctgtgggagggcagcaggagcctgactccaaattgccttgctccaagtttcaagatatcgtgctctaagttacaaaactaactcttgtcacaaagctaggatacgtttatttctcctttttgttgatttttgaacaattagaatttatttctcacagttctgaaggctgygtgtctgaragcagggtcccagcacagccaagttctggtgaggaccctcttccagtggcagatgcccacttcyggtgctatctcccawggaggacagcagaggctataattcctttggagaaagcctactagcaaatacacamtggaattttatttagcctttcaaaaaaaggaatttctgccatttgcgacaacatagatgaacctggagaactatgctaaatgaaaaaaagccaggcagggaaggacacatactgcaggatctcacatgtatgtggaatctaaaacaatcaagctcatakaagtagagaataaaatggtggttaccaggggctgggagcgaggaaatggggaaatgttggtcaatgggtacaacatttcagttagacaggaggaatatttttttgagatctattgcacagtatgagaactatagttaataataatgtactgtrtattccaaaaatgytaagtgaatacatttcaaatgctcttcctaccaaaaaaatgatgagtattggctgggcatggtggctcacacctgttatcccagagttttgggatgccaaggcaggcagatcacttgaggccaggagttcaaggccagcctaggcaacatagtgaaaccctgtctctatagaaaattaaaaaaattasacasacrtgatggtgtgtgcctgtagtcttagctactcaggaggctgaggtgggaggatggcttgagcccaggagttcaaagttacagtaagctataatggtgccactgcactccaatctgggcaacagagtgaaaacttgtctctctaaaaaaataaaawaaaaaaaagatgagtattgaggtaatgggtatgttaattagcttgatttaataatttcacattgtttacatatattacaacatcactcygtaccccataaagacatcaaattataaaaagccaayggcaaacacaaatggcctgtgacttcccttatgtccttcagtactaattcacccaatcctttaaaacctatcccttctgggccgggtgcggtggctcatgcctgcaatcccagcactttgggaggcagaggcaggcrgatcacgaggtcaggagatcgacgtcaacctggctaacacagtgaaaccccgtctctactaaaaatacaaaaaattagctgggcgtggtggtgggcacctgtagtcccagctactctggaggcagaggcaggagaatcacttgaacccgggaggcagaggttgcactgagccgagatcccgccactgcactccacctgggcgacagagagagactccgcctcaaaaacaaacaaacaaacaaacaaacaaacaaaacctatcccttctgatgagcagtttagttcatacttagttctggccctctcccctcctgcagtttaactttgcctaaagtttcaacgttgttcagtgcaatttttcctttgacaccaccagtggtcctgtgttgcaccccttttgttttgtttcattttgtttttttgtcttttggtttatttggtagagacagggtcttgctttgttgtccaggctggccttgaactcctggcttcaagggctcctcctgcctcggcctcccatggtgctaggattataggtatgagccacagcacctggcctattgcaccccttttgttgttgtttgttgttttttggttttgagacagtgtcttgttctgttgcccaggctggagcacagtggcatgatcgtggctcactgcagccactacctcctggctcaatcgatcctccagctttagcctcctgagtagctgggactacagaagtgtaccaccatgcctggctagatttttgaattctttgtagagacagagtttcaccttgtttcctaggttggtcttgaactcttgagctgaagccatccaactgcctcggcctcccaaagcgctgggattacaggygtgagccaccgcaccaagcctgtttcgtgttttgttttttaagacagggtcttactatgtcacccaggcttgagggcagtggcgtgatcatggcttactgcagctttgacctcccaggctccagtgatcctcccacctcagccttctgagtagctggackacacacgtgctccaccacacccrgctaatttttkttctyttttttttgagacasagtctcgccctgtcacccasgctggagtgcagtggtgcaatctcagctcactgcaacctctgcctcctgggctcaagcgattctcttrcctcagcctccagagtagctgggactacaagctcaggccaccacacccaactaattatttttatttttatttttrttttttgagacagagtctcactctgtcacccaggctggagtgcagtggcaacctcctcctcctgggttcaagcaattctcctgcctcagcctcctgagtaacagggaatacaggtgcccaccaccacgcctggctaattttgtatttttagtacagatggggttttaccatgttggtcaggctggtcttgaacttctgacctcaggtgatccacctacctcaacctcccaaaattctgggattataggcgtgagccaccactcctggccaattttttgtatttttagtaaagatggggtttcaccatgttggccaggctggtcgtgaactcctgatctcaggtaatccacccaccttggcctcccaaagtgctgggattacaggcatgagccactgcacccagccttaatttttgtattttttgtatagacagggtctcactatgttgctcaggcttatttcaaacacctgggttcaagtgatcctctggcctcagcctcccaaaatgctgggattataggcgtgagccactgtgcccagccccttttgttgatcgckccacaattttccaaaacgttcatagggactctatattagytttctagagctgccataacaaagcaccacaaactgggtgggttaaaaaaacagaaaatgtattatcttacagttctggaagtcagaggtccaaaatcaaggtcttggcagggccatgctccttctgaaggctccagggaagaatctgttccatgccttacttttagcttctggtgttgccagtaaatgcttgttgatacagcactttaatcactgtctccattgcctcatrgcattcttcctgggtctgtctccgtgtctcttctctgcttctcataaggacagcagtcatattggattgagtccatactacttaatatagtttgaatatttgtcccctccaaatctcaaattgaaatgtgacccccagtgttggaagtggggcctagtaggagatgtttgggtcatggggacagatccctcatgaatggcttgatgccctccttacagtaatgaatgagttcttgctctattagttaatgtgcaatctgattgttaaaatctctcgccatgtgacacactggctctccttgccttccaccatgattggaagcttcctgaggcttccccagaaacagacactggcaccttgttctgttagaaataaaagctcagagtcgtaaagaaaatgagcactcaaacacaagatttctcagcaaggcaaattttcttctgcagaagggtgcagcttgcrccagtcattatcgcaagagcacaccgagcagggtaggaaaggggtttttatctctaatgcagttcctagcacttctgtgtcctttccccattggctggggttggacctcacaatctaagctaactcgattggctaaggtttaaaattgaatagggtctattaggtgragagtccgttactaggtgggaaaagwgtctgttactaggcgggaaggcatatctggacttgtctgggcatggcaaaggcaggaaggttgtttacagaacaggtarctaggagacaaggaagtacaaggaagytggttttaagaaacaaagaacagggaackaaagctttttgaagaggaatttatcatctctgacacttcttgtacagtctgcagaactgtgaggcaattaaacttcttttctttgtaaattacccagccttagctattcctttatacaatgcaaaatggaccaaatatagtactcaagtataacctcattctaacttaaatcttaattacatctgcaaagactatttccaagtaaggtcacaytcacaggtaccaggggttaggacttcaacacatcctttggggcagatacaatgttgaggattgcctcaacagactctgaagaaatwgcaataatatttggaataaaaggcctttcttgcatttcattttttraaaaatattgtatcatgtttaggatgtaaaaattttgtgacttttctatagaattgttagccagaaatgttatattgagagatacatatgttctatgaagtttgagttttaaaaatgaagagaaggctgggcatgcctgtaatcctagcattttaggaagccaaggcagacagtttgcttgagcccaggagttcaagaccagcctgggcaacatagcaaaatcctatctctacaaaaaataaacatttagctggggccgggcacrgtggctcatgcctgtaatcccagcactttgggaggccaatgcaggcagatcacctgaggtcaggagttygagaccagcctggccaacatggcaaaaccctgtctctactaaaaatataaaaattaactgtgtatggtggcgtgcacctgtaatcccagctacttgggargctgaggtaggagaatcayttgagcccgggaggcagaggctgcaatgagccgagattgggtcactgcattccagcctgggagacagagtgagactcagtctcaataataataataataataataataataataataataataataaaactagctgggtgtggtggcctttgcctgtagtctcagctactcaggagactgaggtgggaggatcatttgagcttgggaggatgaggctgcagtgagccatgattgagccactgcactctgcactccagcctgggcaatagagcaagactgtcttaaaaaaaaaaaaaaagaggtatttctcttttaggggagaaggtttacctgggaggcattatgcagggtgagcagtaatctatctggaggacacacttgggtttggtgaaggtgacacttcttcaaagagaaatcgagggttgtgtcaaagacaaaacccagagaagtaggcagattgattaaagaacacttgagaggcaaagatcagaggatctcagcagggtgcttttgccctagacttatatagagaggagtaaacaagctgaagtggggtgatmtgcagttggggttgttttgtatgcagaactgtctgtcacttagctgaaccagaaatattattctcagggaaacaaattgttctaatcttagctagtcaactacagcaaagaatgggaaattggaggatttgtgtttggccttgttgcagatgaacaagggagccaaccctgagaaccgtggggtcacaagagagtggacggtgagttgtacctatgtcctatgcagaaggatggttctctgagcaagtcttctccaagaacacaaaagaatgggggattttgaaaaacaaaaggtggtggaggatgggggttgcayggggttcaggttgggggtgggggtactgggggtgcagggtgctttatcatccctgctttcttttctttttaaataaatacattttctttctgtcttctttattttattttattttattttattttatttttttgagacagggtctcactctgtcgcccaggctggagtgcagtggcacaatctcagctcactgcaagctccacctcctgggttcacaccattctcttgcctcagcctccccagcagctgggaccacaggtgccagccaccatgcctggctaatttcttttgtatttttagtagagacggggtttcactgtgttagccaggatggtctcaatctcctgacctcgtgatctgcccacctcagcctcccaaagtgctgagattacaggcgtgagccaccatgcctggcctctttctgtctttattttattttacttaaatttttttgattttgtttttgttttgttttggagttttttgctcttgttgccaggctggagtgcaatgacacgatctcggctcactgcaatctttgccccctgggttcaggcaattctcctgcctcagcctcctgagtagctgggattacaggtgtgcgccaccacgcccaactaattttgtatttttttaagtacagacggggtttctccatgttggtgaggctggtctcaaactcccgacctcaggtgatctgcctgccttggcctcccaaagtgctgggattacaggcatgagccactgcacccggccaaaaaaaaaaaatttttttttttttttgagacaaaatctcactctgttgctgaagctggagtgcagtggtgtgatctcggcttattgcaacctccacctccctggttcaagtgattctcctgcctcagcctcctgagtagctgggactacaggcacgtgccatcatgcccggctaatttttttatttttagtagagacagggtttcactatgtgggtcaggctggccttgaactcctggcctcaagcgatccacctgccttggccttccaaagtgctggggttacaggcatgagccacagcacccggccaaacaaattttttttgagacagagtcttactctgttgctcagactggagtgcagtggtgccatctcagctcactgcaacctctgcctcctgggttcaagcaattctcctgcctcagccttccaagtagctggaattacaggcgcccaccactaagccatgataatttattttattttattttattgttttagtagagacagggtttcaccatgttggccaggctggtctcaaactcctgacctcgtgatccacctgccttggcctcccaaagtgcagggattacaggcatgagccaccatgcctgcctgattatcactgctttccagaggtgcagggtctcagataaaggtcawcagtgytcagtggtcaggaggaagaaagacctatgtgtcactgagcagagactgtaacttcctgccttcagttattcccagttactcttagaagtgktttatttatctttgcaaaatggatctcacagtcatggggtgccgctgccacagtggcggggcccacttagtgactgccaaacttcagacttgaaagggtatccttttgtcagactccagtgggctgtgcaagaaatccggggaaagtgcaagtgaggcctctgagatgcaggaagaccagaattcctagtccattttatttttatttaaaaaagcaagaatttaaactttactgacattgattatasagtatgcactggatttgtcactctgaatctatgtcaccgttatgtgtcacctcctcggggaagaacagaagcgtcacattgtggtgactttcctccctgaaccccttcagagtgcagcatattacaggttaggagtgcctggttaaaggcagatggaatgatctagtttcarctaaacctatctttacacaacagataagtggctttaaaagactcctacagagaaactgctggttttcaagataactctaataatgcatgtggcggcaaacaaggagctgtttgacaacactgacatctattcctacaggcrtagaagccctttgtctrctatttgacaagaaaatataataaaaatctaacatagtttattagaagttggtcaaaacattcaaaattaccaacactgtttgaaatacggatttatattattgttactatgagcctcaccctaattgttgtgtatgaagaggtktcatgaaatgtctgtkctggttattacagccatgtrtccaccaagatttgaaataarctgaacttagaagcagttcttggccaggcgcagtgggtcatgcctgtaatcccagcagtttgggaggccgaggcaggtggatcacctgaggtcaggagttcragaccagcctggccaacatggtgaaaccccatctctactaaaaatacaaaaattagctgagcatggtggcacgcgtctgtaataccagcaatttgggaggcagaggcaggagaatagcttcaacctgggaggcaggggttgcagtgagccgagatcatgccactgaacttggggttgcagtgagccgagatcatgccactgaactccagcctgggcagcagagtaagactctgtctcaacaacaacarcaacaacaacaacaacaacaacaacaacaacagttatttacatcaagggtccccaaaccctgttaggaatggggccacacagcaggaggtgagtggtgggcgagggagyattactgcctgagctccgcctcctgtcagatcagcagtggcattagattctcataggggcgtgcaccctattgtgaactgtgcatgtgagggatcttggttgcacactccttatgagaatctaatgcctgatgatctgaggyggaacagtttcatcctgaaaccatccccaccccaccaccagtccatggaaaagctgtcttccacgaaattggtccctggtgccaaataggttggggaccactgcttcacatcactatttcatagtgttgaaccagrctttcaaaattagtgaaatgcagaacgtacaaccactggtccccttcccatgatagtgggaaagacctgggtctagagtctatatttttgtacttatgagacatgttaaagtatagttttcaagaaggtaacaatgtggctgtctggcaaatatgcartgaaatgtgtcaaagattttacttagctcaccgattaatgagggaaccagtaaagatgcagtgaccagttcaaagagcatttgagaaacaagaagatttctaggacaagmcatgagtgtgatggttaattttaggtgtcagtttgactggattaaggaatayctagaaacttagtaaagcattgtttctgggtgtgtctgtgaggatgtttccagaggagactaccatatgagtctgagtggactaagtggggaagattcccctcaatgtgtgtgggcayggtccaacttgctgggggcccagagagaacaagaacagaaagggagaatgtgtccatctgtctgccagagctgggatgcacttttcttcttctgtcctcggacaacarttccaggctcccgggcctttggactctaggacttacatcagyggcccctggagttctcaggcctttggcctcagattgaagttataccatcagtttccctggttccgaggctttcacacttgggctgaaccacactactgacatcccaaggtctccagctcgcagatggcctgtgatggaacttctcagcctccataattgtgagagccaatccctctaakaaatcctttttcctatatctatatttatatctatatcatctatctgatctatatctatcatgtcccattgattctgtstctctggagaaccctaagatagtgaattaaatgttaatgtccaacaagccacaaatcrggagttacagtcatgcactgaataacaacattttgatcaatggcagactgtatatatgacagcagttctgtargcttataatggagctaaaacattcctattgcctagtgacactgtggctattctgacgtcatagcatactggattactggtgtgtttgtggtgatgctggtgtaaacaaacctgctgtgctgccagtcatataaaagtatagcakgcacamttatgtacagtccataatactttataatgataataaaagactatgttactggtttatgtacttactctattctttgttgttattttagagtatactcctacttatttaaaaaaaaaaagttaactgcaaaatagcctccggcaggtcctttaggaggtgttccagaaggcattgttatcayagtagatgacagctccatgcatgttattgtccctgaaccttctagtgggacaagacgtagaggtggaagacagtgatattgatgatcctgastataagtaggcctagactaatgtgtgtgtttgcatyttagtttygaacaaaaaaagtttaaaaaataaaaaaagcttatagattaaggatataaagaaaggaaatatttttgtawcmctgtacaatgtgtttgtgggttttttttttttttttttttgagacagagtcttgctctatcgcccaagctggagtacagaggcatgatctcggctcactgcaacctccacctcctgggttcaagcaattctcctgcctcagcctcctgagtagctgggattacatgtgtgtgccaccacaccctgctaatttttgtatttttagtagagacgggtttcactatgctggccaggctgatctcgaactcctgactttgtgatctgcccacctcggccttccagagtgctgggattacaggtgtgagccactgcacccggccaatgtgtttgtgttttaagctaagtgttattacaaaagagtcaaaagtttttaaaaattttaaagtttaaaaagtaaaaaagctacagtaagctaagatttattatttaagaaaatgttttccagtctgggcaacatagtgagaccccatctctacaaaaattacaaaaagttagctgtgtgtgttggctgatgtcggtggtccccgctacttgggaggctgaggcaagaggattgcttgagcccaggaagtcgaggctgcagtaagccatgatcacactactgcactccagcctgggagacagagtgagacctcacaaaaaattaaaaaatgtttaaaaataaatgccccacctgagcaacatggtgaaacctcgtctctacaaaaaatttaaaaactacccgggcatggtggcgggtgcctgtggtcccagctatttgggaggctgaggtgggaggatctcttgagcctagggaggtcaaggctgcagtgagctgtgatcgcaccactgcactccagccaggtgagagagctaggccctgtctcaaaaataaaataaaataatccatccataaataaataataaatgtagcatagcctaagtgtccagtggttataatctacagtagtgcaccgtaatgttgyaggctttcacattcaatcaccactcagtgactcacccaggcaacctccagtgctgcaagctccattcatagtaagtgcctgataaactacagggcacttttgggcagttgactttaaagtaaataggcttctaaattaacagcctgagggagggcttgtrattcatgcaaacatcttgtccctgagtaacgaatcttattgtgagttcctyaaattgtcaagtactgattaatgcacaacctcctgacactgaagaggactctgactcacttttgaawcaaatgtcgatattttagcctttatattgcagtctgtagccaatgattgtaacctctgtgttgtacctccagtgaaaaggatggttgtgctgtcaggagtcctcccttcttctaaactttcccataaaagccttccaacttgtagcagactccagaacactcccaactttgttagcgtgtcttcccaggtcaaccatacatatagcctaggtgtatggtaggctagaccacctagatttgtgtaagtgtggcaggccaattctccctgacaatcacacagacaggcctgcatagcastccagttacacagatttccacagagctgccttaacattgagcaaatagttaaacctagcaaaatcggcacccagacagcaaagctagaaatgaarcrtatggtcagtaggagccttgcgtgggcttctccctaacctggagcaaaccaaaataatacagtctttcattcctagtgcaggacccatctcgggtcaacgaaatctgagacagtcaaggtaacagagctgtttgagtarattcattggagagtctaaggcagcactccagaccaagctgtaaaggagataagatagaaataatcactctggtaccacagtacacaggccttgaaggtactgaggcccttttaatcagacttagtaagcattagtttgcctctgaccttctagttgaaacaaaattagttaccaatagacttaggtgaatgctatactgcatgtgggcatataaccccaacctatataatcatgaagaaaattgtaacactttgagttggtcttgtggaattatctccagcctgctccctgtaactggttacagcaataaattctcttctttcctagtttttctgcttcttgttattgggccytgagaaaacgtagcyggacccggcttggttccgtgaacataagtacactctrtgatgttcacaccatttggcttccaataaaccgttttttgttgttgttgttgttktttggagacagattcttgctctgttcccagtctggagtgcagtggcacgatttcagctcacagcmacctctgcctcccaggctcaagtgatttctcgagcctcagcctcctgagtagctgggattatagacacgcaccaccacgcccagccaattttttttttttttttgagatggtgtctcacatctgtcgcacatgctggagtgcagtggcaccatctcggctccttgcaacctccacctcccgggttcaagagattctccttccttagcctcccgagtagttgtgattatacgctgtgccaccatgcccagctaatttttgtatttttagtagagacaggtttcgccatcttgcccaggctggtcycaaactcctgaccttgtgatctgcctgccccggcctcccaaagtgctggggttacaggtgtgagccaccgcgcctggccaatttttgtatttttaaaagagacaggttttgccatttggctaggctggtcttgaactcctgacctcaagtgatctgcccacctctgcctctcaaaatgctgagattacaggtgtgagccaccrtacttggccccaataaacctttatcaaattatttgtgccccaacagccttaattttggtaaacatgtcctatacaggtgtaccattttttatcttttataccatatttttaccgtacctacttatgtttagatacacaattacttaccattgtgctacaattgcctacagtatttagyatactaacacactgtacaggtttgtaacctaggagcaatttgctattccatatatagtaggctgtatcatctargtttgtgtaagcacactctataaggtttgcacgaggacaaaatcacctcacgcatttctcccygctgttaagcaayrtgtgacctgtatctgtcccaccaacagaagttatttgcatttcttcctgacaaaaatcttcaagttaacaagtaatttcacgaattctgggacccttaatcaatagtaaataatgggataaactttacgttactatgatcctctggctgaatccagcccacatattttgtaaataaagttttgttggagcccagcctatttcttcctttgcttattgtccatgactgcttttgtgccacaatggcagtcctgagtacacacagcagagattctaaagtccacagatttagacttgagttctcaacacagaaatcctaaagctcacagtagaracagggtttctacctgactcagagcctgagaaatttactatgacttagagcctgagaaatttactatgtgaacctttacatgctggggaaagcctgagggtcatgaccaactcagcaytccactggaggctatatgataaaaragcaaactgtttatcacgaatgcaggatgtggggaaactcacatctgcacctgccaccagaaggtatgctgagggcaatcactccctggcgccgtgctccttgaggttatctrctggaacatctggagcctactgttcaaagaaagcagttatgcaggcctgcactaagtgaaacagctgactgacaaccaccccctcctcattatttcctttactcaataaatacaaagggctatagaagctcagrgcccttgttcactagaagcaaggagacccctgaccccttcttccaaatatacttgtttgtctttgtctttattccckcattcgtcctcctttgttcagtccaccagggtccgtggcacagtggagcctgagggttgtgaccaacttttacaaataaagttcgttggccctcactctagacaaccctatgatgatctttgccactgcatgaaagtgaaattgtcagaagcatgtgaaccagagcaactccatcttgaataggggctgggtaaaatgaggctgagacctactgagctgcattcccagatggttaaggcattctaagtcacaggatgaggtaggaggttggcacaaaatacaggtcttaaagaccttgctgataaaacagactgcagtaaagatgccagctaaaacccaacaaaaccaagatggcaacaagagtgtcctctgattgtcctctctgctacactccgtccagtgccatgacagtttacaaatgccatggcaacgtcaggaagttaccctatgtggtmtaaaaaggggaaacatgaataatccaccccttgtttagcatatcatcaataaataactataaaaatgggcaaccagcagccctcggggctgttccgttcatgaagtagccattcttttattcctttactttcctaataaacttgctttcaccgtactctactgacttgccctgaattctttcttatgcaagatccaagaaccctctcttgggatctggatcaggactcctttcctgtaacaaaaggatgtgctatttagctttttgccttatttccaagttttgcatactttttctgaccaacacttgagaacctttaatatatagtttttctgtttccattgkcttcagttccaattgtcttttggttccaattctctaagttttaattcaaccagtgtttactgaacacatactatgtaccagaagctactgcaatgaatggaacctagccctcaccttcacattttgtgaggaaatcaaatgtgtgactgtgaagggttcttcttttagataactctttttttttttttttttttgagacagagtctcactctgtcgcccaggctggagtgcagtggcacgatctcagctcactgcaagctccatctcccgggttcacaccattctcctgcctcagcctcccgagtagctgggattacaggcgcctgctaccatgcccagctaattttttgtatttttaatagagacggggtttcaccgtgttagccaggatggtcttgatctcctgacctcgtgatccgcccgccttggcctcccaaagtgctgggattacaggcgtgagccaccgtgcctggccaagaggagaactgtaagtccaatctaaggaagatatcctagatatgcgaagattgaaggcaggggagaaagagaaataagacgttaatagttgctagagggaaacatgtgaatttgttttggggactctttggttttaagaaaatcactttggccggacacggtggctcacacctgtaatcccagcactttgggaggctgaggtgggcggatcatgaggtcaggagcttgagaccagcctgaccaacatggtgaaaccctgtctctactaaaaatacaaaaaaattagccgagcatggtggtgtgtccctgtaatcccagctactcaggaggctaatgcaggagaatcacttgaacctgggaggcagaggttgtagtgggccgagatggtgccattgcactccagtctgggtgacagagggagactccttctcaaaaaaaaaaaaaaaaaraagaaagaaagaaagaaaagaaaatcacttcaataggccttttgattgtgaaaaagtgaaggcaaagtcctattttaaaaaggagacatttgaagtgaggacccagctctgatttttttttttttgcccaaattcctgtctaararatctggggagtcatgccctacaaactataaattctcatcagatgggttttatttaaccttatatatcgkgttttactttccaatctgactcaggcataacattacgtgacaaagaaraaaatcaaaatattttatcccaaaacatgtttctttgccatattttgaaatggccctgcaagccatcctttgtgggggaaattttgcatgtgtaaagaatctctgttaacatagctagatcttttccttccaggccctctcaatcctgaagaaattaactaagagtctagcaccttttaaaggtctgaataggaaatatttgccatctattgtctctaagggcagccactgtgaaacttcaaaagaacctcgatctccataatcttttttcttaacccgaatatttccttgctattaatcccaggtctttttaaatttttatttattatttatttatttttttttgagatggagtctcactctgttgctcaggctggagtgcactggcgtgatcctggctcactgcaacctctgccccctcgagtttgagtgattctcctgcctcagcatctcgagtagttggtattacaggcacctgccctgtgcctagctaatttttgtatttttagtagagacagggtttcaccatcttggccaggatggtcttgaactcctgaccttgtgatccacccgccttggcctcccaaagtgctggaattacaggcgtgagccaccgcgcccggccaatcccaggtctttagacaaactcaaccaattgtaaaccagaaaatgtttaaatttacctatagcctggaagccccctaccccaaccttgctttgaattgtcccacctttctggacgaaaccaatctgtttctcaaatgtatgtgattgatgtctcatgccctccctaaaatgtataaacccaagctgcaccccaaccaacckccttgggcacatgttctcaggacctcctgaaggctgtgtcacagaccatggtcactcatatttggctcaaaataaatctcttagaatattttacagagtttgactcttttcgttgacacaagcaataggaaggtaaactgttctgctcaggatcataaaaccttgtctttttttttttttttggagacggagtcttgctctgtcacccaggctggagtgctatggcatgatctcggctcactgcaatctccgcctcccggtttcaagtgattctcctgcttcagcctactgagtagctgggattacaggtgtgcaccaccacacccagctaatttttgtrtttttagtagagacggggtttcaccatgttggccaggctggtctcaaattcctgacctcaggcaatctgcccaccttggcctcccaaagtgttgggattacaggcgtgagccaccatgcctggccaaaaccttgtctttttattgtgccttgtttcagtaataaatatgttgtaagacacttttcactatacaactacttatacacacaatatacaaaaatcaacaaaatgcttcagtcgaagcacacaggagtggtaaaagtaaaataatttatattaaaaataatatatacagtcggcacaccatgtggattcaatcaactgtggatgaaaaatatttgaaaaaacaatagaacaataaaaatgatacaaataaacaatacagcataacaactatttacatagcattttcattgaattaggtgttatcagtaatctagagatgatttaaagcaggagtgtccaatctttcggcttccctgggccccattggaagaaaaataattgtcttgggtcacacataaaatatactaacactaacgatagctgataagctaaatatacatatatatagcaaaaaattcataatgttttaagacagtttacgaatttgtgttgggccacattcaaagctgtcttgggccgcgggttgaacaagcttgatttttttttattttttactttgtatttatttatttttttgagacggagtctcgctctgtcgcccaggctggagtgcagtggcgccatctcggctcactgcaagctcctcctcccgggttcacgccattctcctccctcagcctccccagtagctgggactacaggcgcctgccaccacgctcagctaattttttttgtatttttagtagagacggagtttcaccgtggtctcgatctcctgaccttgtgatacgaccgcctcggcctcccaaagtgctgggattacaggcgtgagccaccgtgcccggcyggagaagcttgatttaaaggacagaggaagatgtgtgtaagtcatatacaaatactgtaccattttatataaggaacttgagcatttacaagtttttggtatccttaggggccctggaacaccctgtttgatgctgagagatgactgtagttaacagtcgcattacttggatatgataacatcagaaggcataatgaatagtgagatgcttgggcctctatgttgaggacgaagctctgatttttttttttyccccaaattcttatgtaaggagtctggggagtcatgcyccacaaatcatcagttctcatcagatgggttttatttaatcctgtatattgagacttactttccaatctgactctggccatggcaaggaagaaaataaaaatattttacctcaaaacatgtttctctgtcatatcttgaaatggccctgcagagccatctcttgtgggaaaaatccacattccgtagagaatccccttttccccttttttgtccttccttcctttccagatccaggagataatcaactaagagccaagcacccttttagttccgataagaaacattttgcaacctgctctcyctgaagtctgctatctgagakcttcctctgcacaataaaacttggtacccacaatcctttatcttaacctgaacatttcctttctattgatcccaggccttcagataaactcaaccaattgtcaaccagaaaatgtttaaatttacctatgaagcccccccgcgctttttgtcctgccttttggaaccaaaccaatgttatttcttaaatgtatttgattgatgtctcatgtctccctaaaatgtataaacccaagctgtgccccaaccaccttgggcacatgttctcaggacctcctgaaggctgcgtcaccggccatagtcactcgtatttggctcagaataaatctcttaaaatgttttaccggccaggcatggtggctcacgcctgtaatcccagcactttgggaggctgaggcgggtggatcacgaggtcaggagatcgcgaccatcctggctaacatggtaaaaccctgtctctactaaaaatacaaaaaattagcsgggtgcggtggtgggcgcctgtagtcccagctactcgggaggctgagtcaggagaatggcgtgaacccgggaggcggagtttgcagtgagccgagatcgtgccactgcactccagcctgggcgacagagcaagactcctctcaaaaaaaaaaaatgttttacagagtttgactcttttagtcaacaccgttaaatactgaaaaagggatggatatagaaacagttatggtgtatcactgactaaaataccaaaattaggctttccttcagagacatgattttccaaaatggtgagtaaataaaatcctgagccaagaaaagtacagtatttcctagatttgcaaatctacagtgattgaattcctggaaaattcagtgtctagtaaaactatgcaaaaatattttgttaacatgtaaaagttaggccgggcgcggtggctcatgcctgtaatcccagcactttgggaggccgaggcgggtggatcatgaggtcaggagttcaagaccagcctggccaagatggtgaaaccccgtctctactaaaaatataaaaattagccggacatggtggcgggtgcctgtagtcccagctcctcgggaagctgaggcagagaattgcttgaacccgggaggtggaggttgcagtgagccgagatcgcgccattacactcctgcctgggcaacagagcaagactccgtctcaaaaaaaaaaaaaaaaaaaaaaaaagaagtaaaagttaggtttaagctcagataattataaacaggtttttaaccttcataaatgggtggagggacactaaaagtttatctgggctggggaacaattttgcttttggaggctgttctacacattgtttactgtcgctggcctcagccgggcccatgcaaacatgcaaatcccgccagccctctaaatcgttggtacagacttcaaaaaatttccaaattgccctctagagggcagtactagcactgtagagagtcactgaaccaaaaagctctgctgtggactaaacctgccttgcttcttggggcggggtagggcagcattattctgtggtctgggctgcctggggttggggataagtggtaggggcaaagacattattttcctctcaccagccccttcgggaaggctggaatgctggagattttacaaacacgaatcgctatggtgacacctgacaccttttttgtgtattttaaatcttctaatcaatttgggatagaaaactggagtcaaaaactcttccctacaaaaataatgcaatatttctatctatctatctatctatctatctatctatctatctatctatctatcathtatcatctatctatgtctatatmtatcagtatgtgtgtatatatatgtatatacatggctgtatattttatgtattcctacacaattatgatgtcatggtttgtactgtagaaaaagtgggggcaatctaaatgtccatgaacaggagagtagattttttatttattatttattattatttttgagacagaaaaatatgtcacctaggctggagtgcagttgcgtgatctcggctcgctgcaacctytgcctcccaagttcaagcaattctcttgcctcagcctcccaagtagctgggattacacactgggctaatttttgtattttttgtagagacaaggtttcaccatgttgcccagactggtctcaagctcctggcctcaagtgatctgcctgccttggcctcccaaaatactgagattacaggtgtgagccactgcttccggttaatcttcaactatatatatatatatatayayacacayacatatatatatataywcatayacatatatttatttattgagatggagtcttgctcttgtcgcccaggctggagtgcagtggtgccgtcttggctcactgcaacctcctcctcccaggttcaagcgattctcttgcctcagcctcstgtgtagctgggattacaggcgcctgccaccacatctggctaatttttgtatttttagtagagacagggtttcagcatgttggccaggctggtcttgaattcctgatctcaggtgatccacccgcctcagcctcccaaagtgctgggattacaagtgtgagccacggagcctggccaataatatatattttaaaaataactatattttccaaaaataaaacatatgagtagaatgcccttgttttacatttttgcaaatctcgttaatatctgacctactagaagacagattatctaatcagttstgtattcaatatgttgtgatattatgtaggttctagaaaattccactttacactcatgagagaatggaagttaaaragctaaatataataattattataaaactaatttgaccttggaggcctcttgaaagcatagggccctccccaccaaggaccacggggcaccactttgagagtctttgctctcaaatcaattaggacccagactmtatgaagttaaatgttamacagattgatagttttttgtgtgtgtgtgagacagagtctcactctgttgcccagactggagtgcagtggtgtgatctcggctcactgcaacctccacccaccgggttcaagtgattctcctgcctcagcctcccgaatagctgggattacaggtgcctgccaccatgcctggctaatttttgtacttttagtagaggtgggatttcaacatgttggtcaggctggtctcaaattcctgacgtcaggtgatccacccacctctgcctcccaaagtgctgggattacaggcagcagccacctcgcccagccgatagtttgtaatgatattttttaaagatgtaaatgatttctgtccaattggaactccaaaggtaacagttttctcctttcctttccttccttcttcttttctctttttctttctttctttcttcctttcttttttttttttttttggcagggtctcactctgtcaaacaggcaggagtgtagtggtgagatttytggtcactgcaacctccatccacctcctgggttcaagcagttctcccacctcagcctcctgagtgagtagctgggactacaggcactcaccaccatgcttggctaatttttgttattttttgtagagatgtggttttaccatgttgccaaggcaggtcttgaactcctgggctgcagcatctgccctccttggccccacaaaatgctaggattacaggcgtgagccactgcacccagttttcattttcattttaagctaaatttaaccagtcttatatctgatttagcaaacatgctggtgttctgtttttcccccagtggtgatacatatgtggttcctcaaattctccttagaaccaatttttccatccagctggtccccctcattgatgagttaaataaacctttaagctacattcacgtttgacastttatctgatatttatgtaagactcatgttttgaagtatttgaatgctgtattttgtttctcaattttttatcttgaaaaaaaattcaagcctttagaakaattgaaagaatactgcagtgaacacctttatgccatttttcctagattcaatcactgaatttttgccatgtttactttaattccacgcccccacctccaccatccrtttatctattgtaagggtagatttcaaaaatgagtttcccatttgccaagaaggaaggaaatctttccctcmtccccttcttagagcatttctgtcagaaaacctygtggctgtaaagcctttttctagccttttaaaataaaaatatktcwctttagatgctaagtgcaagggcattatcctacatagccaaataaactgatctcacacagagaatttataactrtacaaggtattctattttctaatacattgtctgcattctaatttcctcattagttccaacaatttgctttatagcttttcttttttttattttttgcttcaaaatccaataaaaaattgcacattggctgggtgcaggggcttacacctgtaatcctagcactttggtaggccgaggcaagagtatcccttgagcccaggagtttgagaccagcttgggcaacatagtgagactctgtctctaccaaaaacacacacacacacacacacacacacacacaaaacaggcgtggtggcgtgcacttatggtcccagctacacaggaggctaaggcaggaggatgtcttgagccccagggttagctgcagtgaactatgataacactattgcactccagtctgggcaacagagtgagaccctgtcttaatagagcgcattcatttcttaggaatttgaaccttccactggctaggtaacagcttatatttttaaccattcttcactaagagttaatgcttcttttctgtatataagaaagaaatggtaggtagtgtgatgtactagatgcaaatctttgtacttgcaaattactcaattttactaagcttcagtaaattgattaggatgcttctggttgccggtaacagaaaatccaaattaaaaatgaccgaaacaattacatttgatatctcacataaaaggctgggcacagtggctcacacctgtaatcccagcacttgggagaccaaggtgagagaatcacttgagcccagcaattcaagactagyctgggcaacatagtgaaaccctgtctctacaaacaaaaaaaggaagaagmcaaaggagaaagagtagaaggagaaggagaagaagaaggagarggaagaaggaggaagagaaggaggaggaaggaagtggctcttgcctgtaatcccagaacttttgggatgctgaagtgggtggataccttgagcccaggagtttgagaccagcctggacaacatggcaaaaaaccatttctacaaaaaatacaaaaattagccaggcatggtgacatgtgcctgtagacccagctacttaggaggctgaggtgggaggatcacctgagcctgggtggtggaggctgcaatgagtgaagattgtaccactgcactctagcctgggccacagagcgagaccctgtctgagaaaaaaaaaaaaaaaagtcttagttgtaggcagagattgccagaaactagatttttccagcctgtgttgcctcagccatgtgacccaggtctggcaacgttcttgtctttcttttgactttggagccagtgacagaagaaatagggataataaacttcctctctggcacctgctggctagagagcgtggttctctaggcttccaaacaattctctgagaaacccagtatctgttgagttaactttttttttcatcttagatcagctggagttgactactgtggcttgcacatggaagctgggagaacagaaactctcatgtggaagagccaagatgtccttggagccattaccagcctcttgctgagcattctttcctactatattcagccgggagtttctccaatggtcctacctcctgtgtactctgtccctaggcatccctcaaatggagatcatcctgccccagaaaagtctctgagaacggagtcaacggtagacagcaggaaagagtgagtggagatgccggctccactgtgccaagtgaaaataacttggtgagcactgagggcactctaagcacgggccagtcagtatcaaacactgttctgatcctagcaacagtatgaggcagaaacctaagttacagaacttgatttacagaccaggaaatgaaggtttataaagtttgaagaagtaagactgggatttcaatacagattgtatgtttctggaacctattgactttatttgtgagtttttgtttgtttgtttgtttgttttgcccttctttctttatttaattaaaacatctgctgatggcaagaatgacccatgtgcctaacaaaaatgcaaatggttaacatgcagagtggaaattctatctttgataaatgtctgttggaacctattgactttaatttcaaactctacagtctcccggaggggatgatagaatactcatagagtctatggggatttttatcaggctgatgtgaagggagaaatcatatgtatgggcatgatggtgtgcgctactcagccttctgagtaattccagctactcaggaggctgaggagccaggatcccttaagcccaggagtttgagtccagcctgggcagcatagtgagaccctctttcaaaaaacagcaaaaaagggctgggggtggtgtctcatgcctgtaatcccaacactttgggaggcagaggtgggtggatcacttgaggtcaggagttcaagaccagcctggccaacatggtgaaaccccgtctctactaaagaggcaaaaattagctgggtatggtggcgtatgcctgtaataatcctatctatttgggaggctgaggcaggagaattgcttgaaccctggaggtggaggttgcagtgagcagagcttccgccaccacactccaccctgggtgacagagtgagactccgtctcaaaaaaacaaacaagcaaacagtggaaaagggctgtggtgagttgacttgctatgctctatactgaggggtcaaaatatgggcatatggctgcctgatgcctgagtctttcaggcacagctgggataagattttgacatatgcaaaaagcaaagtctttgaataaactaatttccatggcttgaatttgttacaatctatctcaatcttgtctactgatatttgaagaaccaaatgagtgtacattggggctcctcatgtgcacactggtttgaagagagatgcttgtacgtatcaccacagccttctcagggaggagtgctgggcaagttacaaagacacaagtgaaggaaatacggaaatggtagaaggaaaccaacataggcatatgaagcaggattaagcattagaaaatgacgagtctggctcttctgagaagcagacagcaagatgggattacacttgaagtattttactgggggaaacactagagtgaaaggaaacaaggaggaagccgggaaaggctgagagagcagtcacagtgatcagcctcatcagacccatgcaaggctgacccagagtgaaggagagggagaaagaaggttgaatggcagcatctcagtcagcctgcggcctgaggatgtagcagcaaagacttggaggagttcctgagccaaaattaacaatattcttttgatatcatccaatacccatattcaaaatttttttttttgagacggagttttgctcttgttacccaggctggagtgcaatggcgtgatctcagctcactgcaacctctgcctcctgggttcaagctattctcctggctcagtctcccgagtagctgggattacaggcacccaccaccacgcccagctaattttttgtatttttagtagagacggttttcaccgtcttgggcaggttggtcttgaactcctgacctcaggagatccgcccgcctyggcctcccaaagtgctgggattacaggcatgagccaccgcgcctggacccatattcagatttctttttttttttttttttgagacggagtctcactctgtcacccaggctggagtgcagtggcgggatctcagctcactgcaagctctgcctcctgggttcacgccattctcctgtctcagcctcccgagtagctgggactacaggcgcctgccaccacttccggctaattttttttgtatttttagtagagacagggtttcaccttgttagccaggatggcctcaatctcctgacctcgtgatccacccgcctcagcctcccaaagtgctgggattacagatgtgagccaccgcacccggcctcatattcagatttctaaaatgagtccttacttaaatttttctaaatgtctaaaattatatttatgctattggattgtttgaatcagggtacgaagaaaaccaagaaaaaaggtccactcattgcatatgttttttgtcttttaaatattttgttatgttttgtttttggaggaagggtctcacactggcagccaggctggagtgctgtgcctcagtcacagctcactgcagccttgaactcccaggctcaagcgatccttctgcctcagcctcctgcatagctgggactacaggtgcacagcaccatgcctagctaattaaaaaattttgtaggccgggcgcagcggctcatgcctgtaattcccagcactttgggaggccaaggagggtggatcacgaggtcagaagttcaagaccagcttggtcaacatggtgaaatcccgtctgtactaaaaatacaaaaattagccaggcctggtggtgcaagcctgtaatcccagttacctgggaggctgaggcaggaaaatcacttgaacctgggaggcggaggttgcagtgagctgagatcacgccattgcactccagcctgggcagcagagtgagactacatytcaaaaaaaaaaaattgtaaagacagcccaaaaatacaaaaaaaattagccaggcatggtggtgcatgcctgtagtcccagctgcttgggaggctgaggtgggagaattgcttgaatccaggaggtggaggttgcagtgaccaaagattgtgccaccgtactcctgcctgggtgacagaggtaaattttgtctcaaataaaaaaaatctgtagacacaggatcttgctatgttgcccggtgcccaggcttgtctcaaactcctggcatcaagaatcctcctgccttggcctttcaaagtgctggctttacaggcctgagccactgtctggcctcttgagtgggaggatcacttgagcccaggagttggaaaccagcctgggcaacatagtgagatcttgtctctacaaaaaatttaaaaaatagctggttgttgtggcgcatgcctgcggtcccagctactcaratggctgaggcaggaggatcgcttgaacccaagagtttgaggctgcagtgagctatgattgtaccagtgcacttcagcctggacaacagagtgagaccttgtctgtgaaaaaaacatcatgttggagaaacaagaaattaagacccaagggaaaatgccaattcataagtatagaattagctaatttaattgttaagcaaaaaaaaaaaaaaagtatttaaattcatgtattcagatagcttataagtgattacaaagctatgatgtattttcagctctatttaatctggagttaaagctccaattgttatacatcatcctacagtgaacagtcagtattgattcaataaagtttactttgatgttctgtttttatatttctttcatcagtactccctacagttgtctctaacagaacatctgtgaaaagaaaagaaaatttcagatttattatgccaaggggaaaaattaagtcccggaaactgactcacataatatggctgtttttcttgtctggtgcacaaccattgcttcctgacctttgtgttgagatgttatacattaaccagactcctatgctttattcaaacctagattaaatcttgttggagatagagactctttatctacctctttatatgaaatgttaagcaaccacttagagcgtaatcgatcataaccaatcagrtcttgtaactgtttgttagtcttgtgtggaaaatgtaattctgttcagcattcttgttttttcctatataaatgacccctacctttctctacactggggagcactcatcgccattctttggtatccctgttttcccatacagccaccctcacactttgcacttgaataagctatttttaaaattatttttatagattcagggagtacaagtgcagttttgttacatggatatattttcacagcagcttttagtgtagccatcacccaaatactacattgtacccattaagtaatttctcatccctctacatcctcccacccttcttgttttttttgtttgtttgtttgttttgctttgttttgttttgytttgctttgttttgttttgttttgagacagagtctttctctgtcgcccatcctgggttcaagcgattctcatggctcagcctcctggggttttaccctgatggtccagctggtctcaaactcctgacctcaagtgatctgtccgccttggcctcccagagtgttgggattacaggcctgagccactgcacccagccccgccacccttytgagtccccattgtttatcacttcactctctatgtccatgtggacacagtatttagctcccacttataagtgagaatgtgccgtatttagctttctgtttctgagttattgcacttaaattaatggtctccagttctatccatgttgttgcaaaagacatgattttattcttttttatggctgaatagtgtaataaactcttttaactggatcctgagccttttggttattttaggttgacaatctatgtgacagtaaatttggtcagtccctttattcaacatcctcagtaaggttagattatgttgagtttctacagattctattagagcccacacttttttttttaatgccattgacttgattacaaagacaggttagttgtcctgcatgatgtcctaaattctgactttgactaaatatttcctcctagtgttacctaactttttcctctatcttctatttttcttgtagactacaggcttgaatagattcaggtttaaggttttgctttgtattgcttagtttatgactacttcataggtggtgctgtatgcttcctattgcctcatattcaaaagcatgcaatagctggttgtttcacttacagtggctgctaagatggatcagcgagttcaagtggtggcatcaacctttttacctaatgattttgtcatctattgataaccagtatttaagtcattttattaggagctacaaaatgttgactttctaatactacatttattatctgtaattattctatatagaactcttatctagtagggttatttgatttccaggaaatactgttcatactggaaaggtgatataaaatctcggttctttccccttaattatcagtttttggagtaatgagttggtgcacagcaacctttgctcgattcattcactatggcgtgtttgttctttcctctttaaaaaaattatgactttttattatttatatatttgtttatctacttgagacagggtctcactctgtcacccaggctggagtgcagtggtgcgaacacaactcactgtagcctcaatctcctgggcttaagcaatcttctcacctcagcccccagagtaatatttttatttattttaatcaattgaaataataattcttcttgatgttcaaatcatcttatctttgaccaaaaggaccctcttcaagctggcttatggaattttttgttatttgatgtgtcccatcattagcctttgataatgtttttactttctggggcaacaagctgttccaagcttatttttcttccttttctttttttttttccaattttattttgtactttttccgccctggacctggtttaggtgtggtgcttttaatgaaaaatggtatgaatttcagctattctaattgtggatagtgatatttcattgtggttttaatttgcgtttctctgatgactaatgattttgagcatctttccatgtgctgattgatcattcatatatcttctttggtaaaagcatctattcactgggaggcggaggttgccatgagccgagatacaccactgcactccagcctaggggacacagcaagactctgtctcaaaaaaaaaataaaaagtgtctgttcaaatctttcactcattttaagaaaatgggttgtcatttttttcctatggaacagaatttattggatagtagcattttaggaaaaatataagctctactatatatatatataaatctatatagatagatagatagatagatacaatcaactgtaaagtccatctcaacttcagaaaatgtaaagacatgtccatcttagaaatgaagaaatggcttccttgcaagtttgcaagaacattagtgacataatgtataaagtacttaacataagtgttcaaagggtaactgttgttactattatcaactgtattaattaaactgttttgagatttaacacacatgttacagactttaagaaagcagctgagtgcaggttttttgttttagttttgcgtttatgccaatgtgaaaatatgaacagctcagttctacattctgttccctgaaaataccacgagagctattagacagtcttgaaaggcagtatctaacataagctttgtgtgttcatggatatttgttcaataataacatttaaataatgagggaggccacttctaaagacttatcatttacctgatctacacaatatctagcataggaccagttctcaattgacggcaaacagtccyagcaggtcacttcattttgaacagacattgcaattgcacttgagaaatcatgccaagttttgcagggattgtccttggacttgtcaccacgaagacataactcatgctatttacatattatagcattttctttctttttttttttgagacggagtctcactctgttgcccaggctggagtgcagtggtgcgatctctgctcactgcatgttctgcctcccgggttcacgccattctcctacctcagcctcctgagtagctaggactacaggcgcccgccaccacacccagctaattttttgtatttttagtagagacggagtttcaccatgttagtcaggatggtctcaatctcctgacctcgtgatctacccgcctcagcctcccaaagtgctgggattacaggcatgagccaccgtgccgggctattatagcattttctagactagttcaatctgcaatgtccttgcactgaccagggctccatttcctttatcagagggctatgatggaaatgatgtggagttcacctggctgagacggaatgactctgtgcatgggctggaaaccctgtggcttgcttagtacaccatacaatggtatttcaccttggacaccagattgcagcaggagacaggtaactcatgtgacaattttttttttttaatttttaccattgttttcgtagatattcctaggccagttctaagagtttgtttcttgggagattagtgctggaggccagaagtctgagatcaaggttggttttttctgaggcctctctccttggcttggaaacagccgttttctcggtgtcttcacatggtcttttgctctgtacctgtccaaatttccttttcttataaggacatcacttgtataagataagggttttcccctcattttaacttaattacctctttaaaggccctatctccaaacacagttacattccgaggtactgcaggtcagggcttcagcacatgaattttgggcaaggatggagagggttggaaacaatacaattcaccccgtaacaccagatctgactcctctcactagcctcctcaaagagtgaggggttactgtgtgtccttttcagattcaaattaaacaagcttttgctctgtcagccaattctgggaaaccaagtttggtttgggcagccagtcaggttgtctttttattactaagttgtaagagtttttttttttttttttttttttttttttttttttttttttttgagatrragtcttgctctgtcrcccagrctggagtgcagtggtgcaatcttggctctctgcatcctttgcctcctgggctcaagccatcctcccacctcagcctccagagtagctgggacgacaggcacgtgccaccttggctggctaatttttttgtatttttggtagagatggggtttcatcatgttggccaggctggtcttgaactcctgaactcmrgtgatcctcctgcctcagyctcccaaagtgctgggattacaggygtaagccactgtgcccggccagttgtgagaattttgtatgtattctgactaccagtcctctgtcagatatatgtattatgatgatttctcccagcctgtggcttgccttttaattttcttaattttgtctttcaaagagcagaagttttgcattttgataaaaatgcaacttaccaattatttcttttatggtttctgctttggcaagtttgtaaatatttttttccctgtgttgcatggttttagcaattatctttaggtctatgatccacatggagttaatttttgtgtgtggtgtgaggtagggattgaggtttttttttttyccaatatagatatkcagaatttaggctgggtgtggtagatgacatctgtaatcccascactttgggaggccaagatggttaattgcttgacgtcaggagttcgagactagcctgggcaatatggkgaaaccctgtctctaccaaaaatacaaaaaaattatctgggtgtggtagcatgcatctgtagtcccagctacttgggaggctgaggtgggaggatcgcttgagcccaggaggcagaagttgcagtgagccaagatggtgccactgcactccagtctgggtgacagagccaaaccctatctcattaaaaaaaaaaaaaragagagagagaagaaaagggaaaagaagatatgcagttgttcctgcaccatttgttgaaaagactggaatgttgattttaataatgcatgtaaattctccaccaccttgggaaatggtgttggctgaaaattacatgtgccctgataacatatgctttaacagagtacctggtgagtggaatgagaatgtggtggtttgcatgagtaactttgcatttctgaactgtttttcaatgcctccattcatattggtaattgaggtcattgggttagtaaggcaagcaatcagtggcaggaaagcattttcaggcacatagtaggtaactcaagtaaagagtgaaacccttccaaatgattaaaagaattaaaaaaaaaaaaaaaagagtgaagtcctgggcacagctgttagaaatctagacagctggccaggcttagtggctcacacctgtaatcctagcacttgggaggccgaggcaggtggatcacttgaggtcaggagttcgagaccagcctggccaacatastgaaatccctgtctctactaaaaataaaaaattagctgggcacagtggcgggtgcctgtaatcccagctactggggaggctgaggcagaagagtcagttgaacccgagaggcggaggttgcagtgagctgagattgcgccactgcatgcgccactgcactccagcctgggtgacaagagcaagactttgtatcaaaaagaaaaaaaagaaatgtagacagttgcatgacagttctagtattaataacatttatcatcagtgctcttgttcttgatgtatactgatcaccaggtgatgtccactgtttaccagaggaatatcagactctggaaacataacggtaagaagcaaaggagagggggcaggtgatttgtggaggatgctccagctgcctttccctgttctagagkaagggcagctctagatgcagcccttgccctacgtgaaagtgcrggaacactccctgagaggcaggagtgctggtttctcgaagctgtcatggtctctgtgttggtggttatgcctctttagaggtctcctggaggagtgtcctcattgaaactttccctttaggccatcaggccttggagacagggttggcattttacacatctttaatccctgcatgagattcacatttcttcttaggtcaggggatgctgaagccttggtaagctgcagcctttgtcagtagtttttttttttccccacaattattcagggggaaccaatgaactccatgagggtggggattacatctgtctactgttgtatctccagcacttagaatggtgcttggcacctaaaggatgctcaagttgttgaaggaattaatattccctctttcaacagctgagtgtcatagcttgggtctagccctgcacagtcaaggaaaaataaatctgactggattaggacctccaacatctgggaaggatctggagctggtctgctgaaatgagcttagggaaaagttcagaggtactttccctcttctcacttcctcactccgcaatttatgtgtccagtttgattgaatgggattcttcttaggtgcctactaggatgtgagtctcaccattaacctagcccatttggtgatgaaccagattttctgcatagctccttttagccttctcttttcttcccagtggagttggcctcagtgcccggaagccacagctttgtcctgtgtcctggctatccctgaatccacaatggtaccataattttgacagcaagtttcaccagtacccatagactcctatgctgaggttcctgtctatcagaatggattccttagctttggacttttaaattttaagatactgtcttcactttgggcattgcgtctattaccaatatgttttcttagtcccagcttgtctgttctaggcttacttccgcctccctgctagctcactgtttaattcccagcagatctggaggctggggctacgtatggttttgagaaaggctcctctgcttggcacttcacaaggacttccagtaatgagtggcgaaaagatagcgtgactctgttgcttcaatttactcttatctgtccacctttttggagtgggagtctgtcatgactttccctttctaaaccacaaagctaacataatatttcactttatttatttatttttaattaaaaaaaaattttttttttgagacggaatctcgctctgctgcccatactggagtgcagtggcgcaatcttggctcactgcagcttcaacctcctgggctcaagccatctgcccacctcatcctcccaagtagctgggaccacaggcacacgccaccacacctgactaatttttgtattttttgtagagatggggttttgccatgttgcccagcctggtctcgaactcctgagctcaagcaatctgctagccttggcctcccaaagcgttgagattacaggcatgagccactgtgcctggcctaacatggcattttaaaaaatcatagtgttcctgtgatcttattcccttgactaataatttatttagagtggatacatgatccagtctggcaaatgagatggaagtggagctgacttgagagggattcctttcccgaaaaacacacaaaagcaccagagaaaaaagctttccccctcccctttttcaccagcttgaacggggggcattcctggagcagcaggagcggcctcttcgaaatcttgagatggcacacatgaggacaaatgccaatatgccaagcacagcagggtgggaagaaatctgaatccctgatggcatcattttgcagttgaactgatgccagcaacaatccacctctgaatttatgctgtgggaaaaattacctattatttgtttaagcctgaagttgtgttttcttttatttgcaaaagcatgcatttctttttcttttcttttttttttttttttgagacggagactcactctatcacccaggctggagtgcratggcgcgatctcggctcactgcaacctctgcctcttgggttcaagcgattcacctccctcagcctcccgagtagaaaagcatgcctttctaacttgtagttaattttcttcttttaacacatcagtctggtcttatttctaggctttatctcatacgacayttactgkgtcctcacatgcacatactcctggccccaacctctctcaraattttatttttcctagtgtcctagctttgagctgtctacttgttcktgcccaccactggatgttcagctgcacttttctctaaaaggtttggtactccactccaaaaaaaattrtatttttaaaatataggaaacgatgatatatggagsacctactatgtgccaggcaccacaccacatatgttacagacattacctcattcgatcttcacaatcagcccaatgtggtaggtattagcctcctcctccaccatccttttatagcagaggaaacataagcacagtaatgttagagagcttgcgtaaggcctctcagccagcaattagtagagccagttttcatatccaggtctattgaattccccaaaatgctcttgcaattcagggagcaggcttgtatttgtcaggttcttaattccaagcaaagtaatgcaatctagccaatttaagcagaaagggatttgtcttagtccattctgtgctgctataacagaataccacagwctgggtaacttatgaggaacasaaatctattctctcacrgttctggagcctaggacattcaagataaaggcaccaatggttgagtctctggktccatgatgatgccttgttgctgcatcctccagagaagaggaacgctgagtcctcatgtggcasaagtgcaggagagagagaacacactcctgcaagcttgttttatggcaaagttaatccattcaccagggcagagccctcatgatttaaccacctctcattaggccccgcctcccaacactgttgcattggggattaagtttcaacatgaattttggaggggacacaaacattcaaaccatagcattccgccccccatcctcccaaaatatccttctcacatgcaaaatgcattcattccatgccagtagccccaaatgtcctaacttgtttcatcatctactcaaaagtccagagtctcttgttacacggatatggttgagactcaaggcatgatttaacctgaggcaaattcccctctagctcatacctgtgaaattaaacaagtcacatgtttccaaaatacaatggagacaggcatgggatagacacacttcttccaaaagtgagaaataggaaagaagaaagggataacaagtcccaagtaaaagcccaaaacccaacgggaccaacaacattagattttaaggcctgagagccatcttctttgactccrtgacagaccatctggacacaatgggtgagggttggactctcaaagctcctggtggccctacccccatggctttgctgggtgcagctgtcatgggttggagtcttgtgtctgtggctctcccaggctagtgttgcatgctaatggctctacagttctgatgtcttaggagtggccctgwcccacgactttactaagcaatgccctatttgggtatctttgcagtgacccccaatcccacagttccactgggcaaggggatttagaaaacagagttccgagttttccggtatccagagtgcaggatggaaagggagatggggccaatagcgggatccgccaaggcctccttgaggaaggctctttctttacagaagagctgcgcattcagttactactgtaaggcagagagtttagattgcaattcagcagcatctccaaaaaactcgtagtgctagaatggctttgaggtggaattttggaaatgagraccatgatgaatgaatgatggaaatggtgactccttgccatagttaagctgttgtccttaacatttcttttaggtagcacagtatayaagcttacattaaaatattcacggccaggtgcggtggctcacacctgtaatcccagcmctttgggaggccgaggcaggcggatcacaaggtcaggagttcgagaccagcctggccaacatggtgaaaccccctctctactaaaaatacaaaaattagcagggagtggtggcaggcmcctgtaatcctagttactcgggaggctgaggcaggagaattgcttgaatctgggaggcagaggttgcagtgagccgagattgcgccactggactccagcctgggtgacagagtgagacyccatctcaaaaaaaaaaaaaatcmcaaacattaaaaacataagatggtgatctatttcaagtactttgttaatttttttttttttttttttacctattctaagtttccttctggaggaatatggccaaatgaaactttccttgtcttttttttttttttttttccagagacagggtcttgctctgcggcccaggctggagtgcaatggcgtgattacagctctctgcagcctggacctcccaggctcaggtgatcctttcatttcagcctcctgagtagctggggctataggcatacaccaccacgctcgctaattttttatcttcattttttgcagagacagagtctccctatgttgcccaggcttgtcgcaaactcctgggctcaaacgatcttctggcctcagcctcccggtgtcaggattactggcataagccatggcacttggcctccttctctttctacatgagtgtatgaaaaacactcaacctgtgggacatctcttctatgttgctgtgatcttataagagatgttaaataaagggacttctaactagttatgagaagtcttattgaactgaaaggatggggaaatgctttcaaacagttaccaaattcctcacctgagtaatgggcatattttaacaccttaagaaaaaccccgtaagtttcttagttgattattctgtgctaaactgttagatttttttttctcttaaggtcaatgttcattattttagtaccaccagctaagatgacagtttgtcccataggctgtcaaggacattgacaagtaacaaggatattgcttttcttgaaagattctggagagcttttcacccccactcacctgacagcacagaatgtcaatccactggcagggagtctccgagtggcagacggaaggtttcctgctcctgccagaaaccaaataccagagtgaagtcctctctgaattccacacccaccctgttcattcattttcagagcctgtttttcctttgacaacatttctcagagagaactgtgacaagtgtacaaatgaactgtctatctctatttcgcagtacagcaatatgtctactctctgaaatcttcaaacatagcagattctagtccattttcttgatgtattcattagtagctacactggaggttactgaatccaattttcattagtgaatgtccccaaagatgacatgtgcctctctttgcaaaattgcctggttttcataaacttgactacgaagttactttaaacggaatcatgcttttcttattaacatcatcttatagggatttcatgctcataaaaaaaagggtctcaacaggtaagttaaaacactcaagaggatgtagaaaattaagaaaaacttttaaaggaaaaagggaacatcagtaataaaaattttagcacatttcagctaacactgacaccaaattcagcttttgctttggactaaaataatgttatttgaatatcagaggcctagttagtaggcaaccctttaaaaatctcaggtctatttgcctttagcygtttgctgaaaaggagtttttgtttgtttgtttgttttgttttggctgtttgttcatcaatttggtttattttgttaaagatttctttccatactatacaccctgcaactttcagatatttcagaatacctgatagataaaatgttcaaccgctatcttttctgagttttatgccattgttggtgagtctgggactgaatcttttttttttttaatcttttttttttgagacagggtctcattctgtcacccaggctggagtgcagtggtgccagtatggctcactgtagtcttgaccttccatgctcaggcaatcctcccgtctcagcctcccaaatagctgggactacaggcgcatcccaccaggcctggctatttttgtgtatctttttcagtagagatgaagttttgccatgttgcccaggctggccttgaactcctgggctcaagagatccacctgcttcascttcccaaagtggtatrattacaggcatgagccattgcgcctggcctctatgcatatgttgagaagccccagtctgagctcagagatgacctctggttaaaatgagggacttggtttatatctttttttttttttgagatggagtcttgctctgtcacccaggctagagtacagtggcacaatctcggcttattgcaacctctgcttcctgggtttgagagattcttctgcctcagcctccccaagtagctgggattacaggtgcccaccaccacacccggctaatttttgtatttttagtagagatagggtttcmccatgttggccaggctggtctcgaactcctgacctcaaatgatctgcccacctcagccttccagtgctgggattacaggcgtgagccactgcgcctggccagggcttggtttttatctaactctgtagaagatgccccaggaagagcagagaactctataaaagacaaacttgggtttggattctggctcttctggtaatatatcttaactttatgggcaccaattttgtcatctctaaaatagggataatgcttcagagttgtgtagtatgaagtcgaaaaatattgaggccgggtgtggtggtacacactcctctagtcccagtgactcaggaggctgaggaaggaggattggttgagcccaggagtttgaggctgcaatgagctatgattgcaccactatgttctaacctgggtgacagagmgagacyctgtctcwaaaaaagcaaaactgaaaaaacctacaaaaatatttaatatgtacagtttctgatagacactaactctcttttccaatttcmtaagaaacaatgctcagtacttgtggtggttgcmtaaagttgtagaggtgaaaactttgttttcatttccatttaggtcttttttttttttcaaaaatttttttaaatagagacagtctcactatgttgcctaggctggtctcaaactcctgggctcaagtgatcctcccaccctggtctctcaaagtgttgggattacaggcatgaaccactgtgcctggctgactcttgtttttataaacattatatgtcaagatttacacttgcaatgaatctcattatcccactgtatttcttttcttgtggtgatccccaaaacaacaacaaaatcctgcccagtctctacatatttttgaccaaatatatatatatttttgagacggagtctcactctgtcgcctaggctggagtgcagtggcatgatcttggctcactgcaagctgcgcctcctgggttcacgccattctcctgcctcagcctcctgagtagctgggactacaggtgtccgccaccacacccggctaattttttgtatttttagaagagacggggtttcaccgtgttagccaagatggtcttgatctcctgacctcatgatcctcccgcctcagcctcccaaagtgttaggattacaggcatgagccaccgcacccggccatttttgaccaaatattataggcgctttaagatatactacaaacactaagcaatttgctgtgttttttcaaatgttactttttctgattgaactcacttcnnnnnnnnnnnnnnnnnnnntattaaacgctgctgtaggtactacaaacctagtaatttgctgagctttttaaatgttactttttccctacataaaatgttgaaattcatcaaaattcggccagatgtggtggctcacgcctgtaatcccagcactttgggagggtgaggtgggcggatcacgaggtcaggagatggagacgattctggctaacacggtgaaaccccatctctactaaaaataccaaaaaaattagccgggcgtggtggcggcatgcgcytgtaatcccacctactcaggaggctcaggcaggagaatggcctgaacccgggaggyggagcttgcagtgagccaagatcgcgccattgcactccagcctgggtgacagagcaagactctgtctcaaaaaaaagagaaattcatcaaaattctaacacttaaaatgcttccatgactatcattgtatcccaactttgtttttggtctggatagaagccacagtgatgactcagttcattccatgcgccttgaatctattttgctaaaatagacaacagctgagccatatttatgtcctaatctaatgaaccaacagtgcaaaaaataacgctttaaatctgcttccttttttgagaaagaaattcacttaaaatacaatttccttttatattcctccaaagcctgagctgkatgattttttgtgtgtgcttcctaaaaaactttatctctagaggtaaatgctgagttttgaaaaagtttagagcttttgctaaatagactgaagacttgctttcaaatctagagtttgatgatttaaacaaggttcaccaggcgtggtggctcacacctgtaatcctagcactttgggaggctgagaaaagagaatcacttgagcccaggaattcgagaccagcctggagaacatagtaacaccctgtatctacaaaaaaataaacaaaattagccaggtgtgatggcacatgaggttggaggatcacttgagcctaggaggtcaaggctgcagtgagccatgatcattccactgaactccagcttgggcgatagagtgagaccctgtctcaaaaacaaaacaaaagacaaggttaactttttcatcatctgtaaagtggagatgacttcaatgtcacattcctgggtttatgtttgcataactgaagagctaagagcagaaaggagctcttcaagtttggaaggaacggaggatgagaattccttcttaagctggtgcggaatactgatctgctcccagataataccctggaggtggcagtgtttccagtggggacggtcgtggttagctgtgcactgtgctcggagtgctatgttgtggaactgcagggaggccccagacttacagatcctttatcctctacccgacaggtgtagctggtggggatggactgagtcgggggaggaggctcctgaagagcagctaattcttgccttttgcttgattgtggtctaaggacatggaaggacagtgatctgatgatggaacaccgcataaggtatttgttggtgcattttttycttaatactaggtgttttgagataatgccacttgctccrtctcttaatattctccgtgtggattggacatgttgcctgactgttaatgacagccattgggcctcatttcttgattgggtgaagctaaattatcaaaggtcccaagcatgaagattttggtctgtttctacttctctgtcttcccagtccaatgaaggtggccactagggttatgtgtcggctctgcagtaccaagcttgccctcacgtgaggtgttctgaggataggaatagtaaactggaggatagggagttagcaccatcattgggtctttcatacagagcttcatctttcaaattaccctttattagtaataaaagcaatatttgaacctccatttcccttattcctttggattatttttcttttcttttttttctttttttctttgcagttgcaaaatttaatagagtgaaaacagagctcccataaaatgggaggggacccaaaggaggttgccgctccctgcttgaatgtctgggtttatatcccgatcattgtccctccccctgtgctctcaggcgatatatgatttggccatttcctttggattgtttttcaatgggccctgaacccaggtgggaagagaggcactattttttcttttttttttttttctgatacggagtctcgctctgtcacccaggctggagtgcagtggtgctattctggctcactgcaagctccgcctcccgggctcatgtgagaggcactacttataggcccctctcaaagacttgactaagagccaccaggtggaagagtcaacactaccaaaataccacaacctttacacaaaggaggaagagtgaaatgaatattgaacatagttgttaactgacataacatcatttgaacttacctaaatgttaggtttttttrttattattattttattttttatttttatttttttgagatggagtctcgctgtgtcacccaggctggagtgcagtggcgtcatctcrgctcactggaagctcggcctcctgcgttcacgccattctgcctcagcctcccgagtagctgggactacaggcacctgtcaccatgtccggctaattttttgtatttttagtagagacggrgtttcaccgtgttagccaggatggtctcgatctcctgacctcgtgatctgcccacctcggcctcccaaagtgctgggattacaggtgtragccaccgcgcccggcacctatttttattttttttgagacagagtctcgatctgtcacccaggctggagtgcagtggcgtgatcttggctcactgcaatctccgcctcccaggttcaagcgattctcctgcttcagcctcccgagtagctgggactacaggtgtgtgccaccatacccagctaatttttgtatttttagtagagacagggcttcactacgttggccaggctggtctcgaactcctgacctcaggtgatctgcatgcctcggcctcccaaagtgctgggattacaggcatgagccaccgtgcccggtcaggttatttttttgatcgataacgcatattgcctttagttagaagtgggtcacagttagctactccccacccctgagtacccggttataatgaaagcaaggtttcgacaaaattaggccacccatatatatttgtatagagcatgcgcttatcagcaagcaagcacacaaccgttcgtacaacctgctcatttttttttttttttttgagatggagtctttctctgtcacccaagctgtagtacagtggtgcgatcttggctcactgcaacctctgcctcctgggttcaggtgattctcctgcctcagcatcctgtgtagctgggattaaaggcgtctgccaccatgcccagctaatttttgtatttttagtagagacgaggtttcaccacgttggtcaggctgatctcgaaatctcgacctcaggtgatccaccctcctcagcctcctgagtgctgggattacaggcgtgagccatcgcgcccagcctttttttttttttttgagatgaagtttcgctctgttgccaggctggagtgcagtggagcaatctcagctcactgtaacctctggctcccgtgttcaagcaattttcctgcctcagcctcccaagtagctgggactacaggcgcctaccaccatgctcggctaatttttgtatttttagtagagatgggatttcaccatattggccaggctggtcttgaactcctgaccttgtgatctgcctgacttggcctcccaaagtgctgtgattacaggtgtgagccaccacgtctggcctaccactaccaattttaacactggaaactcatttctaacataatgatgctaactttattttattttattttattgagacagggcctttctctgtcgccccggctggagtgcagtggcatgatcacagctcatgcagcctcaacgctctaggcttaagcaatcttcccatctcagcttcctgagtagctgggactacaggcatgcaccaccatttctggctaattttttaattttttgtagagacagggtctccctgtgttgcccaggctagtcatgaacacctgggctcagtgatccctcttctcagcctccaaaagtgctgggattacaggtgtgagccactgctgcgggcccatgctaactttaaaagtctcaggtgctcattaaagagaaagcacttgtagcagctgccccaagactgggctttctgattagcatgctgggtggcttcctgacggtagaggggaatccctaagaaggacatttgacccacccacacccgcatattgcaaaacacacagcttctgaaatggtaaatggctggctcaatatctttgcagtcccagttataaaggctcatcaccttttccatgccagtatatagaggagaaacacaataacaagtttcttatttccgtacgtatttgaactccaatgtgaagaaggtgtaacatttataaaacaactacatattttctattcatgatttgatcatctattttgttactctttttgccttccctttcaatgtttgaacatattccttattataagttcagttgaatgattcgggattgacctatttcccctctcctgctcccatcttttgtaatttttcctaaggccaactggtggccatagttcaatttcccactgtaggctaggttgactcttatcattactataagatgatccaccttattactataaggtgatctgcctgctttggcctcccaaagtgttgggattataggcgtgagccactgagcccagtcaggttatttttttgatcgataatgcatattgcctttagttagaagtaggtcacagttggctayagttagttactataactgtcattccacaggatcctcctaactcaacttattctgtgtcctgttttttcaaaaaaatcacagaattttgcacaggctttgaacatgttaacccatgtcttcaaaaatgaatgaatctacaagaacccaagccatgcactggcgagctcaatgaagacatacgaaaatcattccctttggtctcaaacatgttccattagagattgtttgcacctggccgggcgctgtggctcacacctgtaatcccagcactttgggaggccaaggtgggcggatcatctgaggtcaggagttcgagatcagcctgacsaacatggtgaaaccccatctctactaaagatacaaaattagccaggtgtggtggtgcatgcctgtaatcccagctacttgggaagctgaggaaggagaaatgcttgaatccaggaggtggaggttgtagtgcrccgagaccatgccattgcactccagcctgggcaagaagagtgagactccccctaaaaaaaaaaaaarragagagagagagattgtttgcayctacaatgttcattttcagcctccatccagaagagccaagtatggtttggacctaatattatgaagtaaatagctttaaacatggtttggtggattaataatggagccatcactcggcatccattgtcctaggctgtatatatatttggaaaggttgctaagagagcattctctttagggcaaaaggtcaaagtaagtgtagcttgacaccgacaccttcctggtgacccgagtttcttctgcccacctygttttctgtgaggagtccttctgagctcatacgcctggtcttatggaaggaagtggctttgagtgcacctctacctgtctatactcagccagagctgaagggtggaacaggtatatcacggagaatattttccacgtaacaagatgggtaataaatgcatcagtcttgccttagccacatgcgagatggagccagcctcactcacttatctcatcagaatttggcccatcacattcatgtaaacaattaagaggggccaggatttcttcagttttgtcttgggggtgagtaatagaatctctggtcctgaggtgaaaaagtgatttttaaaaattagttggttatgtygtgatatgagttatcccccagcccaccctgtccacattgctcaaccagatttcttcccttggggccctgcatgttcagcttcacgatatcctcccatagtctggaaagcccgtccctcatgcccttggtatttcatgttttgtgtagcaattgcttcagttgtccattccaatttttcagttgtactaaatgcttcaggagtgatgtttagaaacatgaaaaaaaaatcaccaactctgttttttttttcacgtggctcatttgcatcgcgtatgccttaaaatgcattcattagcttgttgctttataagttggaggtccattttggaggcaatccagggtttctagtctttttatgcttttgtgctcttgatgtgactgagggcagacaaggcttaaaccagaatcattgtcaaaaccaattaagaaaagcctccaaagtctcccaatgcaatggaaaaagccagatggaactgacatgccagttatgccccaggctataccctcacaggatgtggccactgaccaaagggaattgttcctgttgtgtcttaattgagctcacagtgcatggcttggctcctgcagatctgctcattctgaggacctgggctgccaccttcaaagtctgcacagtttattgttccagccaccagcactctctctttgggctgtgactggtcgacagcgacgtgaccaaaccattcttgaatcatgctagcaggcctttatgtgagcagtgtgagcagggcctacctgaaagagctgatagagctgttgatggcactaaatgagacaatgtgtatatagttcttagcacagagcctggaacaccagagttgttcagtaagtgatctgtgattatctnagaacacacatccccacttcacaacttggttccaatatcacctgttctgtgaaacctcactgacaacactcactagcagaggtaatgaaaaatcataggagttgcttcaacttttcaccttacaaagatctttcacctccgtcatctcacttgatttctgtgactgccctgtgmagttagtattattattattctcatgtgacagatggtgaaaccgaagcccagtggggttaagtgactttaccatggccacatgggacatgaatctaagtcttgtgactactagtccactgttttatccattatagcattttggtagagaacgtgacttataattygtagacactcagtgaggataggaggaagtagtagaaagtggagtgagagaggaatacctggcctaggaaagacagttcagagttgacaaacatcgtttatcagctgtaaggcctcacgtaaggtgtataacttctctgtgccttcatttcctcaccataaaatgggaataataataataatattttattattacccttagtatcctggggcctggggtgttgtaaggggtaagtttatctatctatctatctatctatctatctatctatctatctathtatccaaatcatgtttgtgtgtgtgtgtgtgtttttttttgagacagggtcttgctctgtcatccaggctggagtgcagtcacacaatctcagctcactgcagtctcaacctcctgggctcaaatgattctcccacctcagcctcccaaatagctgggattacaggtgcgtgccaccatgtctgggtaatttttaaatttttctacaaatggagtttctgctatgttgctcaggctggtcttgaacttctgggctcaaatgatcctcctgcctcagcctcccaaagtgctgagattacaggtgttagccaccatgccctgctgttattttttttttaagttagagaaaagcacaatggaatcaaccttcaagtttgtttaccaaattaaaaccaagagtttgtaactgtgttctcctcagtcacccagaaactctagtagcacattaaagaagttgtatataaggcttgtgtcgctctgtccagcatgtgatcatgggctgcccacagtatattttggtactcagtatcctcatgaaaataggctgagatacccagggtccttattaggagaaatcagaatactattatggcatgtgctttgtacttattaaattttttttaaaaagaacaggctgggtgcagtggctcaagcctgtaaccctagcactttgggaggccaaggcaggaagattgcttgatcccaggagtttgagaccagcctgggcaatatagtgagacctcgtcactacaaaaaataaaaaattagctgggcatggtggctcacacctgtagccccagctacttgggaggctgaggtgggaaaattgcttgagcctgggaagttgaggctgcaatgtgttgtaatcgcaccactgcactccagcctgggtgacagagcaagactctgactcaaaaacaaacaaataaataaaataaaataaaatataaataaaaagaacagaaaaagcaaaaatgtcaaaaaagagaactaagaagttgagctgggtgtgcaaaacagtgccaaaccatctaacttccctccaccagcaatgagagaaagcgttttaaactgaaatgatttagtagctatactgattggtttgacttggtttrataaaaatgatctgtgcaagctggttccatgcccatagcatcagctggggttccatggcaacaaaaataattactcatctgcaaacagtctttgtaacagctaagggtttgattagcatcttaaaattactttgtgattcaaggaattttatttcccacttaaagaacaaaacaatgatgatttttttctggaattggtcatgttttaaaagaacaagaggagacagattatgggtatgttcttctataaactgtgtttagattttakaactgtgcatccattctcagctaatcagatgacagctcactctgcaggactcacatgctggtctgatcgtttacgtgttcttggtcaccctttttctgtttctgcctgtgaatcttacctctttcaagcccctgtactccgactccctctcagcagatgactggagacagaaaataagagtccatcatcttatttaaatagattaaaggaaacacaaagaccgcaatggaaaaattgcaaaagatggaaagrgaagaaatagaaataataaataaataaatgtagtggtttgagtcasaaggttcgatctcattagttaccaataaaatgtacattggaaggacaataagatgatactccttttttacctgtcaaattggcaaagagtcttttttttttttctccatctgtcgcccaggctggagtgcagtggcgcgatctcggctcactgcaagctccgcctcctgggttgacgccattctcccgcctcagcctcccgagtagctgggactacgggcgcccgccacctcggctggctaatttttttgtatttttagtagagacggggtttcaccgtgttagccaggatggtctcgatctcctgacctcgtgatctgcccgcgtcggccttccaaaatgctgttactacaggcgtgagccaccgcacccggcccaaattggcaaagagttttaaaagtaatagcattcagcattgataaaggcatgggaaagstggagctcttttccactccaackgatacataaactagttcacagccttcaaaacattcacactcttggacctagtactaactctacttggagtgagttagttatacaaggttaaactccaataataggagaatgattacaacgacttctttgtaattattttaaaatttcttttaagcgcttaaccacaagctagccacacatctgaggtccttacatgtattttgtcatttaatcctcatcagaactctgtgaagcaaatactgtatttcctttttatggaggaggaaactgaggtacagaaaaaatggagggacagtggctctaatgccagaggcaggctctgaaccagtatgcttaactgcctagtttcagaagaggcttaaggcagcaggcggagctgtataaaatacaagataatctcaagtattcygtaggagagagaaaaacaatggcaaagacagacataaaacagagccaggaatgaggccaaaaatatatatcatttgacctatacacttgctaagaggaccacaaatttggctagaagctttctagcagcctgtggataaaaggaaatctgatcagtcatacaatttacagtatccataagataaaagcaggccaattactcagaagaagccaacgattctaggtagtaagaccagacatagatttattctgcrgaacacaaaatgttcttgtaaaaagagacacygtgtgagctaatggataatgagctcaacagcatccttgtttagacaagrtgaccactgatatggtttggctgtgtccccacccaaatctcatattgaattgtagtttccataatccccacgtgtcatgggagggacccggtgggaggtaactgaatcaagggggcagttacctccatgstgttctcgcgatagtgagttctcatgagatttgatagttttataagaggctttcggctttctcccttttgctstgcacttatccttgctgccaccatgtgaagaaggacatatattgtaagtttcctgaggcctccccagccatgctgaactgtgagtcagttaaacccctttccttgataaattacccaatctcaggtatgtctttattagcagtgtgagcacagacgaatacaatcacttccastgggttgagtcttctagcttttctcttakggcttatggcccaacatcaaaacatggtaacaagcaacaaggatgtggctcaggcacccasgtccctactgcttgggggatcgtagggtacctgagagtgagtggactgatagcctttgatagatgctgtgagaaatgagagactgagattgtgcttttcaacaaatatgtagaattcatcttttmtattttgtaagcccccccaccttttttttttgagacaggatgttgctctcakgctggagtgtggtgatgttatcttggctcactgtagcctccatcttgccaggcttakgtggkcctcctacctcagcctcctggatagctgagactacaggcatgttccatcacacctggctaattttgtattttttgtggagatggggttttgccatgttgcctcagctggtctcgaactcctgggctcaagccatctgcctgccttggcctcccaaagtactgcgtgtgagccactgtgcccagcctattttgtcagtcttttatgcattaaagaccattatactagagacaggaaaggtgaaaaatattgtaatatgaaatgatcaattatataggtgttamacatgatgtttaggatgtcttttggtaatatgaaaatgttctcaaactatagtattaaataaagcaggatacaaaactgtatgtaatatgtaatctcmacaatgtttmacatatatatggagctgcagtgagctgagatcgtgccactgcactccagcctgggcgacagcaagactgtctcaaaaaaaatttatatatatggagcaaggtctgaatctttagtttttcttgctatagaaattttttttcttttatttactgaatagaaagatgaaagmcaatttctggatgggttggaatatcttagaaagaggcatcagttttcaggtactaattgcttgggttctaggtatgmccgmccatcaaaccaaggggaaagaagaagaamacagttttgatttgatttgattaggaagcaggcatgtatatgatgaggcataaagmccatgtgggggaaaaaactggggagaaacgtagcaatgtgaaggatttccagaggggcctttagaaacctaaaaagctaatctctgaagttgtccatgagagagagagcccagagctaggagatttctgtccccaggagaggtttgggagctgactcctcattccctgtcagacaggccttcacctgaatggcaacctgcccattaccaccaccccagggtctaccccaatctcttctcacagagatatggagagggccttgctccttcctgaacttgcattaaactgacaattgcctcaccacaagactctgttgggttcatcattcattaccctgtatgagcatcctctgtaaccatgccctaggacatcagtatgacaaaatagggccggtaaggggaagctctttatatttaaggggaagaggctaaactaacaagcttgagattattttaatagcatgcacacacacacacacacacatatacacaaaatactgcaagaactacaccttcttcaagaatctcaccttacccttttccctactgctccttaaatatgggtattgcctcaaattccttctcagtcctttcttttcattctagattctctccttgggctatttcaacttccatacaaattccgatatgcattaaatctcaaatctccgttatgagtctccttaaattacagtctaaggacatccagaacagagtttccacaccaaaggcacatctagtttctcatccacaagctttttatctttgtctttgtgtttgttttttatwccggaacttcttgacaaatattattccatcatcagaaggaaggtcctgggaaaaagaaagacatgagcacttgtgctaggtattttacaggcatatcttcatttaatccttataacctctctatgaagtaggcataattgttccttattagcaaatgaggaaaccaagactttgagcagataatttgtataagatcaaatagcttggaagagtaggatgactaagttttaaagtcaggtctgtctattcttctaagaaaagaagactgatgctttcctgttagggaaccaacttcttattcccaggctgtggaatactgtgctaaccaggaaatagccaattcttccttcagggcatgttatgagatacatgaattgttttctaagtcacaatagccttttttttycttttctttttttttgcttgctttcttttctttttctttttttctttttcttttttttttttttgagatgaagtcttgctctgtcacccaggctggagtgcagtggctcgatcttggctcactgcaatctctacctcccaggttcaagcgattctcctgcctcagcctcccgagtagctgggactacaggcacacactaccatgcccagctaatttttgtatttttagtagagatggggtttcaccatgttggccaggctggtctcaaactcctgacctcaggtgatctgcactcctcagcctcccaaagtgctgggattacaggtgtgagccactgcgcctgccctttctttctttctttctttttttttttttttttttttttgagatggagtttcgctctgtcacccaggctagaatccaaggtgtgagctcagctcactgcaacctccacctcctgggttcaagcgattctcctgcctcagctcccgagtagctgggattacagatgtgcaccagcaggcccagctaatttttgtatttttagtagagacggggtttcaccatgttggccaggctagtctcaaactgctgacctcaagtgatctgcccattttggcctcccaaagtgctgggattacaggcgtgagccactgtgcccagccacaatagcctttttacctaagttttactttagaatcctgagtaaaagctgtgaccttctagcttcatctactctctgacattccctgaaacctcagcctgtgtggcaagttctattacaggattcacatttcctgatttcaaaattactacacagcaatggtaaacaagacattgtggtaacmccataaatagtgtgatggtttgaatgtctgtgtcccttccagaattcatgttggaagttattccccaatgcaacagtttaagaggtgagacctttagggggtgattcaggcatgcgggttctgccctcacggatgggattagygctttataaaagggacatggggaactagcctaggccytttttttttttttttttttttttcgcttctgctcttccaccatggaaracacagmaggaaggtaccmccttggaagcagagagcagccctcgccaracaccaactctgctggcaccttgatcttgtacttcccagcctctagaactgagcaraaatacatttctgctctttaattacccagtctcatgcattttcttatagacgtctgaatggactaagatcgatggacatatagaccaatggaatagatttgagagtctagaaataaacccatatgtctatggtcaagtgacttttgacaagggtatcaaaaccattcagtggggaaagaatagcctttcgacaaatgatgctgggacaacaggatagccacctgcaaaggatgacattgaaccctcacctcacacaatttaaagaaattaattcaaaatgaaccagaaacctaaatgtaagagctgaaactaaaaaatttaaaaaataaaacaggtctaaatcttctcaacctcagagttggcaatgatacgacactaaaagcacaaacaaaagaaaaaataaattggacttcatcaaaattaaaaactttcattttttaaaggaccactttatttatttacttattattttgagacagaatctcaccctgtcacccaggctggagtgcagtggtgwgacctccgctccaggttcaagcgattctcctgcctcagcctcccaagtagctgggattacaggcatgcaccatcacatccggcttatttttttatttttgtagagacagggtttcatcatgttggccaggctcatctccaactcctggcctcaagtgatccrcccacctcagcctcccaaagttctgggattacaggcatgagccactgcgcccggctaaaggaccatttaaaaatgtaaaaggacaatcccctggatgagagaaaatcattccaaatcaaatatctgataaggggcttgtatmtagagtatacaragaacccatacattcagtaataaaatgataactaactcaaacaatagacaaaggatctggacaggcattttgccaacaaagataaacaaatggccaagaaacacataaaaaagtgctcaacataattagccatcatagaattgcaaatcaaaatcgcaacaaaatatgctactttacatctactagggtggctggactcaaaaattcagatgataccatggttgtcaaggatacggagaaatcagaccccttgtacactggtgttgggaatgtaaaatggttcagccactttggagaacaatccagaagtccttccaaacatgaaactttgagttaacacatgacttagcaattccacttccaggtatgcccaaaagaaatgaaaacatacgtccacaacgaaagttgtacacgatgtttataacatattattcataatagccaaaaggtggaaataacccgagtgcccataaactgatgatggatgcaaaggtggtatatctaacaatgcaatattattcagccataaaaagtaagcagtggccgggcacggtggctcacgcctgtaatcccagcactttgggaagctgaggtgggtggatcaccctatgtcaggagttcgaggccagcctgaccaccatggagaaactccatctctactaaaaatacaaaaaattagccgggctttggccgggtgtggtggctcatgcctgtaatcccagcactttgggaggccgaggcggctggatcacgaggtcaagagatcgagaccatcctggctaacagggtgaaaccccatctctactaaaaatacaaaaaaaactagccaggcatggtggcgggcgcacacctgtagtcccagctactcgggaggctgaggcaggagaatggcgtgaacctgggaggcggagcttgcggtgagccgagatcgcaccactgcactccagcctgggcgacagagcgagactccgtctcaaaaaacaaacaaacaaacaaacaaacaaacaaacaaaaaattagtcgggcgtggtggcgcatgcctgtaatcccagctattcaggaggctgaggtaggagaattgcttgaacctgggaggcggaggttgcggtgagccgagatcatgccattgcactccatccagcctgggcaacaatagcgaaactccgtctcaaaaaaaaaaaaaaaaaaaaaaggaaagtagtatgatatatgctacaacatagatatattttgaaaacattatgttaagaaagaagccagtcacaaaagactacatattatgtgattttatttatatgaaatatcaagattagggaaagctatagagacaaaaaatagtttagtagttccttaggactggggtaatggggtggaggatggggatgggataggaggatgacagctaaagggtactgtggggaaaagcaagagagatcagattgttactgtgtctgtgtagaaagaagtagacataggagactccattttgttatgtactaagaaaaattcttctgccttgagattctgttaatctatgaccttacccccaaccccgtgctctctgaaacatgtgctgtgtcaactcagagttgaatggattaagggcggtgcaagatgtgctttgttaaacagatgcttgagggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcagagcacttaatcctttacattgtctatgatgcaaagacctttgttcacgtgtttgtctgctgaccctctccccacaattgtcttgtgaccctgacacatccccctctttgagaaacacccacagatgatcaataaatactaagrgaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacagggtacaggtgattaaagtggacaagggcagccactgagagagctggtatccaagcagcttggagatgaagtcstggccccagaaggcactggtgtgraagccacayatctcccttgaragtgcatctggaggtctcastatgtgaagtgctcttraagggaagatttcccaccggccattcacagcagagcaccccagtgccccacagatacaccctctcaktgtgtgttatccctgccatcatttctgggsacatggagttgtmtgattaggctgtctccacatcttaaattttttgagatggagtctcgctctgttgcccaggctggagtgcagtgccacgatcttggctcactgcaaccaccacctcccaggttcaagcaattctcctgcctcagcctcccragtagctgggactacaggtgtgcgtcatcacacctggctaatttttgtatttttagtagagacagggtttcgccrtgttggccaagctcatctcaaactcttgacctcagatgatctgcctgccttggcctcccaaagttctggaattgcaggcatgagccactgcgcccagcacacatcttaaatttctattcatgctgtaatccactacaacctggtatctgccttctctgttccacacaaatgaatcttatcaagagcacccacctccatgttgccaaatccagtgacattttgtgtccttatagtacttggctgtgacctcttgttggcactgacttggtccttattccctcgctcctcatacacacttctcttttgttacctttcaaatgtttctctcctgattttccccccacccagtccctctcaactctctttgctggcttttcctttccaactcaacctttaatagggatacttcagggctagatcctagacccctttctcttctttatttacatctttccctagataatcccatctgttttccatgggtttcaatgccctctaacgctagtgattttcaaagcaaagtcatcatacctcctaagaagtctcttcttaatttttgtcttacatcaaattattgacttaatatttctattcaaatatctcaaaagtggctgggcacggtggctcatgcttgtaatcccagcactttgggaggccaaggcaggcggatcacctgaggtcaggagttcaagaccagcctggccaacatggcaaaaccacgtctctattaagaatacaaaaattagctgggtgtggtggcacatgcctgtagtcccagctacttgggaggctgaggcaggagaatcgcttgaacccgggaggcaaaggctgtagtgagccgagatcacgccactgcactccagcctgggcaacagagggagactccatctcaaaaaaacaaaacaaaaaccccacaaatgtttcaaaagtgtcttaagcctaatatgttcaaaatagaactcttgatttcttaaaactgttccatctaactaaatggcggcccgtcttcccaagtcagaaaattagaatttatttatgattccttttttctccctatcccacattcagtcttcaaaaaggtcttaagaattctactctcccattccactccttcctcaatataaatccatgtacttcttttcccagctgctatcayctcagtctaggccatgattttctttttcctggacaactgcaacarcttcctaactagggaccctacttctatcttttgatatcttccaacttttttgtgtgtgcagtagaaaaattttaattaaaaaaattttttttgtagggacggggtttcaccatgttgtccaggttggtcttgaactcctggaatcaagcaatcagcctgcctcagcctcccacagtgctctgggattacaggcgtgagccactgcatccagctgacattcttaaaatacaaatagaactatttcatttcctgactaaagaatcatcaaaggcctcccctgagaataaaacccaaattcttcattctgacttgcaaggcaagtataattcccgcctatctctctgatgttgcctgacttcttgatatagtcttaggccatttcccttgagcttcttaatcctcagcctctttcattttttttttttttttatttgtttttgagacagggtcttgctctgtcacccaggctggagtgcagtggcacgatcatggctcactgtagccttcactgccaggctcatgggatcgtcccacctcagcctcccaagtagctgggactacaggtatgcaccaccatgctcgttcgattaaaattttttttttttttagtagaaatggggtcttggtatgttgcccaggctggtctcgaactcctgagctcacataatcctcctaccttggcctcccagagtgctgagattacaggcatgagccactgcacccagcagcctctcagatttttattctttgcactcaacaagctcttttctgcctttggcttttacacattatttcctttccctgaaaagcttctcccccacattttgtatatccgactcctttttgttcctcatagataataaaatgaatatcacttcttcagagagatctcyactgattatctttttttcttctttctacctaaattttatccttgtttttcttttaaaacttttaaaaagcacatataaaatgcttatgtgtgtgatactattctattcacaacaatctcataattagattatattattatctcctttttagatatgacacaactgagaaacacacagctagtaagtggcaaagttggatatgacccaagtagactagcttgtgctttttttttttgctttttttcttttcttttttttgagacggagtctcactctgtcacttgggctagagtgcagtggcggatctctgctcactccaacctccaactcccgaattcaagtgattctcctgcctcagcctcccgagtagctgggattacaggcgcccaccaccacacccagctaatttttgtatttttagtagagatggggtttcaccatgttggtygggctggtctcgaactcctgacctcagatgatccgcccacctcggcctcccaaagtactgggactacaggtgtaagccaccgagcctggcctttttttcttttcttttggtgagtcttgctttgtcaccaggctagagcacagtggcacaatcagtacattgcagccttaatctcttgggttcaagccatcatactgcctcagcctcctaagtattggggaccacaggcatgtattaccatgcccagctagtattttttaattttttgtagccatgaggtctcgctatgttgcccaggctggtcttgaactgctggcctcaagtgacccttctgcctcagcctcccaaagtgctaggattaccagtatgagccaccacacccagcctaggaatgctttaagaaattattttctatatacctgtcattgatatatatgcaatacatatggcatatacgaaaaaagagggaactgtaactatgcagtactggaacagcatggtgtataggaaaataaatttggctgggcatggtggctcacatctgtaatcccagaactttgggaggccagggtgggaggatcacttgatcccaggagtttgagaccagcctgggcaacatagacagaccctgtctctacaaaaatttaaaaaattagctgagtgtggtggtattcatctgtagttccagctactcaggaggctgaggtgggaggatcgcttgagtccaggaggttgaggctgcagggagtcatgatcatgccactccactccagcctaagtgatggagaccctgtctcagaaaaaaagagaaaaaaaacaagaaaataagtttatcttctttacgttaaataccaacatttaaggatcaaagttcaactaagcaacatcttaaagtgtcagagtgtgcaagacatgcctgaaatcagacaaaagtgacaagtgacaaaagtgtatcaatcagaaaaacggggcaggatagagcataggggctggaccacaatggaaatttagcaaaaaggaaagtcacagaggcaaactctgttcttagtttgatccaaaggagagggaggcacaggcaatctagtgcgagtcttatgatccctttggaaggcctatgcttacagtttgtagagtgaggaacagccagaggcttcctgggaaggcaggttagctacctgcaattgcaggttccatctcttttcagcagttcatcatcattcatcaacgtgtcagaggtcagatgccacgggagcacacaggaggggcttcccacctggagtgcgagataaggaaagatgggtcggatgttgtagtcattatcatccgcttctctacaaggctggaatttatggtggctgcacatttggaatgttttctccttttatttatttatttttagatcagacaatcacaagagamtattcttttgttttatttttagatcagacaatcacatgagaatattctgttgtgatcgctggcgtttagaaggaaacttgtctggtttgtgaagcaatggaaaacayatccagacagcctgctagtggaaactttggaagggcactgtcatatgctttttctcccacgccatcaacaagtgtcctttttttttttttttttttgagatggagtctctgttgcctaggctggagtatagtggtgccatctgtaccctccacctcctggattcaagcaattctcctgcctcagcctcccaagtagctgggatcacaggcgtgcaccaccatacctggctaatttttgtatttttagtagagatgggatttcaccatgtgggccaggctagtcttgaactccggacctcaaatgatccatccacttctgcctcccaaagtgctgggattataggcgtgagccactgtgcccggtcaacaatcatcttttttttttttttttttttttttttaccaggtacacaatgatgggagagttgagtcctgctttctaacttaraaaacgcatgtgtgttcatcacctggtcactgaraaacagctctggaataggtgccatgcagaagaagagagggaactggaaagacccactgatctgtgggtctcacagcctcccgttacacaraaattgcttcttttctctcatgttgcgttcttcctcttgattctcgacccttctccactctttcatttactccactcttactttgctttcacctccttttgtaaccgttcatcatcactcttcatatggattaatgkgattatcttaaaagcatgtaatatgtagttgctgggtttgtatgagtaatgagtgaacctgaagccaacataatgatcccgtttagtgctcccgagttaagattccagagttgcctgactttggacaaatcacatctccctttgcctttcaccccctgtaaactgaggataatggctcttacctcaaagcattgttaggattggagagaacgcatgttacatacttagaagaatgcttggtatgggtctcaagaactcttagctcttattgtttaaaaaatgcttattacagggcatcgttggtatcttatatagggaatttcaagcagttttcctttattgaagacacagagtaaggtgctttgatggaaactattggggcaagatatacagtacctagctagaggtttcctgggtgcatgtattgtggagatattttttttctgagtggatagcgctcttgtgatacgctgggtgagggcgagcaatatttagcggactgtcctgtgaggatagtaaggtyatctggtgagagtgttaggtggcccaggccagacttgggagaggcagggagagagggggacgacggaggagggcgccttggggtgcgtcttgaaagctttgggaaacccagcggtcttttgggggcaggtggcccaaaaagccttctgcgcgcccaggggacgaggaggatgcgcggrccgcgaccgcgatagttttgtttgcttttctcgggagaaagcgttccaggcagtttcctgagcttcggccctcgacgtagcaaaagagcccgggcgcccacgccgctctcggggtcttctactgccaccgggacaaagccctgggaggagctcccgcccccgcgagccggacagggcggaggctcccccgccgcgcgcgccccaccgcttcccagtcccrgacccgtcgcctgcgcctcctcctggcgcgcctcacggtgcagcgggcggcggccccgcgcgccckgcgggaggcgcctcgggatgtttccgtctggtccttccctccgccccccgcgctgactccatccgctccccgccccctgctcggagccgccgccacgcgggaagggagggagccggccccgagactgcatcattccgcaccggctgctgcagggccagagggagcaggtggagcgagagagcgagccgcgagccrgagcgcgccagacccagggcgagactgcagtgacgcggcccgggagacatggcggacgggcgtctctgaataagcagaatccggagcccctcsctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcycccaccccgtaaccccctcctgcctccatccaccggggctatggccgcagaagaggtattgcagacggtggaccattataagactgagatagagaggctaaccaaggagctcacggagaccacccacgagaagatccaggctgccgagtacggrctggtggtgctggaggagaagctgaccctcaaacagcagtatgatgaactggaggctgagtacgacagcctcaaacaggagctggagcagctcaaagaggtgagttgcctgtcacctctccctttcctggccctcactccccccacccgcaaggcccactcatcatgatcaagaagtcataaaggagktgattgaaaggactgttttttcttctagggccctttgttggtaagagaagattgaaagagtccattgtttcctcccccaagagaaaaattgcctaagaaatgaatatataagctggaatttgggaggcaatggctgtttggcctgcgggggagggagattagtaagagtcatcaagtctcakcactctaagacgacattcaagtgggttggaatgtataaatcaaacttctcaaaaccgctgttatctcaaacccaggtttcagcgacaatttcgtagtccacaaaagtgatgaggtttgtgcctgaggacccacaatttcaggatttagactgtgtggcacctcagctttcctctggatgtaaccactccttggtgagagagggaactcctcaccaatcccatttgacaaaggctaggcaatcttcattctgcttggctttagtcattcttgtcattgggctgcagaagaaaaacaactttgctgggtgatcccactgccttgatttcacctcggagcgaggctgggccatgtccaagtcttatgaggtcaccctgactagaaaaaattgaactcacctacaaatagtctgaaagagtggtgtatatcaaatacgtgggtagtgttgcatttcaaatgaggctcttctggttgaaatgatayatttataaraccagaatatcamaaatgggtgatgtataatgtctctttagttttttggtatttggcctcttttaaagcctgtcggatgtatgggagaaaacaatgaacgtgctttgatttcctatcagtcactcttaagaacatacatattgtttaagtaactcggtcttttttatctgattcttgagrcactatgggtagcaartaaccacttacaaatttaaatgtaatatacactccttttctgtgtgtcaagtccttatttttaggtgcatattgacatttaaatgttaattattgtttggcatataatatcaaaaatctattatttattttatgctgttacagttaaaagatgtgatttatgacatactgaatcaacttgccttccaatttagtgtgtaatatggtaagcatttatacttttagatatgtcttatttttatttggatgcctgtctaccaaaaaataaatgtactacctatgattaaaaatcccaactaggaatctaatttttgtgtgtcaggctgtaaatttctggttcctattttacttaccatgtacctgtctggtcttaacaacagctggacttgtttatattttccaacttagattaggctgacatgtttaaatgcagtgatgctaaaccttgtgaartgaggaarcasgatgatgactgtcattctcagagatgttttgatattgtctatacctatcaacactgctttgccaagatagggaagtgcaaaccagaaastggtaagccatcaccttcttgataaaggagatggacttaatttaatgaaatgtrcctcttactgactytgctgcttgatttaaacaatccttctagggatatttctgtcattgcacttaccttgcatagcaaaccttaatgcaattgtgttttgcctttgctacaccatgagctttgcatcccaagtctttaacacaaaagmtagcacacagtgggcatgaaatattttatgaaagaatcagtttgtactagaagaaggcacacttttatcargggttcactagtcaatattgattagtgttagataaatactaagaaaattaggatgtataggaagtgacagatgttaataaaactacctgtattagtttcaccagcagtaatgagaaaaatgtgaaaaaaacgttttgtaggaataatgtaactgtggtttcttaatacagaataatgcaaataccaactaaaattttttmtataaatattttaatatatattttgttmtatatagcaggaggttaataaaaatttaccagcattatttttactaaacgattcttgttcatatatttattttcagttgcatttagcataagtgaaattcgagattcctaaaaaactggtttayacagttatataaaaatgtattttaggtaataaaattattatagttgattatttgatagtgaggcctattatttttattctttaaacatagaatatactttagttggaaatataacttaaatgagttaaattgatttcaagtaacatttcttgtatgaaaagtaaatccaaaataattgtgcaaactgaggtgttccaacacctcagttttgaaaaatattttgtgagtgttttgatttttcaaaagaaagttttgctcatcaggtatgtatagtaaatgatgttgcattatatctataaagccaagcataaaataaatctttgcttatttctaggatttttgaacaaatatgatttatttaaaaataattgaaccagtttatgggaatgtcaacagaaaactactgtattaagtccaaattggacattagtaatttgcartatagcaacatggctcagtctttgcagatcattttgttttccagagtcagtacccaccaatgttgctaccttccttcccaggctaggtactgctgtgacaataatgcaagtcggcagtgttgcctaaagatgtgcaaaatcaagaagatgaaattcattaaatttttttcctagttatttcttccctcaactcaattgttttttgacctggcctgatgttgtttagtgctctgcatggactactgtaattcagctcacagaagaacacacttgaaagaatagtactaaggatttgaaaaaaggatgacttctgacatcatcaaagtgttctccttttcatgattctttgggcagctggacagagcagtatgtccactagaatacttgagtctggttttgtgatttcacaagtaacacttgctcttcagtgacctgagtgagggtcacccatgcccagttatgttcagggcctggctgattatatgtttgggatgtacgtaaatcagcactgtgcgcctgtcacccaggccagaatagtgtttgaagaagagtcatagctccaaaataacctgaaaactaaaaatatacatatataaaaataccttggatctaaacttaagagttttttttacaccgcatgttctcactcatagatgggaattgaacaatgagaacacatggacacaggaaggggaacatcacactctggggactgttgtggggtggggggaggggggatggatagcattaggagatatacctaatgctaaatgacgagttaatgggtgcagcacaccagcatggcacatgtatacatatgtaactaatctgcacrttgtgcacatgtaccctaaaacttaaagtataataataaaaaaaaagagtttttttttaacttaaaaatggttgaaatttaaaatgttgtaaagttgaaaaagagccccttagaaaggaatgattcagcattactgatggcattttaaaaaggaaatgtatctgtgagacagctttagaaaagttttgcagcttggataccgtaaactatgcactaatgagcttcaacccattttcttgcttattttgtcaaccctgacaccaaggatagttaccagctgctgaagaagcactttctggacattgggcagctttttcttttggagccaactctattctttttcagggttatagttaaatcattcaacacaaaaatatgtacttacacagttttagagcttgtcacattggtgacctgatgaatgccacttaaattacctagattcatctttaagcagaattgttttcccttcagatgcttagaaagattgttagtttcttttatatctttaagttstaaatcacaaaatcatatggcaagaaaaaccccagatttcttttccaatctatgaataaacataaagagacagttwatacttaattgatctatctgaactatgatttttaacttctctcattgtttttatttttttattttattttattttattttgagatggagtctcgcactttcacccagcctggagtgcggtggtgtgatctcggctcactgcaagctccacctcccgggttcacgccattctcctgcctcagcctccggagtagctgagactacacgcattcaccaccacaccyggctaatttttcgtatttttagtagagatgggctttcaccttgttagccaggatggtctcgatgtttttaaagaaaaaatatttacatttattatcaaattaatcttaaaatctaaaatacattaagatatgcttttggaaactgtttacaaacaacctcaacaaataaacatcatcgctttcaatcacatttctttttttctggacccagttgctctaacttgcactatcccttttttttttttttttttttttgagatggagtttcactcttgttgcccaggctggagtgcaatggtgtgatctcggctcaccgcaaattctgcctcttgggttcaagtgattcttctgcttcagcctcccgagtagctaggattacaggcatgcgccaccacacctggccagttttgtatttttagtagagatagcgtttcttcatgttggtgaggttggtcttgaactcccgacctcaggtgatccgcctgcctcagcctcccaaagtgctgggaytacaggcgtgagcccccacgcccagccccttctttttatttgaaatcaagatttcgtctctggcgaagttatttctcagatataacttagcaagaatttatcatcttttatcacattccccatgtttatgtgaacatgtatgacagcgatggtttgaagrtttcttcagaactttctgcttgcaaatattttgccctatcatccccttaaatatagttgtactcatggatattgctttccaaatttgaaaatacggtaattaattacttgcatgttgaaatatacataaaggacttgcccacacataagattccacctgtaattayggctttgaggagaggagggcatgaagggctgcatagtcttagtattaaataattcattacgctaaaggagaatgcacgtaaagtcaagtggcaggagatgcaattgtgaaagggccatggccacattttgtcttggggatgtggagccattgaaaataaatgaaacagtcactgtgtttaatctcaccagtcttcaaaacaattcagagggcttactgctcatttttactgataagaagataataaaaataataaagcattgacttaggtacaaggctccatttagaactaggttctttacaagcctcrcctctaattcatgcagcaatccttactcaaggtaggtgtttcttgcattatacagaagaggaaactgggtcttagagaggtttaggtctcttcccagggccacaaaactaaacgatgaaacttggaagaagcccacttttttttcactgcatcatactaccttgaatatgaaatatctctgccaagtctacaagtgcagtatagaaggttatggtgatggtcatagtgggtggattgaggctgtgtggtgggacagacagtggcagtagggatcgtgaggagggggcacgtctaagagctatttgggaggtagggtggaacaggcattggatgttactatatgtggaaagtgaggaagacagtggagctgagaatcttctcaggctggataggaggtggttctrtttacaaaggaaggtattatggggcagagcagttttagagggtgaaattgatgctcaagttacatgagtttctgttgtttttgacacagggtttctctctgtcacccaggctggagtgcagtggtgctgttacagctcaccgcaaccttaactaaccatcctggctcaagtgatcctcccatctcagcctcccaaggagctgggaatacagacccatgccaccatgcctggctaatttttttttgagactgagtctccctctgtttccccagctggagtgcagtggcatgatctcagcccactgcaacctttgcctcctgggttcaagtgattctcctgcctcagcctcccaagtaactgggactacaggagcataccaccatgcttgggtaatttttttttttttttttgagctggaatctcactctatcacccaggctggagtgyagtggtctgatctcagctcactgcaacctccacctcccaggttcaagcgattctcctgcctcagcctcctgaataggtgggactacaggtgcctgccaccatgcctgaataatttttttttttccaagacagaatctcgctctgtcgcctaggctggagtgcagtggcgcaatctcggcttactgcaacctctgcctcccgggttcaagtgattctcstgcgtcagccacctgtagatgggattataggcgcgcgccaccacgcctggctagtttttgtattttttttagtagagacagggtttcaccatgttggccagagtggtcttgatcttctgacctcgtgatccacccaccttggcctccgaaagtgctgggattataggcatgagccaccgcgcccagcctaatttttgtacttttagtagagagaagatttcaaacatgttgcccaggctggtctgaaattcctgagctmgagcgatctgcctgccttgccctcgtaaagtgtggagattacaggcatgagccattgtgcccagccacataagtccttttaattcatgttttctttgctggggaagcgtacattgcatgatggattcagatmctcaactttcttttttttctttttttgagatggggtctcattttgtcacctaggctggagtacagtggtgtgatcgtggcttactgcagccttgacctcctgggctcaagcaatcctcatgcctcagcccccaagtagctgggactacaggtgcacaccgccatgcctgactaatttttgtattttttttgtagacacasggttttgccatgtaagccaggttggtctakaactcttgagctaaggacagtccgcctgtkttggcctcccaaagtgctaggattacasgctaactttcaatttaataaaaaaaattaatttgtgcaattggttgttattttatagaagcctaatttctakaatatgggatataaacaatttaataatgtkttcaccagttagtttgattgctttctaaattaggaaaaatgaaaacaaataaacgatgggcaaaaaagctgactggggacagtaaggtctaagaaggcagcctaagtggaaaattagcccttactcaccatttagggttatgggggctgggagcaacagtcctcactgctcactgactaatctttatcaatcttatttaatctttattgaagatgcattagcatttttaatttaagtgggtttttttcctcttttcttttggtggggggtgtgggcggcgggggagtttcaatatgttgaccaggctggtcttgaactcctggcctcaagcgattctccckcctcagcctcccaaagtgctgggattacaggcatgagccattgcacccagccttttctatttttcatttcaagagtttgctttttaagaattaaaattgtgtaattatgacagtttttattrcagtactccaagctagagaaaagcatatataaattaatagttttcccttcttctcccacagttctgtctctgttgttaacactttgctgagtattcttctgtacttgttttaaatgtctttaaacatataggcagggtttttgtgtgtgtggtgtttttgktttttttttttttgctgtttttcttcctttgtttttataaaaacaggatcttgcagcctggtgttttaaatttagtagtatgtcctttcaaaaggcaggtatttacgagacaaagctgcatttttaaagcactggtgaagtgtgaagaaaatgagaccgattagggaagaaaacccgagaagctcaragtttgggtgaccctggggatgtgggaaggtggtgwaaatggtaccctgagggtagcatggatggtaagtgaaagaggaaaaggtgtaggtttgcataaaaraaactgatggaatttggatgcccmatagcaracccaggggaatgataccaggggaaaagatggacagttttgtgggtaaattagcagkgattttgattccttgtcttgttagctgctgatggagatacrtgtatcagcataatacctggctagtttccatggccggcaagagccagtcctgcagtgtgaccacatcctgtccattctgggtcttggtggcaagccaggatgattcaggcagttgggctttattacgttatcccttctttgccctctgaaagctgagttttgaaatagttaggatcttatacaacatctcagattcagcatgctgtgcasgaggtggggagaaaagggtacaaaagaggaaaatgttcagtgaaggtgttattacaatggaggggawtatgaaagtggaaattgataccttttcctcttgggatttaattaagtctataaaattraggtgttgcaatacataatgtctatgatttttttttaccasctctaaatctctgagatggctgtgttttagagctgcatgtkctgcttatttactgcctgtcctttacatttcaaattcattcaatatttttccaaagtacasaatagttttgcctagttgcagtaattttcacctagacttcagggatcttccatcaactcttttatgtattttttctcctttgtttttccactctggtcactcagttctagccaagatagtccaccttattttagcacttgtactatgtctctgtctctgtctgtctgtctgtctgtctstctctctctctctctctctctctctctatatatatatatatatatgtaattttgagatggagtctcactctgtcgctctgactgaagtacagtggtgcgattacagcccactgcagccttgacctcacaggttcaagtaatcctcccacctcagcctccagagtagctgggaccacaggtgcacaccactatgctggctattttttttttttaacctgattttgtttttactggaggctcaggtggcccaactaatttttagaaattattatttgcagagatgaggttttgttatgttgctcaggctggtcttgaacttctgggctcaagtgattctcccacctcagcctcccaaagtgttgggattgtaggtgtgaactactgtgcctggccttctacattttttttttamccatttcatagttccctttttctttgaacacttggtccaaactcacttttyttctggattcatattttctgatctcacmtattatgttatagaactgatatgttacgtttgttttcattgatgcgtstgtacttggcttcagagagcagaacaaggccctgtgagtcactgggagccagattttggatcaaaataaatcactttctgacaagtgtagttgtctagtaatggaatgaggcagtcttcttaggaagtaatgaattccctgtcaccaaaagggagaagctagtgagccacttgctgagaatactctatggggagttgtccttaggaaggggtatatctagaatgatctctaaggttcattcttattcggatttctttgatttttatcattccaggtgttccaaataatttgataagtttatgttttttatacttttcccaccaccagagcagtgtttccaacatggttaaattgttctgctttaatgtttggcatttcacactatttgatgactgtaaacatttggaatgttttcacagtgtctcaaaactttattttgatttatgttttgctttattttcagaagaaaactaatgggtaatataaagctttaagatgagtgtatctctaaatttggagagctttcagtgaaactgtacattttgaagctacgtggttgcattgagggaggtctacagcctccagaatcttctttttcacacacacgggcacatgtgcatgtgcatgactttatattttgtcatttacgcttagtcatatatatatatatatacacaaatatatayayacacacacacacacacacacmyatatatatatatatatatatttttttttttaagaccatatttygctctcgttgtccaggctggagtgcaatggcatgatctcagctcaccgcaacctccacctcccagtttcaagcaattctcctgcctcaggctcccgagtagctgggattacaggcatgcaccaccatgcccagctaattttgtattttyagtagagacagggtttctccatgttggtcaggctggtcgcgaactcctgacctcaggtgatctgctcgcctcggcctcccaaagtgctgggattacaggcgtgagccatcgcaccggcccgcttagtccaatattttattttattttattttattttatttattttttttgagatggagtctcactctgtcgcccaggctggagtgcagtggcgcgaactcggctcactgcaagctccgcttccctgggttcatgccattctcctgtctcagcctcccaagtagctgggactacaggtgcccgccactacgcctggccaatttttgtatttttagtacagatggggtttcaccgtgttagccaggatggtctcgatctcttgaccttgtgatccgcccgcctcggcctcccaaagtgctgggattacaggtgtgagccaccgagcctggcctagtccaatattttataatctgcatygtcaactagtcaggccccagaatctgtgggttcagcatccttggattctgcatccttggattgaaaatatttggaaaaaaaattgcatcggtactaaacgtatacaggctttttttggtcattgttccctgaataattcagcataacagctatttacatagcatttacatcgtattaggtattataagtaatctagagatgatttaatgtatactggaggatgtgtgtaggttacatgcaaatactacactattttatctcaragacttgagcatctgtggattttggtatctgcagggggtcctggaacccccacaccctcacccagactgagggatgactgtatttacgttatctaccactctgatgttttctttttgctttarattgcccattacctcttcatctgtttcatttattcattcaaaaatttgtattgagtggctactgtgtcgggcatggtgccacttgctggagatacagcgttgaacaagacagacccaatggggctgcctgggtggagcttatgtttcakactgggaagagagtcaacgaacatccacacatatttcagttgtgagaggtgccatgagggaagagacagactggctggggaaagcgtgatcaggcagtcttccccaggaggtgagacttgagcccagacctgaatgatgacaaggagccagtcatgtggagactggggaatgtgatttttaagaagaggacaagtgccaagatctgcgaactctgttgtagttgttaggggaagggatgggttaccatgctctgtaaaaatgaccattcatatttgaaatatgaccattctgtaacacagtgtattgcctactggatttttctaatgaggtattgggtctcaacattggaaatgtttgagcagaccttggatatctccctgaggtcttctctgagaagaggtgggtaggaactagtgactttcaatacagactgtatgttagaatcacctgggtgatttataaaactactgctgcctggaccccactccgggagagttaaatcactcattggaagtggagcctggcttcagcatgtgaatcccacttcccttagagatgcagccagggtaaagaacccctcttctatatttccaacttgaggactaaatgaccccatgggcgtagaagtgtttagtaagaaaatctagttccgggtgcagtggctcatgcctgtaatgccagcacttagggagaccaaggcagatggatcatatgaggccaggagtttgagaccagcctgaccaacgtggcgaaaccccatctctattaaaaatacagaattagctgggcatgctggcatgcgcctgtagtcccagctattcgggagactgaggcatgagaattgcttgaacccaggaggtggaggttgcagtgagctgagatcgtgacacttcactccagcttgggcgacagaacaagactctgtctcaaaacaaaacaaaacaaaacaaaaaactgggaagttatgagctaatacataaaccttcattgcacagtcttttaaaatttgttgtttctactttctgaaaatgaaaatattaaatccttcctgaaaacagaaaatatcaaaaacttaactgcattagacagagatatatgttaactttgagtgcatttaattttgtattcttgagtactgtttaaagtgtcttttaaaagttctctcttattgtgtctatttattttattctgtttgcagtttttatgccaactttacacatttgtaaatagaatatttaaaaagaattttttttgagggattgatctctaacttcttggtgacttatagttgttcttttggttgtacatctttactgttttccaacattttaaggagaaaaagcactactctcaaatgtaatatttaactgctgtgtttctatctttaaatatagaattgaaaatgagaacctgtttatatttatgggagcaatagcaatatgtgtacaataacagtagcaatttccttaagaatgttctgttgcagtttggcgtgggtctgtgatagaaggttcagaatgatgggtctttgtttttctcttgcatactgcagagtaatgtggaatcaaataccactattgaagagctcttagtcatcaatttttgaaactgaaagaggtttatattgtaagaaggatgggccctgttgataagcctcactgattgctacttgctagatggttttaggagatatcttgaagttgaccttgtgtgaggttactggatggaaacagcatgagtttaatyttgtacatgacttcttttgttgagctggagatactattgtyttgcagattatytytttggcacgcatgaccatttttttttgtyttttaaatcacaaactggctttytttctgctaaggttggtgtgcttagattctttaagctccaaatctcaagaaaatataggaaggaaaatcaaccattagagagagagagagagagaraaaaaaaaaaggaaaaaatataatgtgctccaaactgattataaatagcttttgaattgttggctccatagaattttttttttttttttttgagacggagtctcgccctattgcccaggctggagtgcagtggcgtgatctcagctcactgcagccaccgcctcctgggttcaagtgattctcctgcctcagcctcccgagtagctgggattacaggcgtgtgccaccatgcctggctaagtttttgtatctttagtagagacggggtttcacaatgttgtgcaggctcgtctcaaactgttggactcaagacatctacctgcctcagcctccaaaggtgctgggattacaggtgtgtaccactgtacccagcctcagtttgttaatattttacaataatttagaagtagaaccctttcttaaggctgggcgcgctggctcacacctgtaatcccagcactttgggaggccgaggtgggtggatcacgaggtcaggaratcgagaccatcctaacacagatcgagaccatcctaacacagatcgagaccatcctgactaacatggtgaaacccccgtctctatgaaaaatacaaaaaattagccgggcttggtggtgggcgcctgtagtcccagctactcaggaggctgaggcaggagaatggtgtgaacctgggaggcggagcttgcagtgagctgagatcgcgccactgcagtccagcctgggcgacagagcaagactccgtttcaaaaaaaaaaaaacaaataacaaaaaaagaagtagaaccctttcttaagagcattctcaggtcttctatcttaattactgtagttatttccagtcatgttttataatcaggtgctatttttcattgtggcataataagtaatatatttttgtaaatcatgttgaagtgcttgagacaatacaagcaattatttgctaaaatttagaccagggtctcaaaacaacaattacatttttagataatggtcacagtaagtcttttcaraaaaaagcaacgaagaaagctctagaccaatgagattttagtcatcattaatcaatgccaarcgaaaaaatcttaagatgtatttaaatttgtgatgccagtgtgattcagaaatttgaaaaatggatttcaaagtaatgctgtgagcagataggtcattgtataaacataactaatggttcattcattcattcctacaataatgattcagtgtcagatttgggtgttgaaaatacagcagagaacaaacacaacagaaggtccatatttgcggagcctacattttgtgggggaagagagatgataaacaaaatgaatgagttaagtagatagcacgttagatcatccaaaatgctatggggggraaaaaccctgggaatagggagatggcatgtgaagtggaagaaggttatgattttcaatagagtgatcagagaaagcctcattgagaagacacnctaaggaggccatgtggctggaggggactgagttagggggtgaatagtaggtgagaccagagggggccacatgatgtagcagcttctagattatcaggactttggcttttgctctgagtgagatgggaaactttcagagagctttgagcagaaaagtcacaatgttctgcactttttccttcattgagataacctctgcatacattcaagcacgactaagacccccttcagggaaaagaagttttcattaactcagtatcccatgaggtatatggcattctcttccttcccaccatagcaggtgtttaatagrtggttatggtattgcactgatttaggctgggaaaaaawtaaagatgaagttattaagacagccagttgtggtcgggcacagtggcgcacgccggtaatcccagcagtttgggaggctgaggcgggcggatcacctgaggtcaggagttcaagaccagcctggccaacatggtgaaaccccatctctattaaaaatacaaaaaataagccaggcgtggtggcaggtgcctgtaatcccagctacccgggggctgagccaggagaatmgcttgaacctgggagatggaggttgcagtgagccgagattgcgccactgcactccatcctgggcgacagagcaagactccgtctgaaaagaaaaaaaaaaaagacagccagttatttgaaaagaggttggagtagaccacttgttttaaaaataaccacttgtttgcctaggttaaacccatttactcaaaagacactgcgctgacttgcctggttccttgtacctgaatctttacctaagtgtcttgtgctctctgtcctttattctccataatgcgagctatccagtagaccctagccaaaggggacataaagacagtctcaacattgtattactggttctktgctacagttgtcattcaagttcctgagaaaatggaatgaatgtctgttattcatttatttattaaatctttagagagcatyatctatatgccaggtattatgcaggctatacaaaaattaggaagacgtgatctttatttttaagttacttatttgttgttgragrcaacagagataaatgaattgtgatattttactggaaacaatatgrgtttttgagttaagaacagactgtgtttgaaatccctttagcagctatgtgaccttaggccaatatttgaaatgatgtgaacgttggtttcctcctcagtaaaatggagaatgataataactataagtggtaaggaaaaatgcatgtgaaggatttaatacagtayctgacacatgacaagcacttgataaatgatggatgtgatggtgacaataatagtaataataataaaataataatrtgttggctgtgctcgataggagtggagggtagcaaactcagcttgaatcagagtaatctcctgatcaggcaacatttgagggggctttgaagaataagtagggattttccggggagagaagaggggcaaagtcattcaggargatgaaacagcctgtagargagggaaggctggagagagtgctgcttgtcagtgtctgtgttgttgcagtagggaggtagatggaatggggtgagaggggaggtgagcctggagagatggtttggggccagatggggaaagctgtgttayggggcttgtcagtttctgccagccaaggcttcagcatagctgactgtaacaaagttgggaaggccttgcttttgagagccagaccaggagtacctgtgactaacaaggggtctgggaggatctgctgctcccatgccctcctttgtrtrttttaaatctgtttgagccttctgggctcctgtgaattagggagwggcagctcctcagtctaactcctaytgtgaccaggttgcctaattggccctttggtttgggcacccactgtccttctgcgtggttggatagatgctgctcccaatgtccctgatctcttacagacccctctgattcttcactcttggctttgagagcccctgatgccctgcagtcttgactgagcttctaatggttgatcagacccttgaatgttgagctctttccatactagacttgaatattctcctgcccatttgatttgttaattaggattcattggctgtttctstgctctcctcttttctctctgttcctgctggttcaagtttaacctccattttctttctcctctgggaagtttcccttatgcctcttgaacagggtcaagagcacttaggagctcagatttacactgtatatcatgagaaaagcattgaaagtttcaaagcaggagagtgacataattagctttatgttttaaagcggmtttttgactttagattctggcaatacagtggtcctgtggtctaagacatctgactaaccttcctgmtagcaacaattaaaaatgctgagtgcaataaaaaactagcccttaaatggaatgaatgagtygactacttggtaaggatgctcagaggctaaaactgaatcaaagcaggaactcttaraagtaagcagtgtgttggctaggcgcagtggctcagcctgtaatcccaacactttgggaagccaaggcaggtggatcacttgagctcaggagtttgagacctgccggggcaacatggcaagaccccgtctctaaaaaaaaaaaaaatgccaaaattaggcagacatggtggcacacacttgtagtcccagctgctcgggagcctgaggtgggagaatcgcttgagcccaggaggtggagtttgcagttagctgagattgtgtcactgcactccagcctgggcaacagagcaagactccatctcaaaaaaaaaaaaaaaaaataagcagtgcatcaaatctgacttttgccttgaatgcatttgctgaatcagtattggttcaatactgagcattagttttccggccacttagagtagaggaaataggagataaagcctagaatctccccagatttgggctccagaggaccctacaactattgtggggggaactggatgtggtgggaaaaattgtatacctcttctcagacttcataccccaccaatgggctstcaccacggtttgcagactgttcacaccgagtktgtgtagaaaggatgaaatcttaagattagaatgagagtgaacgcaggttggtcatgcctgcagctctctttgaagacactcgctatcatggygggctagaaatagtcaccatagatagtattcttaaaaaaaaaaaagttgctggccgggtatggtggctcacacctgtaatcttagcattttgggaggccgaggygggtggatcacttgataccaggagttcgagatcagcctggccaacatagtgaaaccttgtttctactaaaaatacaaaaattagtttggcatggtgatgcaagcctgtaatcccagctacttgggaggctgaggcaggagaattgcttgaacccgggaggtgaaggttgcagtgagccgagatcagatcacgccactgcactcyagcctgggcgacagagtgagactctgtttaaaaaaaaagaaaaagaccctgcagaaattaaaattgtaaaaatataaatatacaaggaacaggcaccaggcacctttggctccacatcctygtcatcacttcataccttgtggctctagtttgcatttttgtggctgcttatgaggtcgtgcctcttcagtatttacaggcatttatgactatcctgcactgaaatgcatttcatgtctttgctcatttaccattggattgtttacatttttcttcctgatttgtaagagtatacacctatactcatattctgtatactaagcctttttagttatttagatatgttggaaatatcttttcctagtccatgggttgtctttttactctttctgtggtatcctttgaagaagagaagtttataattttaatttagttgatttatcactsttttgtgtttctaggttgtatttttctattcttaagaaatcctttccatgaagtcataaaaacatgcacctatattgtcttctgaatatcttmtggtttgacttttatatttaaatctttaattctccctggaattgakttttgtgtttggtgtgaggtagaaatctaatttaaattttttcccatgattccaccccaccccccaataaaattagccagtgatctcartaccacaggttactgaacagttgatctttcctgcactaatttccaatgtstgttttgtgataaatcaagtttttatatatgcatgggtctatttttggactattctgttacattggtttgttggtctattcttgtgcaaatgccacactgtcttactcttaccattttaatataagttcttggtagctgatggaataattcttcttattttgttcttccccaggagtcactggctttggacaccttccttgctgtcataggctctttgctttggaaagctctcaacatttacaaggaagtgacaagtgtgaacgaaggcagatcacactgtttatttccgtttccccaataagcattaaggaggaggatattgagggtctagttgtggttgtcttagactttgcacatgtttttataagcaaagcagacaagctccagcaagggaactcaattgtctaattagatgttacyagaaatcttattggggctgtgatctaattcttttttttttttttgagacagactcttgctstgtcatccaggctgcagtgcagtggcgcgatctcagttcactgcagcctytgcctccgaggctccagtgattctcctgcctcagcctcctaggtagcggggattacaggtgcatgccaccacacccggctaatttttgtatttttagtagagacrgggtttcaccgtgttggccaggctggtctcaaactcctgacctcaggtgatctgcccgcctccgcctcccaaagtgttgggatcacaggcgtgagccaccgcacccggcctgagctaattcttaagaagtcactttggaaaaaaatattatttaagggcttttcataaagtattcaraaaggtacaagttctaatctaacagttctatttgtgatttttgaggaagcatatgcgtatttccacttaagcatctgaaatattgcctmtagtgctgaacaaattcttcccttggttattttcctcttatctcagtccctggarraataaatgcctgtactaattctctatatacataaatggtctctttaggtataaataacctcataatcacataaaagttaaagttttaatggaaaaggctgagatgaaatattacctaagtaggaattaattgctttttatcactttacattatttcatttttagtattatgaaaaatataattgttccttttcttaaaaaaaaccagygtaatttgtgcttagttttaaaccaaaatttttcctatatgtttatagtttatattttcaagccaaaatacttgagtttttttcctgtcataatatatcaatatgagaaatgtattgttactttagaatcttttaaaacttctttttattcctttttttgttttttaagatagggtattgttttgttgcgcaggctagaatgcaagggcacgatcttggcttactgtagcctcagcctcccaggttcaagcaaccctcccacatcagccatacaagtagccgggactacaggcatgcaccaccatgtccaactaattttttttttctttttttttgagacagaatctcgctctgttgcccaggctggagtgcagtggcacgatcttggctcactgcaacctctgcctcccagattcaagagattctcctgcctcagcctcccgagtagctgggattatgcaccattgtgcctggctaatttttgtatttttatagagatggggtttcaccatgttgtccaggctggtctcgaactcctgacctcaggtgatctgcccgcctcggcctcccaaagtgctgggattacaggtgtgagtcaccacgccaggctgctccgtgacatttaaataaaatcatattttaaagtccagttgtaagcctatacatcccccttatcacttatctctaattcacttctagacctggtttgaactttggatttagtgctttcaaagtgtgatttttttaaaaaaattatttttctgttgccgtatatttcagctcttctcggtcttgaannnnnnnnnnnnnnnnnnnntcgagtagtcatcactcagctccccaaagtgctgggggttagaggccaactaattttttaaaaattttttgtaggccgggcatggtggcttatgcctgtaatcccagcactttgtggagtccaggcagacggatcacctgaggtcaggagttggagaccagcctggccaacatagtgaaatcctgtctctactaaaaataaaaaaaattagccaggtatggtggcacatgcctatagtcccagctacttgtggaggctgtggcaggacaattgcttgaacccaggaggtggaggttgcagtgagctgagatggcgcaactatactccagcctgggcgacagagcgagaytccatctcaaaaaaaaaaaaaaaaaaaaaaattctgtaaacacaaggtgtcactatgtttcccaggctggtctcaaactctgggctcaaccgatcttcccacctcagcctcccacagtcctgggattatagacatgagccaccgcacctggcctaaaactctttcttcaacattaagaaataagacttttccagtctctttcttaaccctgtacccttttctttctcatcttcttttatcccctcccttcattaactttacattgcaataccaaggacttaatggtttgttaaaaaaatgaattctactcagtagaaaattcctgagaatatttattaaatgtcactgggaggaaatttccctaagcaagatacaaaacttagaatcaaaagggaggactgacttatttggttttagaaatgaaaaagaacagtttggaagaaatagtgcgatgtggatgacttacaaacaattattattcctaaaatataggtacratgagtttattgaaaacaacataatgcaataggaaaaaaggacaaagascaactagtcagagaggatttgcaagtaaatcagtaaatgggaagagatgttcaatctgagtagtcagtgaatgtaaattaaggaagtttactttttttcccattaatttacaaaaattttaaatatgataatatacagtgacaaaatttttttttttttttgagatggagtctcgctctgtcgcccaggctggagtgcactgggcaatctcggctcactgcaagctccgcctctcgggttcatgcccttctcctgcctcagcctcccaagtagctgggactacaggcgcctgccaccgcgctcggctaactttttgtgtttttagtagagacggggtttcaccgtggtctcgatctcctgacctcgtgatctgcctgcctcagcctcccaaagtgctgggattacaggcgtgagccaccacgcccggccccaaaatttttaaataatgataatatacagtgtcggaaagtgtgtagaggtagaagtgtgaattgctgtgaactttgagaacgtggattggcagtctgtattaagatctaaaatgcatacagtgcttgggcccagcagtctcacagaagccataggtgattgtatgtcagttcccaaataccactcgttagagagaagcactgtttaacatctagtatctcatttagaccctgtttgagcatagatcatatgtgtgtggaacataaaagtaatcgaagtatgctcattctttttttaacatatctttccaggcttctatatagttaaataaataatgctccttgacatttatgtatttatttatttagatggagtctatttctgtcgcccaggttggagttcagtggtgtgatctcagctcactgcaacctctgcctttcgggttcaagcaattctcctgccttagcctctcaagctgggactataggcatgcaccaccattcccggctaatttttgtatttttagtagagacggggtttcgtcatgttggccaggctggtctcgaactcctgacctcaggtgatctgcccgcctcrgcctcccaaagtgctgggattacaggtgtgagtcaccacgccaggctgctccgtgacatttaaataaaatcatattttaaagtccagttgtaagcctatacatcccccttatcacttatctctaattcacttctagacctggtttgaactttggatttagtgctttcaaagtgtgatttttttaaaaaaattatttttctgttgccgtatatttcagctcttctcggtcttgaaaagatttgtgagcctttttgacaaaaggtggtgctcattttctatttcggtggctccagtaaagggagctgctctctcatcggatgattattgcccccagaagtggtcctaccatagctttactggtcagttagccagaatttacacatttactctgaggcttacaaaaatactgtgttcataaaaagccctccttcacattttgtgaaacagttgcatggtgatttgggatattttaagtttaccatcacctctctgtcctctgcaaaaataaaaattgtggaatgtaaaacaactctgttgcacaaaaaggggaacttggtgtaggaaaaaataactagaaatgataactacgagacactgcactcccaaattgaagatttaaaaaaattcctgatcgtaaataagaaaaattatggagacatttatccactgcatatctgatgactaaacgcttggtataccccagccattgttaggtgccagggtacaaagttcctgccctcagcgggttgacacacttgtgggggagaaaggcaacaaaagcttaagcaagtaaatgcataattttacagggtgatatgtgctaaaaastaaataaagcaaggtggaggaataacaagactggcgggggtgctggctggggtggctatttgagaaatgagggccaggcatggcctttcagaggagatgatgttggagctgaatcccaagtggtcagaaggagcaaggtgggaaaatatttgagcaagatgggaaaatatttcagttcctgggtcaaaagtaacagtaagtgtaaagatcttgagatgggggctgggcactgtggctcacacctgtaatcccagctgtttgggaggccaaggtgggcagatcatgaggtcaggagttcgagaccagcttgaccaatatggtgaaaacctgtctctactaaaaatacaaaaattagctgggtgtggtggcaggcgcttgtaatcccagctactcaggaggctgaggcaggagaattgcttgaacccgggaggcggaggttgcagtgaaccgagatygtgccactgcactgcagcctaggcgacagagcgagactctgtctcaaaaaaaaaaaaaaaaagatcttgaratgagaatgaactgggtttttgtgaaaatggcaaatggcattttgggtactgcaagcctttgcggctcggaactgtgctgtgcactgtgggactgtgtggctcaatgcgggacggttagcatccctagtcactgtcattacaaaaacagtcacacattctagacacccactgcccgccccaacgccaagggggcagtactgccttcaaccaggaccccaaaagactccagtgtggcagttgttggggagggggaatgtgagaggggcagtggagagggagtcagcaagcaggttctctgagccctggtgagaagtctggattttattttaagccgcctgagtgatgtgatttcayacatgtttttaaaagatcactstggttaytccttgcasacagtgraagagtgagccaagttaggaggctattgcagtagttcaggtaagagatgatggtggcttagactgagagagaatctacttgagggtaagaagtgatctgattcagggtatatgttgaaagatttgctaattaattaaatatgggaggcaaaagaaggtggagaaatcaggatggctcctaggtttcttataaggagctaggaagaatgtaaagaaatcatatgataaggagatataaaaaggaataaaataatatttcacacttaaatttaggagacgaaatatttgcttatttgaatttgaaaattcttgtggataccaatattgatactttgtctgaaaaataattttaagatgagtctcctggccaggcggggtggctcatgcctgtaatcccagcactttgggaggctgagtcaggtggatcacctgaggtcaggagtttgagaccagcctgaccaacatggtgaaaccccatctctactaaaaatgcaaaaattagmcgggtatggtggtgcacacctgtaatcctagctactcgggaggttgaggcacaagaatcacttgaacctgggaggtagaggttgcagtgagccaagatcgtgccactgcaagccagcctgggcgacagaacaagactccatctgggaaaaaaaaaaaagatgagtctgccaaaatgtttctcatttggaagggattcatgactttgccagaaaaacaagcagcattctatagttataatgctctatgatgtaatttactggacctaagttggctacctttcatgatgcatattaagtgtggagccatatttcttagtttctgttataaagctaaactgttaagtcatttttattcctataaagtcaaacaaactagccatggatactttttaacattctgtgaaaccaactttatccagtttctgaaatggatgccagttctttttttttttttttgagatggagtcttgctctgtcccccaggctggagtgcagtggtacgatctctgatcactgcaacctccgcctcccgggttcacgccattcttctgcctcagcctcttgagtagctgggactacaggcgcctgccaccacgcctggctaattttttgtatttttagtagagacggggtttcactgtgttggccaggatggtcttgatctcctgacctggtgatccacccacctcggcctcccaaagtgctgggattacaggcctgagccactgtgcctggctggatgccagtactttttaaaccaaagttaaaataattatttataggaagcagttgtgcactgtagattaggaacatggagactggggcataaatatattcttgagctagaattaaagtaaaacatgtgactgatggaaataacagctctccctgtgccctaccatggaacttggtaagcctttgttaactcactggcactgctagatcatgctatggtccccgagggccagggaggcaagtgtgytagtccaagtaaaaagctgatatgatctttgtatgaacagaaacactgtttgtaatgtgatgataacgttggtttcttgctcctgggatattgtgttctaggtaaagtggtccagagaccaatgggtggcagatacagggatacagaggtcaacttaatataaaaaaagaccttctctaatgtctaagagcagagtgaaagtgagcaggccatctgaggagagagagacttccctgttggctcatcatgatgcttaagcagagccaaaaagctacttggtagggatgtcaaggaagtgagtcaggtgttttcagcaccgcgactctgtcattgtgtgcctctctccttaatacctcagaattagaataaagtcttgataacagtagtggcaccagtcctgtggtttgttttgcgatgactgtgtggttgttaaactttctaagtgaaacaccatagtgtcgggagcaatgccgacaagcctggccacctttggtctacagcagatattgcaagctgrtatcccgtggccacagtcaggcttggtgattgataaacattttgatttagggagctgcttttttcaagaaacagaatcacataaacaggatttcaggccagtctcaaaaaactggaagatttcacagagccttgggyccacatttctgtgtggcatcagagggctagaggtgaatgagtcctcctctcctctcctctccccctcctcccctccattcccctcccctccccttcccckctcccctcctttattttttttttttatgagacggagtctcactgtgtcacccaggctggagtgcagtggtgtggtctcagttcattgcaacctccatctcccaggttyaagccattctcctgcctcagcctcctgagtagctgggattacaggtgcatgccaccatgcctggctaattttatatttttagtagagatgggctttcaccatgttggccaggctggtcttgaacttgtgacctcaggtgatccgcctgcctcggcctcccaaagtgccgggattacaggcatgagccaccatgcgtggcttttttttttttttttttttttttttttttgagacagggtctcttgcgctgtcacctaggctggagtgcagtgagacraacacagctcactgcagcctagacctgstgggtttaagkgatccttacatctcagcctcstgagtacctgggactacaggtgkgcatcaccacacctggctaatttttaaatttattgtagagacaacacttcactatattggctggcstggtctcaaattccttgcctcaagcgatcttctgcctttacatcccaaagkgctggaattacaggcatgaaccttcacctttcttttagaaagagcgtgaatctctaattcaccagagtccccaccattccatctcatctgagttatctcactatctctgtkcttccctcatttacatcatctgtcacttacctgttgacatgtgagttttgactyttgattgagatgctgacaccctccttcccttctaggaaaggaaaataaagggggaaggaaggtggagagggacaaaggagaggcgtgtggaggatgatagygcaggacttgcattctcagttctgcctcttaaatcttggaacctatttcttcatctaacagtataggactgatgtttatttttgtattagatcatatatataggagtacctggcatataactttgtccaaagtacacattctttagctggtgctcctctgtgttcccctgtaaagactgaggcaactataatgttccactgttctgtgattattgattttcaggtctgtttcctccaccagattatgtgtgtcttactcaactttgtatcaccaagcacctacgtggcattttttcttttttgaaggtagggaccatggctttctctttctttactggacactgtatagatgtcatgcaggtctgaacgtcacactgttaaataattacttaacaactgaccagaactaaggctstggtctagagctccaaaccagaagcaaaaaggaatggtgctgggctggggcactttcctctaacatcacccaaacccagaaaangaggatcgtaagccccttcatgggccaaatgcagggctggggcccttgggctaaccctttagtgcctctggctgcatcactgtcagagtaaggtaaccagcaaggggctgcagggaacaaccagccaggtccagacatggacaaacataattggaaggaagacaggaaatggacaggtcctgtccagtgtagataaaatgacagcagctaaggcaggttgaggggcagaggagaggctgggggatcggtattgtagcaatgcaggagtcctgtcctgagtggctgctcagggtattgacatgccattttgataaatacatgaattaatgagtgagtttcgagagtagggggagagagaataactgggcatccccttctgtagatcctcagtcttctagtctyatctctctagaaggatattcacccatactcaccttgtccactttgtgccagagttgaacattcttaagaaattaagaaggtgattctttgccarccatattccagttctttatttaggagctatattatcagctttgcttatggctccagaagtggccattaatacctggagctaaaacactgttttggtttagcatgactctagttttcactgaatatttagtatttttaagttargtttttttgttgttgttgtttttgtttttgttttgtttgagacagtgtctcgctctgttgcccagactggattgcagtggtgtgatttcggctcactgcagcctacactgcctgggttcaagaaattcttgtgccccagccacctgagtagctgggattacaggcatgcgccaccacacctggttgatttttgtatttttagtagagacagggttttgccgtgtttgccaggctggtcttgaactcctggcctcaagtgatcagcctgcctcggcctttcaaagtgctgggattacaggcatgagccaccgcacctggcctaaggttaattgtttttataagcaaattattttgcttttgtgacccaaagcagtactctcagatacttagtgtagcaatttattactcagatatataactttttacaaagagaatcatagcagaaaagaacaaggtaacgtgttgtagggcatatgttctgaaggagcacttgaccttatcttctgacatcatgtaaagattttggcatttagtgtcatcatgtgcaaccattgttactttttgctactgtatcataataatacttagtcgtatcagtttgattaaatgcctcctttgtatggttcccagcagcatggctgtagaaagtattctcaaatttatcaggagacccaagttttaattcggattccctttgtaaaaaggcctccattactggaggccaaatataaaaacttttttttttttgagacagagtctccttctgtctcctaggctggagtgcagtggcgcgatctcagttcactgcaacctccgcctcccaggttcaagcgattctcctgcctcagtctcccaagtagctgggattacaggcacgcatcaccatgcctggttaatttttggtgtttttagtagggacagggttttgctatgttggccaagctggtctcggactcctgagcttaggcaatccgcctgccttggcctcccaaagtgctgagattacaggcgtgagccaccgtgcctggccaaatatataaagtttaaaaatagctcgcttgtgttcattgcctaccacatactgggtattgtgctagatatttaatatgccagatagcatatgcctcattagcctatgaagtagaggcttttattattatttccacttacatagatgagaaaattgcagcacagataaattaatttgtctagcgatggaaccaaaatctcagtcaggcagtgtgacttcaaagcttgtattgatagaagttctccaagtgctttaaatatattaactcattcagactcaccaagctgtgcatttttagtttatagagttgatatcagtattaaataggaatatgtatgtgtatgtatttatatatgtatgcagatggtccctgacttaacgatggttcatcttaatgattttttgactttataattattttttgactttataattttttgactttatataaaccatattttgggtgcccacacgtctattctgtttttcactttcagtacaccagtcaacaaattacatgagctattcaacactttactttaaataggctttgtgttaggtgatttttgcccaaatataggctaatgtaagtgttttgagcatgtttaaggtaggtgaggctaagtaagctgtatttgataggttaggcgtattaaatgtatttttgacttatgatatttttcaaactatgatgggtttactaggacataatctcatcatcagttgaggagcatctgtatatgtrtgtgtttagatagatataattagatatctatatataatagattctatgctatgggcattgtaagttctaaattgcttcagtggcattattgtacattcttayataagattgaagaattttgtgattttgattaatttatatccttcaaagtgaccaggaaggtagagtttgcatgcagaaaatttgcatgtatattaattccataaataatgtttgtagttaaattttcattttgtttaaacattttttacaagatagagtttactcagtgctgttatttagcagctgtgtgtatgacttcataatttagggggctgtctgttttgtgttctaagccacgtggctgctgtggtgactgctttaraaactttcagttccctttgctgtgaaacaggtttcagtgcatcgtccctgtgtataaggtcaggtttcttacatggactcactctgtttctgtaaatttgtctgagaattttcaaggcagtgctttcatggcctctcctctaattttgtgtgtgtgtgtttgtgtgtgtctgtgtgtgatgatgaaaaagtcaaaagccctaaaattaaatcagagtttaatccatgtccctaaactagataagctgctttagaccttttccttatcccttacacgtcgctcagtaaatacttgctgattgactttcaaattcagattacttttacgmtagcatacggtgggcacaaagggtttttttgtttatttgtktgtttgagacggagtctcgctctgtygccaggctggagcgcagtggtgcaatctcggctcactgcaacctcctcttcctgggttcgagcgattcctcgtgccttagcctcccaagtagctgggactacagacaagcgccaccacgcccagctgatttttgtatttttagtaaaracggggtttcaccatgttggccaggatgctcaaacccctgacctcgcgatccgcccgcctcggcctcccaaagcgmtgagattacmggcgtgagccaccgckcctggcctgggcacagagttaaaaaaaaaatactggtaacagaaaacttgttggcgtgtttcagttttcagagtcttctataaggtcttataccagccgagaagcagcagaaccatctgtccgtgtaccgaggacggatctcarcagctctctgttcagtggctcctgcctttgtagtggattcccttgctgtgctgtaattaagtcagccggcaggagttcctgttttgagggggcctctcccggctggagaagtaccactgcctttgtgttacctgccatgttattgtggagtggataatttttttttcctgcatgggtcttggtttaacagcaggatcctctgggcttcttccaagaagcaccacatttccctgaaaataaatggcagatgaattatttcttgagattatgaaaatctgttagatgaaagcttgcctttttstcatgttcaaaacaatgctaaatgcttataattatactcccaatgaattacttctttcactggcttcctttgctctggcaaaggtggattttttttccatggcagagaaattttataaaaaatgtaatattttagaaawtgcctaaatgtcaagaatacaacatcttgtttgttgttgttgttgttgttttgtttgttttttgatacggagtctcgctctgtcgcccaggctggagtgcagtggcgcaatctcagctcaatgcaaccccgcctcccgggttcaagcaattcgctgcctcagcctcccgagtagcctccattgaaggaagtgccatagtgtgggaggatctttttattttctacgcgcaccgtatttgattctgtgtttacaggaactgtgtctgtagacaaaaagcaaaatgttgggktttagtttcttcaggtgaataaaatgttacttgcatctcctcattgtcacagtgttcgtattacatacttcgtgtgtgtagttttggcatttaaggaaacagagctaaaaaaaaaacaaaggacaataactgcatcaacaacatgttatacaccagaggaaatgcggcgacttaggttctgtgatgggaaacccggatttttttgttgtacttgaaatcttccgtagaacgtacgtgtttgcatgacccagaaaggaaaacacattggaggactttgtactagttccattctaattctgtaaaattctcacaaattcaggcatctgttaacccttcgagggcatataagttcagagccatgttttctgttttgtgtctttccctttggcggagtggttaccttttctgagcccttggcttgctttctgtgaacataaggcgctccatctgccgctttaaagtgaagatttataattcaaacaagacagcgtttcgatgttgcactcctgtcttattagatatcaacttaaagttaagaaaatggaattattcaaggccttgttatctagtttatagcttattcagaatttatatttctgatttttttttgtcctgatgactgcctgtgactaatttgtgtttttgttattaagctaagattgtatgaaaaatatggcaaaaacaaaattctatatttctaatgccccatgagaaatctgatttagaggcccttcctttggacacactttttgttttgttttgtttttgagcggagtcttgctctgtcgcccaggctggagtgcagtggtgcaatctcggctcactgcaccctccacctcctgggttcaagcgattctcctgcctcagcctcccgagtagctcggagtacaggcgcccgccactacgcccagctaatttttctatttttagtagaggtggggtttcaccatgttggccaggctggtctcaaacccctaacctyaaatgatccatccgcctcagcctcccaaagtgctgggattacaggcgtgagccaccgcgcctggcctggacacccattttgaatagcacttaccacagattcccgaagccagtggttttctagcctttttattcgccgttcgttgtaagcttcttgagtcttggtgattcttgtttcatttgtttttgtttctccccagagcctagcacatagtaggtgacgaacaaatgttcatcgaatgtatgggctcaaccatagtctatttttttcaaaaaggtataaatcttatcaatgttttacattttgctgaacaaaacaggagagagcggattcttttcaaataggaaaaattagggagggaaaagagggattgwctgaaactctattgaagtatgtcaacataaaagtttattgacagcctggcgtgatggctcaggcctgtaatcccagcactttaggaggccaaggtgggcgggtcactagaggtcaggagttcgagaccagcctggccaacatggtgaaaccccgtctctattaaaaatacaaaaattagccrggtgtggtggcaggcgcctgtactctgagctactggggaggctgagacaggagaatcgcttgaacctgggaggcagaggttgcagtgagctgagatcgtgtcaccacacttccagcctgggcaaaagagtgagactctgtctaaaaaaaaaaaaaaaaaaaaaaaaamaacaaaaccacccctatctatcctatctatcctatctatctatctatctatctatctatctatctattggtctatctatctagataaaaatagcagtcaactaatttttcaaattaaaaatgctttattgttatttatagcatgattgtttttctataaaaaaggcatattacaacagccttcgcttcacatmtgactcttgcagcattcttataaagagatctcacaccatatttgagggcttcattagttttctaagccttaaaaawatttcatcattaagattattctctcatgaagcacccaaaatatagacagcttttcttattttcttttcttcaattgttgacagtctaatgctgccagatctttatytgtcagggacttttgatgttgttggagccatctcttgtggactttatgaaaycttgcatgcagcacaatttgaaacttcattgtgcattcaatttgcattgcctttgctgtgttcacagtggcactccatgaggcttaactatggagatcctggtgctacaagccgttaaatagttctctcttcycaacctattcccctatcctgcttttcttttcttcatagcacttattacctyctgattatattttttgtttgccttttgtctatcacctgtcattcttttaccagaccatctagtctyatatgtctatataacctttctgaaaaacatcctgtgggaaatataccatatatacagaaaaagtgcacaaacatgaatatacagtttaacaaataatataaacctgytattcatgtagccaccacccagatgaaggaaatagaatatcataagcaccgcasaatctccatttgtgcccttctccatcgtagctttctctgtcccagacaaccattgtccacaacttgttgtaataatttacttaattttcttttatagttttatcacacataatttagtttttgtctgctttttgaactttacatgaatggaataatattgcatatattatttaatgctttttctttcatttaacatttttktktgtgtgtgtgtgagattctccaggttgttgtacacagtgctagttatttcattttgttatggtatagtatcccattgtatgattgtaccacagtttatccattttttagttgatgggttttgacttgctttcattgtttgggctattatgaatagtgctgctctgyacctgttgtacatatagcctggtgaacatgtttgcgaatttctatgagcgtgatcacrgtggtgtagaattgccaatcttcaacctgcctgtattttccaaagcgatcataccaatttatttaccttccagcagtktatgagaattctstattctcaccatcattggatattgtcagattttaacatttggctcaactgatgggtgtataatggtatcctatggtacttataatttgcattatccctagttactaataagcttgagcaatttttcatatttttatttcgatttcctaatttatgaaatgcctgtttaagtcttcagccatttcaaatgttacctgtcttttcaaaatgatctataggagttctttgtataatatatattctggcccctagtcctttattctttgtatgtgttgcaaatatcttcatctctgcagtttactctttttgtggtgtcctttgataaaattctcaatttggtgaatgtaattgaatttattaatttttctctttgttatgtatttttgtgtctttaagaaatttttccctatgtagggaagaaggacaaaaattgtctttcataattagttctttaacccttcataactttgagtatataaattattgtgaccatctttgaatctacagtagttgaattgcatatatagaggcttgagttcttaaattattctttccagggtgaatattagcatatcacaataggacagtagggacagtggctttttcgctaatgaaatctaagatttttccttttctgctcatgaaaaatgtttctgcttaaattgtaatgagtgtacaagaggcataaatccacagtgggtacaaatgtcaaagattatggtttaaaccagcaaaatatgtcttcttagatatacgaaacattttgtcaaatagcccctggcatcatctgggctaaatgaagaatcaccaggacrtgtgatacagtgaaactattccacttatagtaacagcacttagtaattgctttcattaatccaggcaggttaatattctatctacttgcataacaatgtcaaaaaatctattatctactgaaaccttttatatagcaagttaagctcctatttctttcataaagattgagattcaaatattaatccaaactactcagaatcactttctcttcctcacttttctgatacccccactggagagtgactgatcagtgcattatctgtcacctcagagctcagagtgcccctcttttctattcaaatacaaagccattcatttmctttgatggacaaatagccgtggcattagtatgggtaggggcaagtgctgttgtctcttatctaggaaggagttggttcttttctgatggttgaataatatacttaggtatagaaagagacctgagtgtcttgaaagcaacattctttcatttttgtcaatgttttaatcagcacccctgtgcatatattatctttgcatatttcagcactttgtattagacttctacatgttgtggtctttgcttctgataagggacagaataaataggaagaaagaataaaaaagccataatgttaagtacatccattccatgcccatagccatacatcacagaagtcacagggaaggctctgtgacacragataatkatgtggatgtgacagaacatggtagaggaaaaggccacagacaggtgcagagtaggaagaatgaaagaattcattgtggctgtcaaaatcctatgtttgtgttcccaaatcctatttcttttttcttttgacttgtgatgtattgactgtcaattagttatcaggtactatgttcagcccagttattgcacaagagatcctgaaaatctttaagtagctcctggacttggaagagggaaggaaggaggagacactaaaataattacaatatgttactattatacatgacaatatgcagaatgcatttggaacatagccaataactttacacagagatagcagtttttgagctgaattttagaggaccaagttgatagaatttgatgatcagatgaggggttagggagaggaagtctttcagtttattttaaggctggagtgaatattatttttgtaaatgcaggattttaaggaaaaggacaaaatgccagaagacagcagatttctattttctgtatatttgtacatcatgacaatacatttatagatacactaattcttgtacataaataattcatataatgtttgtctttatcagtctgaattgtcagctttggtcatagggaattggaaccaagtgtttactgagcatctactatatgtgaggcactatattaggtgctgggcatgcagtgatgagcaaaacagggatgggtccagctcttatagaacttagagttgagtgggaaaaacagaattaatcaaatttccatatttataattagaaatgacatatacatatgaacaaaggctctctcagaacccaattattcttccctttcactcttcttcctaatcatactaccagcgttaagttgacagttatttatcaggcatatttagcagccagccttacagttttctcttgcacactgttaacaattactgtcrcatggtcactgttacatgttagccaatagtgcctcacattcactgtggcttccaaagcttgggcttggggaagcaggtggatggygatatcatgagctcagatagagatcatgggagaagagatttgagatgttttaaaaaagtgttttgagcagatgaagttaaagagttaaagggaactatggtcaagtggaggtgctggtaggcaggtggaaatatacttctgaatctcaggatgactaatgaaaagcaagaaaatgaacaacaagggactattaatgtgtgttatgctgtgcttatgcattttgtctggtttcaaatcattgtatttaagtagttcttaaagtcacaggagtgaatgagattaagtagaggaagaaggaaaagaggtacagatggagacctagggagtgccaggcctcagagcagacagaggaagggcacgcagtgacagagcccacgaagtgtggccagagagcagtgatgaggaggattacmgagtggctcatggaaaccagcgtggaagctttcttatttcttcttctccttctgcttctctttctcccttcctcctttcctccctccctccctccctccctcccttccttccttccttctcctcctccttctccttcctcttcttcttcctcctcctcctcttcttcttctttctcttcttcttccttcttcctccttcctcctccttcttcttcctttttcttttttgagacagtcttgctctgtcacccaggctggaatgtagtggtatgatcatagctcactgyagcctcgacctccccaggcttaggtgatcctctcaccttagcctcccgaggagctaagaccataggtgtgagccaccatgcccagctaatgttttaatttttgtagacatgggacctccctatgttgcccaggctaatcttgaactcaagtgatcctcctgcctcagcttcccaaagtgctgggattacatatatgagccactgtgcccggctgtgggaagctttcaagaacaagagagaccaatgttgccagacaggccaagtaatattaggactggaaagcagctagattgagagactcacaggaacaagaacagagaattctgaattctaaaatccacaacgctcatttcactgaaaggtcgttcaggtggcggtggtggatttttttcccttagcygtcattttggatatttgattaattatcgaccattatatttccttcttcttgttagttacgatttactaagaagaatttttatgctattttaaagttaaatgatctgtgattgtaaaatcattcattatttacctcaactgctcacttaattttttaaaaacatcttcaaggctccttcagagtttttatgttgataattttaaaaaatctttttcaagttttctagaaacatgaataagtacacaataatttagttaatgtgggcagtaaatacacagttgtgatagtgaaatgtcttctatgaactagaaaataagaaaatagacacttaaagttcagagtagagaaggaaactcaaagagacakaatggttccagggcagsctaactgtacagtacccttaagaaaagtattcgtatctatatctctactgcagtaggccaagtgctgtggcacaygcctaaaattgtagcactttgggaggctgaagtgggaggactgcttgagcctaggtgtttgaggccagccctagcaatatagggagaccccccatctctacaaaaaataagaaaaattagtcaaatgtggtggtgcacacctgtggtcccagctgcttgggaggctgaggtgggaggatcacttgagtctgggaggttgaggctacagtgagccgtgatgacaccatcacactctagcctgggtgacagagcgagactccgtctccaaaaaaaaaaaaaaaaaaaaaaaagaatctgagaagcagatactggccatattcactgaggtgctaagcaggggtgggcaccctgcctggctctgtagtggtcatttctgacaggcctgtgttgtggagacagacacactaggttttcagagtctgatgcagttacattcgaattaggcaaatctcatactgattctgattccatgttccccgcaacaggcacccggtaaactggctttctggagagtctgcctttgagcagagaatgtgattttcccactgtccttctctgacctctcggcagttatacaattcttattgtaaaataaagctctattctggttttgtgcatcagtctcctgtgggtttaattcacatgcaagagcgtcctcgagcctgaatgagcctggaatggaatacagtttcccagcccatgaatcatgacctgaatcatgtcaaattcaccaagttatgctcccttttaaggtcacttggcagacaggcaggtaggaactttcctggtgaaccctccctgtatgaccatgcagctttccactgggarcttttacaggttgctgctatttttataaaaatgatagactgtaatgttgccgggsacagtggctcatgcctgtwatcccagcagtttaggaggctgaggtgggagaaacacttgaggtcaggagtttcagaccagcctaggcaacatggtgaaaccctgtctctactaaaaatacaaaaattagctggacatggtggtgcacacctgtattcccagctcctcaggaggataaggcacgagaatcacttgaacccgggaggtagaggttacagtgagccgagatcacgtcactgtactccaccctgggtgacgaagtgaggctctgtctccaaaaaaaaaaaaaagagttctgtaattgtaaaaatgtgacataggcattctctaatgtgcaatgaatagtcatttttaagcatttcatacaktgttcstgtactgcactggrtctccttgtgctgaactgcatgggataggccatttccatacaatctcatcctctgaataaggaaccatgatgctcmtaaagacatactaaatatagatcytgggtaatattggagtcagtgctggtcatcaatgattttctctgtgatgatagagggggtccactatgaatgatagcattaattttgctgtatgttcttgcatcattggtacataataattcatagacttcataagttattaatatacaagttacagaatttaataatgtaacccacctttgatatgttttcatayacattatggggaaaccatatttttttgaagtcaagaaatgtatattgcttcatgttgcaaaatktgtatgmtwtgtcaaagaagcattgccagaaaatgatctgaaatgtagmacaataaagttacattatagatgtcttaggtgaaccaagagaaaaattagtgtcagagttaaaaagatgcaagtcaggaattaaggcaaaacattgaccctatctgacttaggagaattctggtcatgtgatcttaagaagagagagtaactgacagttctggagactgggaagtccaaatcaaggcatcagcagattcagtgtctggtgggagcttgctgtctgcttcacagatggtgccttcttatggcatcctcacatggtgaaagggaacaaacagsctccctcaagccttttttgtaagggcactaatcccattcatgaaggcagagcacctacttgtaatactatcgtattcgttcgttctcatgctgctaataaagacatacccacgactgggtaatttatttaatggacttgcagttccaggtggctgcggaggcctcacagtcatggcagaaggtgaaggaagaccaaaggyacrtcttacatggcagcaggcaagagggtgtgtgcaggagaactcccctttataaaaccatcagatctcatgagacttactcactatcatgagaatggcatgggaaagacctgtccccatgattcaattaccttycacygggtccctcctacaacacatgggaattatgggagctacaattcaagatgagatttgggtggggacacagccaaactgtatcaactatcatacctcttaatactatcacattggattttaggttccaacatacaaattttgggrggacatgaacatctggacagtagcaatgctagtccattattytggtctgtctgaaggttttatctaggcagggaaaagcgtatgttttttccttgaccttgaaaatttagcttgggctttctttgtacaaacatgaagatcctaggagaagcccaatcaatttkakagagacaagtggatgaaratagggattaaaagaattgtgcttgactgagcagaragactgatgatctgaaaggacaccaggtaaaatgtttctttttagctttacaaatgcactgcttgttaacatctatgaattcatgtactygcttttccatgctatagacgggtaacttccagggctgytgtgtggcacaagtttggggagtagggatggaaatggtacccttaaagttatgcagtgcagacctgcacaacctgacacaggggccttgggtcagtccatgtcggtgagtgtatgatactctgatatcttaaaaaaaaataacataagaatctgtaggctcttgttcaaagatattgcagagacaagaaccccttccacaggtaaagaaggcacgtgagactcatggcaaattcattgactcttctgtccgagcattttcttgtcattttcattatagcccttccttgtaatcttaacatcaatggtaccctgcttcttagcaattttgataaatctttgtatttcagcaaatacttgaaaaaaatgtaggatccactggcttatatcttctgtgtaggcatcaaaacasatggtggtggggttgttgggaagatggtagcagacagrgttgcttaaaaatrtaagacttccttgatgtccaagaatactgagatttatatgattagaaatttctatacaaagctggaaacagtggagcatgttcccayatagaagcacaggttcccagctcccccagaggccctcatacagagctgcagctgcctgtgatggagcctgcacagattcttccagtagacagtcactttccttctttcttggcagtcttgtgccctgacagcccttctgatggctctggagcctctggctgcctgccttcctactcaccaggtgcaacttgttaattacttgcatgcaatatgatcaytggattatggtacagctttggctaaatcacttacatttttcattcttattaatttggagacatgcacgtgccaacccaagtacrataaatggcacactgtttattgcaagcactaaatagatacatcgaaggttatgttctcaggcatccctagcttataagtgtacattatgttgatttgatattgggtgatgaccaaacacagttggtcaaatcctccctctgggagttggagagacatagaaggaaaggaacagaaatgccagtggtgataayagggacagcagaaggaagaggagcagggactgaaagccactgagtcagagtacactgaggcatatgagcaatacctgagtggaatctgtggttgcagggcatccctacctctgcctgcacatctgcttctttcttccctacccccagtttccctttttctccttccctgtggccatagtggaagatggaggcttcacagttcctgagactagatgtcttcagttcaagcagtcagcagagacttgtttttttgttgttgktgttttttgtttttgttttttgagacagagtctcgctgtgtctcccaggctggagtgtagtggcgcgttctcagctcactgcaacctctgcctcccgggttcacgtgattctcctgcctcagactcctgagtagctgggactacaggcacacgctaccatgcctggccaatttttgtatttttagtagagatggggtttcgccatgttgcccaggctggtcttgaactcctgacctcaggtgatccacctgccttggcctcccaaagtgctgggattacaggcagagactagttttttttaactttttttttttttttaacagtcttgctctgtcacataggctggtgtgccatggcatgatcatagctcactttaaccttgaactcctgggctcaagtgatcctcccgtcttagcctcccaagtacctagggctacaggtgcatgccaccatgctcagctaattttcttgccatgatgctgaggcyagtcttgaactcctggcctcaagtgatcctcctgcctcagcttcccaaagtgttgggattacaggcgtgagccaatgcacctggctgagrctggtattttcaaatttcaattctagctgtcagggagagagaaattgattggcccaccagggaccaggtgtttgcttctggtccattcttctataaccagggagacatttatatatataaacttggctgctgaggcccaaccctcaaaacatagagatttgagcaacattagaataaattcttttatttatggaattatttctataggcatatgtcataaccttttattttctttttaagaaatcaagtctacttaatatgataataatatagtcaaagaagtacacagccacgtatggctggatttgatttcttatccaatasctggatctgagaaaaggttgttcagttacattccagaagcttcagtagcaaaactgctcttttttcccccaacttttactttatattcagagggtacatgtgcaggttttttactgaggtatatcgtgtcatgctgaggttttgggtatgaatggtcccatcacccagacactgagcatagtatacagtagtttttcaacccttgctctcctctctccctctcacctctaggcatccctagtgcctagtattgccatctttatgtccataagtacctgatgtgtagctctcatttgtaagtgagaacatacggtatttgtywttcttttcctgcatttctttgcttagaataatggcctccagctgcatctatgttgctgcaaaggacatgattttgattttttatggctgcatagaattccatggtgtttatataccacattttctttatccaagccactgttgatgggaacctaaattgattctgtgtctttgctattgtgaatagtgctgcgataaacatgtgagtgcccttgtctttttggtattaatagagtggtttgttttcttacggatatatacctgaaactattcttgttaagtgagtcaacaaggcccacctggcagaagaggaaacccaagaacattaaatcagttaagatggaggccaaggcgggtggatcactggagctcacgaattcaagaccagcttgggcaacatggcgaaagttcatctctacaaaaaatacaaaactagccaggcatgatggcgtgcacctgtagtcacagctactcaggaggctgaggtgggaggctggcttgggtctgggaggcagaggttgcagtgagccaagattgtgcctctgcactccagcctgggtgatagagccagactttgtatatatatgtgtgtgtacatatatatatatrtrtgtgtgtgtgtgtatatatgtaatacatatatattacatayctaatatatataatatatatgtaataaacatcatgtatatatgatgtttattagccctccaatgcttgaaatcaggggttggaatcaaggctaaccaactctggtctggtcaccatcactgaatgcttgcggtagccatgtgaacattgtttattgtcgtatactcctgggagagtcccagggatgagcttttataaagttgcagacgggaaagggactctcactttggagagaattaagcatgtcacccagttgcctaacaagttattgctgtgcaggcaaaaaacagacaaaagactcacccaactctaagatttttttgatggacttctctaagttcattatgataaagttaatattatgatttttccagttctcaatattttgggtctaaccctttttttattactttatgtatatgttctgggctccgtagactctctggagtgacaagaaaatcttgaaaaataaaaggcgaggtctattggagagctgttcgtggatgattctgatacgtgctcttggttaagaatcactgctctggttttcttcccagtgcctcttacccaccactgttagatcagttctttaaacaccacttmaactcccacttttgtcagcaacctcctcttgacagtcaagctccttagtctggcatgtagcactcaccattacttggtgtgagtcctgaattctgagcagccagtgtctccttatctgtcacattcgtactcatttttatgactttgcaggtcttgctgaaaattcttccttaacttgccttgagaacyaccttttccaccaagcattcccaatgaatgtagctcgtggtgttctttccttccaaattcctgttctcttatctctactgcttataacccaatacttgactatatattgtcttgtataaatgaagtcttttctatcaaagtagatgttcattttcttaggaggaggaatgtctttggtatcctgtacaaaatctagcatagcctggtactcaaagtcaccttaatcatacactaaatggtatctttattgatgggttgtcgataaacctcctgctttatcctgtatccaattaaaatgatccctcgtcagtttttcctctgattcaaacattttaccccacattgtttctgcaattagacagaaaartaagcatctgtgaagtcaacctttttgctttttttactctgaagtgctgctttttttttcagtaagttgtggttttaaaaaaatccagttatttgaatgacatttattatttttgcagttaataaatgtattttaagtttttaaatccacagtgtagataaggccctagaagcaagtgtagacttcgtccacagctgtactccatcggccactgacagtcttattgcattatttcaacggcacaagcaatcatttacacttgttattacccaggggcatttcaaactgttactgaaatgcatccatccctggagtaaccatctgtgaatggtaatgccataaggtagagagactaaatctaattgatatgcaaaaaggagaatttcagctgtccagctatggagattcaaattsaacctttaataggctgaggatttcagctaaatttttaaaatcatgatatctagttcaggcactcatcttttaggtttctcacagattaaagtacagccgtcttccttgaagtaagaacatctcaaagtcaaaaatacttgtttattgtaaaacaaaatgctacagagaaaggaaagttcttgtaaaatacaaagagatcgcttttgttgctatataatagcaaagcagctgcacctttccttggtttttacacttgtttgtgcctcaaattgcctgaaagaaaaaaagggaaaataagaaaatgctttcagatttcagttgcattaaaacataaaaaaaattgggagcaacatttgttaagatattaagatatagtcatttacattaagtggttttataaaagtgatttataatcttttaaagttatctccccctttcttatgacacgtaaccctaaaagagccatttaaattagctgtcaggcaagatgtaccaggcctttccagtgatcccagcccacctggacatatctagcaattctgcagaccagcacatacttctggaaagatgttgcatggtgatttatagatctgtgtggacacataamacctttacaatggagtgaggtcttgaaatagccctgctgttgctgcccattgagagataagtattctcctgaggtattccccaacagctggaaatgaagtagcagctcttgtcagtctgtgacaggagtggattatcagacatttgtaaagagacaacagcagaatcaggcctttttgcaataaaattgcacacatagatattattgctcctccagcgtttcatatgcagtgtcaaggcacgctacagttcaggcagcaggcaagcagctctgtttgaatggtgggacaaacatacctctgtgtgtgaggtgcctgcacttgccctgctttgtcagggaggacacaatgccactttctctgctcctcagcatagctcaattccagctcccgggatgaattaataaagagatatagccgagggcagtcttagttggggctcaggttaccagctgtcacattactgaaatctcaggatatgcttacagtaattgaaggaaagcacattagggttatattgactcagaatgaggcactctctgggagatcaccgtgaacagcattttgggagcaacctagatcatttcccctaaaattctgacatttgctttttggtcttctgggctccaggtacttattactctttcctgaagagctgttaactggctgtcaagtttacattttgaaatagtgccatgatggcatccctatgcttggtattatttaccccacggaggagatgtgtgtattgcagaacactcatgtttagatcagccaagagaactgcttggaacaatcctagaagcaggcaaagctgcattttatgttcttcatatattatttgaaaattactagtggtcaagaaacattccaactgtttgaattctcctctccaaacaggaaaattctgtaaaattgtttttcatatatatatgtataacacacatacattttataacacatacatacacatataagcatatactaaatgagttagtaaatatacaacactttgaactgttgcctgggatataattactggcataattacatgtgctcgttattatttttctaaatcaaaggtctggttttcataggcttaaaaaataataaaattggatgttaatggtacaagttttgaaaatatttgatattgattcaggagatgaaactgtctagaaattactcttgtctattataattaagtccagagtcttattttcagagataagtacttgatccctacttttgtgtgtcaatttgaatttaattttttaatgcatgtcttttaatactrccctttattatagatgcagacgttaatgaagaatccagtcccatttgtacaaatgccaaggagtttaccctctattgaagggatgaaatgttggtagagcaaatgcaggtgtattattatgattacttttggatactttgtattaacaaattttcagacacattcctaaagattctggggggctggagcaagcaggcaaacagaggtccacatactctatgtgtaaatactaaaagtgatcaatcaagggtgctctccaccctttctgcttcttctggaagctaccaagattcctgggtgcccaaggatacctgttgggtggttgcaggggccacctaaccccaaatttccttgccaccattcccttcatcctctcagcatgacagctggtttcctacttttcctcttcttcccccttttttctgtctttggccaaagcttagtgaattttaccttagagattttacttttaacctattcccatattttaaatgtttccacgtattcactgcagtgtgctgatggttggaggtggtaatacagtttcttggttaaggtgtggtctttggaatttgactgcctgtttaggtcctggctccccactattagctktgagaccctgggcaaattacttaacttttctgtggctcaggttccagatgtaaaatgaaatttttaaaaaagcaacacctttaagttttcttaagaattaaatgaggctgggctcagtggctcacacctgtaatcccagcactttgggaggcttacacaggacgataatttgagcctaggggttttttttttcttttttttttttttttgagatggagtttcactcttgttgcccaggctggagtgcagtggtgcaatctcagctcgctgcaacctccgcctcccgggttcaagcgattctcctgcctcagcctcctgagtagctgggattacaggcgcccacccccatgcccggctgatttttgtactttttaagtagagacagggttttgccatgttggccaggctggtcttgaacttctgacctccagtgatctgcccaccttggcctcccaaagtgctgggattacaggcgtgagccaccgtgcctggcccaagcccaggaattgagatcagcctgggcgacacggtgagaccctgcctgtataaaaaagaaaaatttaaaaatttaaaataaaaaaaaattaagtgagttaatatgtggaaagaatacctctggtatataggaaacactcaacaaatattagctattctttttcttggaactctgaaggtggcagacttgctccctcttcctgtgtggagagaagcccatgtactttatttgtggacagtcatctgtgattctcatgaatggctttgcttccttctcatgtggctttcacacttatgcagagctttgttagaacctctgctgcatcctgcagtgtgaaatttacattcccacctctccatctccattggtttgtgagcccttcaaaggcaaaaattgtgttctttggttttgttttcctagggccttgcacagcacttgccactcttgattaagcatgcttaagaaatgcttgttgagtgagtgcgtgaaaggggggccaataacttgtatggttatttgtacgccatcaaacttttttttttgagatggagtctcgctctgtcgcccaggctggaatgcagtggcacaatctcagcgcactgcaacctccgcttcccgggttcaggcaatactcttgcctcagcctcccgagtagctggaattacagtcgcgcaccaccatgcccagctaatttttgtatttttaatagagacggggtttcatcacgttggctaggctggtctcgaacttctgacctcatgtgatccacccaccttggcctcccaaagtgctgatttacaggcgtgagccaccgcacctggctcatcaaacgtttgatttatcggtttcctagcatataaactagctgcgaagatgtgtatttttttgagaagccatgtggagagagtaggggacacagaatctgctcttcaggcatgctgacagcaaaaagtgactactagtaggccatgagggatggaagagagaaatactataaaaagcatagttgtctggggctatttaaggaagacacaataacacactgcacatcccaggacccctttcaggcatcactataatagcatggtgtaagaactgtgtcctctcagtcctgttcagcttcagccactactatcctttgtctattaatacagcaccaaccacttggtcccaaaggaacgttctggcgagaaatgtgcagagwgaatcagttcgccagcaggtgcgattctggaattgtttggctgccagagacccggtatttggtgtgtccgtcattactgggtgtttgtgtccccaagccagagtcatcatgttgaccatcctcctgaactggggctctggttggattcccacctgtttacctggtgccttaacgttcttctccacttatcttgccatacccttcctggagaggaaagaagacaattaatttctacctgtagtttgggttctccttcaagagaaattacaaaactgcctgccttggacccagagctttccttctttaggatggtttgggcctgacagcctgaggtttgaatctggtctccaccatttcctagttcatattcactctcagcaaatatttaactctctaagcctcaaatttctcacccacaaaatagggataataatatcctgttgttgtgcccttagatgacgcatatggcatctaacacatacttagcatgtggtttagtctggcacatacttagtattcagcaaatggtagctgctacccctcccacggccatgtcccagctactggaatagctcactctggatattgttcacttctggaaccaagcccacctttgccaggcagcctcggctaatcccttagagatgtccccacagcaagggaatctctgctagcatgccttccatggcctgttttgacaagatgtttataattctccaggttgttaagaaaaggttttatctttaaaatgtaaagccatcgttagctaagctagcttaaaaattctattgtatactttagaaatatttccacaaatatggctaaaataaatgtaaccactcttggagaggcaatgttcatttatcttgaaatggaagtgcctcacttttttttttttaatggagcctcaatacagtctgaaaaccaggtggaaagtgtttttcagtatcaagtgtggtaaataagagctaactgattcaaattacttttattccttatcatctgatatgaaaatctgaatcatcttgaaatacagtggtgccccttaaaattgcttttctgtcttatattcattcattcatgcagcaatttagggtttattatatacaaggtagtaaggtgggtagatattcctgtttgtgactgttgaaacattttttattaagtttcaggtatcatacacacatacacagatacacacatgtgttttgttttttcccctcttattaaaacttaacacatgaaggtagataatatttcaattgtacttaagcactatctaaatttgctttatgtgcagcaagactatgatataaccttgtaaatatctaacttcattaaaaacacacatttatacagaataggttaactctgtggctctctgagcaatatcttaacctttagtctggaagccttaatgacacactaatatctaatattgcctataacttcttcagatccggaaagaaaagtgatataaatgtcattatgtcttgagactcacctaaatgcaatctttaacatgacttactgagcccccaacatggtaaaagatcttagcctgaaaacactccttgtcaaatcattgcccatcatagtgctgagtagtaatctctccaggctgaaagatggcatgccgtataacaaatgaaagggagctgacactagaaagaacattagtgaaatcaatatgattcaaccagagacacagactccgttaatggtatgtcaatatgaccaattatttccacagcactgacatcatgattgtatttttttcttcatctttaggagagaacagttttacttaaccgtaattgttgaattatagccattggccgagaaagtcttggatgttttacattgttatcgttaccagtttcaatttgtctttatttgatatctaaactcctgatcataacttaccatagtttgaaggttaagatcaataaagtggaccaaacattcagtgaattgtgaattctagaaatgcctgatggtatccactgcccagggaataagatgtaatggaagcaggcagaacttgaagagcaatcagagattgtaaatataatcagaattgaattcatatagttattttgttaatttctgcttcctcaactagactgtaagcttcttaagtgcagggaagtatatattttacttgtcattgtatttgtcattctatgccatgtctatcacctggcatagaaggcactggatgaatattttttgaataattttctaacttttcatgaatttttgttcaattttctcatattgggaagctgccagttttagagttataccaacactgccataataaaaaaaagctgtcaagatcaggaaactgcagatactttygcaggttccagaaccagcaaaggaatgccccttaccatacccgtcagcacccatgaagtaagggaatggacactgcaacttctggtagcaccatcacagagaagggaagtgccttcgtgagcaggcttgatggcagcaacagccatccctcggtctcacatccccctttgtaatcccacaggcatgtgtctgattggtggattctaaaccaccctcagaaatgtagctgcaaaggagtatgaaatgtgcaggttttaatattccagcctctgctggaaagaaggcttacagaaagaagttggaatggatgttgagtgccaatctactgtatctattctacttccttaaagcttacattccattaacagtctttggaagaatgtaatataggcgaagatttttcagtgccaaaaaataactgacatggataaatgacatgaggcagtgattaagtatgggctccagagtgatgctgtctgaagtcaaatcctcttccacctctatgggaatccatttccatatctataaaatgggtatcatctttcttcaaaatatggctttgaggrataaataagaaaaacagtacgatatgcctagcagagtgcctggctaatggtaattcatcaatagaggttagctattatacttccaatccttattcttcaaatttttgttttcctggcaggaaacggagattctttaattaaaaattaaaatttgaggttgggtatggtggctcatgcctgtaaacccagcattttggcagacsgaggcaggaggatcgcttgaattcaggagtttgagaccagcctgggcaacatagcaagaccttgctctgctaaaaacaaacaaaaraattagccaggcgtagtgatatgtgcctgtggtcccagctactcaggaggctgaggcaggaggattgcttgagtttgggaggtggaggctgcagtgagctatgattgtgccattgcactccagactgggagacaaagtgagactctgtcttaaaaaaataaaaaataaaaaatttgatattttataattttaaattatggttttaacatatttagttgaaaaggactcttccaaagcctcatgaatatctcttacacatgttaaatgataacgcaggggtcttgagttctgaggattgttccagtatttctacttgctttttattagctccacacctaagcaaccccaaattgagaacgattttcattataatagattttcatataacattttattatttaattcttcctgccttcttttcattaatttatgcagcatttgagggtttattatgtactagggtactgaggtggataggtacttctgttttatttgaatgatataaattcttatttctttaataatatttttattataagactaatacatgtttattgtggagaatttgacaataaacaagtgtatagagaataacattaaatcacctataatcccactctacagggctgttggtagcaaagtgatattttcctctagtgtttttcttgcatatccttactttttaggaagacattatgtattcagtttggtatcctgcttgttcactcaagactgtattatgagcatgtttctgtgccattaaatattcttggaaaacattttaatggcttgatagtcttttattatatgaaatataaaaatataaaaattgctgtttcccgttttccagtattgtagtcatgtctttggaacatagattctggtgctcaccaaatattccatgtggccctttctatttcctgccttcctgttttgttgagttagaatcatgagactgatatgagtcagtggcccatgaacagaatccactagtaccactcacaggccaatggtcagaacccaagacccctgcgttatcatttcacatgtgtaagagatgttcatgaagctttggactagtctttttcaactaaatatgctaaagccaaaattaaaaactatcaaatttcaaaattttttttttattttctgttttttaagacagagtctcactttgtcttccaggctggagtgcagcagcacaatcatagctcactgcagcctccatctcccgtgtgtttcctttcttcccttcttctcttagtgaaacgaacttagaagtggcatatggcgaatgtcacagctataagttggaggaggaactaccagtctactttcaactttacctagactgatgttgagtcaaatcattgagacttacagatttgtctattatagcagcttgtgttaattatcctgataatgtatagaatgtatcttgtttaccaatggtattgatttattgttatattttttaaggaatctttgcagttttaatggccatgctattatgccccaattctcattagcgcacttaaaaatcagttctttccaccctgtaaactgaaaataaatcagaatatatggttcaaaagtgaaagactaaagaaagtttactaccacgcaatcctatctttgtctctttctcttttttattggcgtcaaactactcagtattttagactgcaaaatttccactgcrtggaggaaagtaaatggattgggattatttcctgcaggtaaatgaaactttatggtatttgttatggaggcaagtagggtactyakagaaagccaaatataacctgtccctccctatcttttccttagttgtgagggtcaaaggggcacattacagtctggattcagaaacccctttcaacagcacgtakatagttaaagagaaagattgttcttcaagggcctctaaggacaaaagtgaatccaytaacactctaggaagcagtgtgactactggaagaaagacattcaagaggtraaatggattttakaaggtcacasgagccaattgtcagtgtttgtactcttcatcaaaattatttttaatgagctccctgacaactgcgcatcctgacagcacgggtgaagtggctcatctggggtcatgcccgtgcctgacactgccctaattagctgacactgctctgctttgctgaagcacagggaggtctctcgagaaagatccagaagggaccatgataaatcggrcaaaatattccttgagagcctgaggttcacatgagagctcagaggaattacaataaagatggattaggaaaatggaatattaggaggggaaagactagagttactagaagagatatttgaaaagagattccaggatttactggacaggtttgtttaaaagtatttgagttggccgggcgcggtggctcatgcctgtaatcccagcactttgggaggccgaggcgggcggatcacgaggtcaggagattgagaccatcctggctaacacggtgaaacaccgtctctactgaaaatacaaaaaaattagacgggcgtggtggcgggcgcttgtagtcccagctactcgggatgttgaggcaggagaatggcgcgaacccgggaggcggagcttgcrgtgagccgagatcgagccactgcactccagcctgggcgacagagcgagactccgtcacaaaacaaaacaaaacaaaaattagctgggcgtggtggtgcgtgcctatagtcccagctactcgggaggctgaggcaagataattgcttgaaccagggagtcggagattgcagtgagctgagatgcgccactgtactacagtctggtgacagagccagactstgtctcaaaaaaaaaaaaaaaaaagtatttgagttgatgctcygtcaaaactcatttatcaagaggatttggttttaggcaacgaaaccttgcctcaaactcatttccaactcagcgggtttgaagatgtgcaaggattcatctgttcaaaagcaaaacatgataaaacaatgcagaacacctcaaaaccatagagaagtacctgtggaactgttcaggagtcctaaaggggctcattctaagtggaaaattattgttactctttcttgagttgtttctgtgaattacgaaaaaggcctatctcagtgaacagaccatgttgatcatactatgaagcagagattgtagagattttattaaactgccatacttctcagttcagagctgttttactccttctccctgggacatttggcaatgtctggagacatttatttatttatttatttatttatttatttatttattttttatttattttttggagccagcgtttcgttctgtcacccaggctggagtgcagtggcgcaatctcggctcactgcagcctctgtttcctgggttcaagcgattctcctgccttagtctcccaagtagctgggattacaggcgtctgccaccatgcctggctaatttttgtatttttagtaaagacggggtttcaccacgttggtcaggctggtctcaaactcctgacttcaggtgatccacctgcctccgccacccaaagtgctgggattacaggtgtgggccaccgcgccaggctatctggagacatttttgattgtcacaactggggggatgcttctggcatctagtgggtagaagctagaggtgctgctaaccatcctacactgcacaggacagccaacaggaaagaatcatccagtctcaaatgtcggtagtgcccaggctgagaaagcttgagttaaagtaaacctgataacctgtatttaaatgaataaaagggataagactaggggagaataaagctgtccacatttgtaagcctctaccaagcacagtgcctgatgtgggattacagacaggcgcctgtctcagtgagatcatagcatcagtaatccctgtaccgtatgtagtcccagattggaatccttgaccgaaggcaagttctcaacctctctaagactcagttacaaaaamgagggcataatagtgtctcttgccttataggttttggtgaaaattgaataagaaaacatcagtaagkatgtggcatggtgcctgacaatctttagatgcccaataagtggtagctagtatcmacatagaaataaaattgaaaagatacacacacaatgtttgcattggttatccttgggtaatgggttttaactttgtttcctagattttaaatttttccaccataacacgtattgcctttataataacataattcacktgttttaagtcgattcaggaagcttctgattmtatattataaattctaaatgttcccttctattttccagagtcaagtttagattatctagatcatgaaataatcagatattttcagctattacctaactcatgagtgtgtggaatgctgtggctttctgttattagaatgaaataaaaatgaaaaataaattgcttatcaatattctgagatagcaaagcaatgatgcatttatgatagactggatgataggatttgtttttgctgaacttattcatacatatttgtgttttgcttaractttaaaattgtttctttttctatgagcacatagcaataactgggaagtggctgagaatcattcttttttttttaatttttgagacggagtcttgcactgtcgcccaggctggagtgcagtggtgagatctcagctcactgcaacctctgcctcctgggttcaagtgattctcttgcctcagcctcccaagtagttaggactacaggcgcatgccaccatgcctggctaatttttgtatttttggttgaaatggggcttcaccatgttggtcaggctggtctcaaactcctgacctcaggtgatctgcccaccttggcctcccaaagtgctgagattacaggtgtgacctaccgcgcctggcctatcattcttatttgacagggatttccctattgctgggtgctaagtgattgagggaaacccagaaacagctttgtgttgtggttaacagcacagattctggagccaggcttccttgtaccaaatctcagccctaccgctaactagctttttgacttcagtgaagtttyttaacttccttgtgattattttcctcatctttgaaaaaggaataatgtcctcaacaggtaacatgaaggttaaaaggagatggcgtgtgtgtgtrtrtgtgtgtgtgtgtgtgtatacttgtgtatctcatccctaaacaaagcctggctcatagtaggccctatataagtgcttgttactatgattgaaagttggatatatttttaaatttctatttttcaatcttttgcaaagaaggaaaacacaactttgataaaggtaattttggtagacattctctaacatgtaaactgcttgtgtaaactgggaaataccagattgctctaaattaattagttctatatttgttcaattacactggattgtgttctgtgtttttattttgttttgtttcttgttttctactcacatggtgagacttggcttgggtgagtcatttctttgaagaccctcagttcatactaaggggcaaaagcagatgagggtccagggcaaggcatggaagccaactgctcagtggtttcaacccgggcttcatgggaaaaggatgggagggtggggttgggtgtccttgagattgaggtgagaacagttgcctgagaacaggaaccagaaagtcctaacagcggtcgatcactgataacatttgtgctgaaaacatttcaggcccaaactgtctcagccatgctgagcaaggcaggaacttgggatgtgaaccactctcttaatcgggtccactgtgtatccaaagttgacccttgagggccaggcacggtggctcactcctgtaatcccagcactctgggaggccaaggcaggtggatcatctgacgtcaggagtttgagtccatcctggccaacatggtgaaaccctgataatacaaaaattagccaggtgtttgtggcgggtacctgtaatcccagctactcgggaggctgaggcaggagaatcgcttgaacccgggaggcggaggttgcattgagccgagatcgcgcgattgcactccagcttgggcaacaagagcgaaacttcatctcaaacaaacaaacaaacccaaaattgaccattgagaaaaacccttgctttgtgcccatctgttgtgaggagatgggacagccttgcccctgcatggaatctgctcaggagctttagtttctgtagtagaaggtgggctctgtgattaactctgtggagtttaaggatctgggttcagtgagcactcaggctctgatggggaattgtacctggaacggttaattatctcgtaaaaagatcaatggaaaaattattttcaagaaaaataatagataaaatttacctactctgatacttagcacaataaatatttattgaactgttgaatcttttctaggtatttgaagttttattttcaggctagtggcttttgaattctgccacaggagaattcagttctccttctgaggccttctgaggaggggagagagtgaaaggaagggaagaagcagcttggcctggacccattttttccattaattttttttttcttagtagagacgagctctctgctatgttgcccaggctggtctcagactcctgggctcaagcgatcctcccgcctcggcctctcaaagtgttgggattacaggcgtgagccactgtgcccagcctggacccattttatatactagacttttctagaaggttctctttgaagaaaagttttctctgctaaccacactttgaaaaattatttctgtaggaaaatgatatattatccttygataacctaggtcgctggacagcttttgttaaaaagttctacccatgtggctttagcttccaaagatacacttcctttttttgagacagagtctcactgtgttgcccaggctggtcttgaactcctgggctcaagtgatcctcctgacttggcctcagcctcccaaagtgctgggattacaggcatgagccactgcgcstggcccccaagatacactttcaccaaactgtgtttcaaagttatgcttttaaattgtatttaaagttcatataagaacaggcttagctgtgacactgtagaggcgagaatgtggagttgacacgggtccttttcacacttgttccccacacagggcccacatgaaacctgtccctgagtttaatcctaagaaaaaccttgtttcactagcaaataattcccttctctgagaaggcaaattaattattttatttccaactttctcttaggcatcctgaaattytgagctcagtttcatgctctgaaaaagaaaaaataactgctagagtcacagaaatggtattgactttttggattggaatatttgttttctctgttccttacctgtttccccctatttttcttacttcctttccattttattttgtatgcctctttgtaagctgccttaaatgctttttggaatgaggcaggatayacattcaataaataaaatatgtytgagccacttatgaacaaaaccttyttgggccagagcctaaacattacttatataaaaagacctgattcctcaccttctacaacaatattatttagtcatttctctgcattgtactcaactctttaaaggttatagaattgtagttagcgtattagaaggctcatggatmtagattmtatgtcctcagcaggtgaagtcttttttacacaatgccactgtacggattgtagagttcttgggctggcataattttatgtgaccaaaatttggcaaagggtcttatcaktttgaggagagattaktggagcattgaatttcasagtttgaaatgacattagagattatctggtccagtgattctcaaccagggagacatttggttatttccggagatatttttggtcacaactgaggtgggtgctactggcttctakggatggaggtcaggaaagctgccaagaacccgacagtgtacaggacagcccccacaccagcatgtsactactgccgaggacgagaagccctgatctagccaatcctgtcatttttcagactccagggagtttgtgacctgaccttcaaatataagatttaatatttaattgcccaaattcattcttaaaatatagcaaaatgatgagaaatttcccttcaaaactgagaacaagacaaagatgtctattatgatagaccgttcttagaagtttactgctcctcctggggatgcctctcaatagagaaattctacattcccgcctgttgaaagcagacatggttacttgacttgtttgggcctatgaaatgtgaacasaggcgacacacgtcacgatcaggtgggagacttagtaacacatgcctggtgtcccatgcccttttccctctgccagtgttccagggcgtggcaggactgccagcctggtcttggagtcacagctgggccccgaaggcgatgctgtgggacctggaaataaagctttgctgttgttttaaaaatggaatcacattgtaaattaggatcctggggagcgtggcactaggtattcttatgcagagctagatggtgatgctttcctttccttatcacttcaagtctgcagacacagccttcagggcgttcttcttctgtggttcctcagttggggcaccttgtctggagtacacagtaaggctatgccacagtcctgctatgactgagatggcaatatgagtgcttttctttgttggtggtttttatatttatgtttaaaaaattataaactaggctaggcacagtggctcacacctataatctcagcactttgggaggccgaggcggatggatcactctaggtcaggagctggagaccagtctggccaacatggtgaagcccggtctctactaaaaatgtaaaaattagctgggcatggtggcgtgcacctgtagtcccagctacttgggaggctgaggcaggagaattgcttgaacccaggaggcggaggttgccctgagctaagatcatgccactgcactccagcctgggtaacaaagcaagacttggtctcaaaaaatacacacacacacacacacacacacacacacacacacacacacacacacactaaaactgctgacattgagcattatacagtaagacagattttccttccttgtttctttgcatcaattttctctgcctctccctccgttccttttctgtttgcttctactcaggactgggcacgaatgcacacattgctgtctggcttgtatctatgtggtaagtctagaatgatcagttactgaaagaagagggaatcagtgctagtgaaggatataggttgtggttaactggagttcccaagtagctggatcttttgtgacagggattggctagtttggttttataccagatactagttatatagagatgaaaagacaagtttccttcactcaaaggaaccttagcttagagtcttgcagggaaattgatttgcaagcaagctgctttgctcccttactctaaactcacacttgaatctctgatcttaacactttgatggtgaagaaaaagccctccagagaaaaggtagtaagagatccagaatctagagcctttcccaaggcttcaggtagatctggttgaattcaccttgttctctcttgccccctattctcttatcagtcattcccacagctttaagtgttttaaaggagtggaaagctcccaagactcaggcccttatgtcactcctgacatgcacttataggggagtccagagtgtttagtcctccagggtttttatgaatggtcagtgttactctcagaagatgctgacctgggtaggacaggttgttcatccattcatttgtgtgcttaccatgtgccaggcacagttccagaactggggatccactgctaaataagactgataaggtctttgctcttaaggagattccatgctagacattaattatattaatcttgactccagtttatgccctaagccaagctatcctctattctctttcggcatttttcagttgttaaaccagcatcaccaggttgacaacataacccaactaataccaacaacataaagtgcctgagttcaccagcccgctcagctcccagctgactgccccggagtcccgccctgttcaggcagaggcagagtttttttttttgttttttttggagacagcgtctcactctgtcgccaggctggagtgcagtggcacgatcgtggatcactgcaacctccgcctccagggttcaagcaattctcctgcctcagcctcctgagtagctgggactaaggctcaccaccacccctggctaattttttttgtttgtttttagtagagatggggtttcaccatgttgcccaggctggtctcaaactcccgagctcaggcaatccgcccgcctcggcctcccaaagtgccgggattacaggcctgagccaccgtgcccggcccaggcagagttttaattgaccaccatccyttgtccgactcctagaaactttcacctggattccttaaagtgatgccttgctgacctgattggataactcagtattcattgctgagtagctgaggtaagcgtgatgttcacttatttctcagctatctatgagagctgtagcttacattgtgatcattctggtaaatgttctctaagaaagaaaacgaaaaaataatggctagagtcatgttcacctagttttaacatctttagagttttgcttcttctcagttcagtagctcaaagagagaaaaaacacccaaagacagcaattcttcactctaaacccaatattcttcaactttctagaaattattagccacttaatttactttgattttcatctctgaaaaagtattcagacttatatatagttgccagatgtgttcatcaaacacttctctaagaaatttgtatatttttggaattcagtcaacattttttggataaatgaatgtgaacactttaggaattgcttattccacaaatgatytcttaccaagatttccagaaactattttcatattgaaacaaaaacaaaacaacacaccactctgcttcttcccacagagttctgagacagcttttacataatgatcttgaacatattgtaatcttgtttatgacagaaatgaaaagctgtcatcacatttctgttttggagagttcattgttttccctgtgaattcataggagttctttgtctattataaatattatcactttgtcttgaaaatagctttcccttctgtactctttctctgtgggctttatgcatcttttgtcttataaaatgtatgatgtctacagagtcagatgtatctgttttttcctttttagcgtctttattttttgtttaacacaaaaacatctgccagttggtaagttatagaaatattcttaaatttcttctaaagttttaatattgtatttttcagttaaagtgtaatccactgagccaggcgtggtgacatacacctgtagtcccaaccacctgggaggccgaggtgggaggattgcttaagcccaggagtttgaggctgcagtgtacaatgttcacactactgcactccagcctgggccacagagcaagaccctgtctccaaaaaaaaaagagaaaaaattaatccattggattactctttgttttcttctagttaaacatccattgtgtcagcataatcaaactatcttgccctatgaaatgagttgctatctcttgtctatattcacatcttttcccagattttctgttctattcccactgatgtatttacaggccagtatcacaacctgtgaaagcattgtcttcagtggaaattttaaaatagtaattactcctttcattatttttttcataattttcttggttatttccagatctttacttttcaatgaacatatttttaaatcgcttaaatcattcagatctgaaacctcattggcagtctaattggagtgaatcttctgattcacaagcatgaaatgtatgtatttctgtttattcaaaccttcttttagtattttaaatatgcgttttgttgtctttttcatgtaggatctatacctttcctaaatgttttatagtttcttgtaaatagaattttaaaattcccattctatctggttattgtaactataagacaaagctattgatttttttcctctttattttctagcatttattatttgcaagcatttattagttgaccttttggggtctgttttctcttttgaatgtgtaagcacaaggtagatcatgtttatcttgtttactagtttatccccagcattctggcaggacaaatgaatgaatgcatgaatggatatctgaaaaagcgtttgagaggagattcaacaatctacactactttcccttttcttctttttaccttgtgtttctaacacatactaagctttttttctttttcttctgaaatggggttttgctctgtcacccaggctggagtgcagtgtcatgatctaggctcactgcaacctctgcctcctgggttcaaacgattttcctgcctcagcctcccgagtagctgggattacaggtgcacgccaccaagcccagctaatttttgtatttttagtagagacgggatttcgccatgttggccaggctgctgtccaactgctgacctcgggtgatccacccacctcggcctccccaaagtgctgagacgacaggcatgagccaccaatcccagcccattctaagcttttaacatccttagattactgttccaaatacgttgggaaggtcccccaattttttccttaactttttaaaagcaactttattgaaatatattttatatatcataaaaatcacctatttcaagatgattttagtattcaataatttttagtagctttactgagtgatgcaactgtaatgtaacgatagatgttcaggtttagaacgttttcatcctcctaataggatctctcatgtccatttatagttaatccctgttcgcacctttacccctattcacaagcaatcgttaatttacttcttgtttcagtggatttgcctgttctggacatttcatataaatgagatggtaccatatgtgaacttttgtgtctgactgctttcgcttagcataatgttttcaaggttcatctatgttgtcgcctgtgtcagtattctcttcctctgttgctgaataatattcccttgtatgcatgtactacattttgtgtatctgttcattagtttttggacatgtaggttgtttctactttttggttattatgagtaatgctccagtgaacttcacatgtaagtctctgtgtggacatatgttttcatttcttttcrgtaggtacctaggagcggaattggtggttcattttatgttttttgagaaattgtcaaactattttccaaagtggccacaccattttatatttctagcagtaatgtatgagggttcctattcctcttttcttaacatttttctcacagtttattgatgtatgattgaggtatcatttacattgaggtataacttacatatgataaaatgctcagatcttaagtgtacagttcaattatttttggacacatgtatacatgcatgtatacaaccactgcgtcaatcaagatacgaaacatttgcatcattctagaaagtcccttgttccttgccctcagattttgatttctatcattctatcatactgttttgatttctatcattgtagattagtgtttattccagaatttcatacaaatcaaatcatacagtatgtactcctttgtgttgtcttctttcactcatcgtaagggtttcgagtttcatcagtgttattgtgtttatctcagttgtttgttcctttttattgctgagagcactccattgtatgaatgtcccacatttttgtttatccagttacctgttgatggacatttgagtcatttttcatttgtagttattaggaacaaaggtactattaaacatttatataccagtctttttgtggacatgatttcatttttcttgggtgaattcccaagagtgtaattgctgggtcatagggtagttatatgttacttactgttttttatctagtattaagtcactttacaaaattctttaagaattacagttttttggccgggcatggtggctcacgcctgtaatcccagcactttgggaggctgaggcgggcgcatgccttgaggccaagagttcaagaccagcctggccaacatggtgaaaccccatctctactagaaatacaaaaattagccaggcgtggtggtgcgcacctgtaatcygagctacttgggaggctgaggcatragaatctcttgaacccgggaggtggagattgcagtgagctgagatcacaccatggcactccagtctgggcaacacagctagactcagtctcaaaaaaaaaaaagaatgacagtttctaaaatatcgtgtctttgattttctaaattattatacaatttgctgataggtataattttgagttagatctttatctgttgatctggaggagtttcygggactttttttttttttaaagaagcacacaagttgcccagaaatgtatatagtataatccaaattttgtaagacaaacaataacatgtatgtatatgttcgcgattctataggcaaaagaaaagatgtgaaagatgttcactggcatgctaaccatggtttcgtggctggagtggcggaggtggttaaggggaggtgtagagggttgagtttacaaaaaaaggaaacagggataaagaaaacacattattaaagttaaatgatttagtagagtataaatatataaatatatttatatatttataaaaatatataaatatatttatatatttatataaaatatatataaatattttaatatatatttaatatataaatatttataaaaatataaatatttatataaaatataaaatatttattgcaaaaactttttaatgataaaaatattggaaccagcataaagatgagcttaccaaagttatttgcagctgttaaaaatagtgatatacgtgtgtttagaatgtatgttaaattcaaattcagattgcaaagcagtatgcattctatggccctgactactttgtgctaatatgattgtgattatgggcatttttgtttactttttaaaatcttatgggggaaaaaagcaggagttatttctagaagtatgaatcactgaaacacagtaatattccttaaattatacttttcttaggatagctgtaattatataagatttagtcaaatctttaattagatggtaggctgattgagggtagggatccctcaagattctatttgtcaccgtcagagctcagaataattctgactcattcataacatgaagagatcaccgttgaacacagtccataggaaagtaagatctcagcattaaagagatgcaggtatgagtgttaaagaagagcaggccctggtcagagtattctccaattgacgtcaatcagttctccacttgattgacctggagagtactttgacagggcctgctcttcatttacataggctcggtgcctaccttttgcagctgaacaggctcggccccagttcttgctgggttctaagctacagtttcagggaaaaggcagaaagccaagatagggcaggaatgggatgaaaggggactggcctgttggctaggtcagcaaatttgtctgtgatttacagcactaagctcaggatttgacttgattagaatttgattgcctttcatttgattcaagttggagccactgctccgggctgttctatctagtggatggaccatagaagcagggatctcatgacttagcaatattaaaacctcaggcaggtggcttgttggtctgagcagcctctaaatttgtacaaaagcctggtggctggctgggttggtaaaaatggcagytgtcctgcatgctgacattgggagttactctgcactgctgcaggctgtcctggcacactgcaggccgggcatcatttcatggtggaggacgtcactcagttttgcatgaggctcttgcatcacatttgtatttaaggaattcacaccttattttagggaaaacatctgttccttggttaaaacagcattgcacttttaacagagcggccacctttttccacatacgataggacaggttttggatatatggagtattaactgaaaagagcactatatatttcatagttctttaaagaccattgatatgtaaatcaatgtgtaagaagatatcgtttaagaggggttatggcacatggtggaaggaatgctgctttgcatttatcygtgtgaagtaatctgcctgtgcatctgaagaaacagcaggccccgccgcaagtgatgaagcagttctgtggagaaacccatttacaccagtttccagatgctattccaccagaaataattccaagaatatacttatattttaaataaatgataaaatcaatttccagatgaagtgtacattacaaagagaaacttggtattattatgtattaatccatattaactaaagttgaacctgacatcaaaatattgatcccttcttaaaatagacaaaaatactttragttaaattgtttttcttcctatttgtgctagccggtgcttaaagtctaatgatgtgataattgaatagtaaaggaatctaaatctctactttcttgattcccagtgtgctaactttactaaaattgtgggaataagcaaaatatttttcatagcagtaataaggatttttaaaaattatgtgacaattgtgtattagactgaagtaattaatacctttgtcacagggaccgggtgcaatggctcatgcctgtwatcttagcactttgggaggccgagacaggcagatcacttgaggtcaggagtttgagaccaacctggccagcatggtgaagcctcatcttactaaaagtacaaaaattagctgggcatggtggtaggcacctgtaatcccagctactcaggaggctgaggcaggagaatttcttgaacccaggaggcaaagattgcagtgagccgacattgcgctactgcactccagcctgggcaacaaagcaagacacgctctcaaaaaaaaaaaaaaaaaaaattggcatgagactaaagaggatttaaggtggaggatttcctcgcagtaggtaaagaagcaaagccctgtttattcagagcctgagctcagacttgaatttcttttttagactttcattttctccctttatgaagtggcaaagtcagttaagtatagatgtggccgtctatgtccctgarcttctgggttcaataatcagctctgcgactcctcttaaagaatccagaggatttcctgcctggaccttgaagtcacctccccgctacatatttcccagctctggttttccacctcctcaggatgaatgtcttcttgaatgtcctctggaagagtgtcagctgcacttaaacttccatcaaaagggggactcagaggccttaaaataggcatcaggtacacattctatttatgattctgggattaggcctattttttggcatttcctgtggtcaaatttttaatttctgaactttatcggatttccaaagataccgtcccttggctgtcttcattgatttcttcaaaggatttcctcggcaaagttaccctagtcttaactggaagagcatggctcccttaaagagtctaaaataagccttttcctttagtgactcccagctctggtcttgtcaggttscatttttctcctaaccttcttctttcctaatcctcactcactaattcaaaaatgttattctgccttccagaacatcacactttgtaaacattttgttaataataaaagctagcattccttgaatactggttttgtaagctagattatctcatttaaccctgtgatgatgttattcattaaggagcatttgctttcttaggtctgcaacatcagtcactcctcgcccatctgtatcccagcttttaacagtttgttactgctctttcctatcatattctcttgtgggcaccaaattttyttttttaattttattgtatctttagaggagttttaggggagagtaaaaataaatatatttttcaatccatctttacccagaaattgaaatattactttttatagtagaaccagaaattaacttaagaatgtttttggcatttggagacatgcatacaaatactaaagaggtgcttataaaaaaattacacttttggccgggcagagtggctcacacctgtaaccccagcagtttgggaggccgaggggggtggatcacttgaggtcaggagttcgagaccagcctgcccaacgtggtgaaaccctgtctctactaaaaatacaaaaattagctgggagtggtggcatgcgcctgtaatcctagccaccggggaggctgaggcaggagaatcgcttggacctgggaggcagaggttgcggtgagcagagatcaccccacggcactccagcctgggcaacagagcgagactctgtctcaaaaaaaaaaaaatttactttttattataaatttgtcatatttaatgccatggtgcattatagttctggctacaaaatgaaacaatttatttttaaacttgattttttttctctaacatttgaaatcattaaaagttactatcaggagcctctcattttatgcatataaatgcaataaaacagctggttatcttatgctctatatgaagggtaatattttaagtgcattttcaaattcagctaagctagtgattctatcagaaaatatcatttttcactcactggcttttgaaacataattagattttctgagcaactgttgcttataattggaatttgcttattatmattttaacagagaaaaacactgacctatgtaattttagtgcaattaaatttttctccttatgcctgtgtgtacctcatcaattcagcaaaagcaaaacctgatctagaagtccctgtgcagcagattgcagggaaagaagcagtcagctgatttgtctgggccataaaaccgtggtgtctggcagaattgtgatagtaattgctctaagatgcattctgtttacaaagactaacattgcagctgcttttaattagctgctagaaatgaaaaactgtcagggtatgcttgttagatctacctgaatttattccattgcaaataaagcagaatttaaagaatatcaatgtaaaacaggaaacttctcattgtaaaccaagttcagaaaggtggtggtaaatatctgaatgtatccttttggttttatgggaagcagaaaaacctgatttcctatgacacagaccattgcattctgtattgtattgttttcttttttctttctttctttctttcttttttttttttttttttttttgagacacagtcttgctctgttgcccaggctggagtacaatggtgcaatctcagctcactgcaacctccacctcccgggtccaggcaattctcctgcctcagcctccctagtagctgggattacaggtgggcgtcaccatgcccaggtaatttttgtatttttagtagagatgggctttcatcatgttggccaggctggtcttgaactcctgacctcaagtgatctgcccaccttggagtcccaaagtactggaaatataggcatgagccaccatgccccgctgttttctacatttcttttatatgtaaatttctgtcctgagcagatgattcacttccagagaaaaggatctttgcattccctgctgtctggcattgtgcataataaatatatactggcaaatacataatggtagtatttttatttataaaagtatgagaaattgctttgagaaaatcaaagggttagaaataaaagaaaattaaaagcattgttacaatttatcatgaaatttagtgagtattacagagctttgtacactgggttagaaaatttgtgtttttttctttttcttttcttttctttctttyttttttttttttttttttaaagagatagtgtcttgctctgttgacaaggctggaatgcagtggtgtgatcacagatcactgcagccttgacctagactcgagcaatccttccacctcagcctccagactagctggaactacaggtgtgcaccagtgcactcagctcattgttttattttttaaatgttttgtagagacggagtcttgctttgttgcccaggctggtctcaaagtcctggcctcaagtgatcctcccttctcggcctcccaaatcctgggattacaggggtgagccaccacacctggtcttaggtttcttaattttatttctctgtgtttctacaggcttttaggccattttactaataattacttttttttttttttttttagtttttttgagacagagtcttgctctgtcaccaggctggagtgcagtggtgcgatcttggctcattgcaaccgctggttcaagcgattctcctgcctcagcctccctagtagctgagattacaggcacgcgcgccatcacgcccagctaatttttgtatttttagtagagacagggtttcaccatgttggccaggctggtcttgaactcctgwccttgtgatctgcccacctcggcctcccaaagtgctggcattataggcgtgagccactgttcccagcctgctaatagcttttaaaaaggaatattgattttcatagttgtgtggcagacacagctgacaccactagctaacttaagcatactctgagaatgaccttgcatggcagatgcacctgacacaaaatttaagcataacctgaggatgaccctgtagcctaagaagaatgtgtattcagagttcccagctaataaatccaggaaggccaactgggagagtcattccttatctgtgagtaacatctgaaccctcagcccatcctgtggaacacaggccatataggggattgaggccctttgttttgggttagatagaggttgctagggggagggtgctaagcaagaatgctgtataaactgcatgctttttacaagcagttgccattgtctagtccagcccgtcaccactggaccaccctgtatgtaaatcctctcagtaaaccttgtctcatttactggctccaggtctctttgaaagcctctcaaacatggcgccatccctattgcagccattagagtccggcgtggcagtggtcaggactgttgaagaaggctgagaatttagggcactgtgaagtgtttaatcatttatcaaggtatcaatttagtgtctctcaaggaaaaaacatatttgttgatttgatttcatgccaacactgatgttttttgctactctatggccttgaatagtcaggcattgactgtaaccaaaaggatgtatggaaaataattgttttcttttttgagatggaatcttgctctgtcgccaggctggagtgcagtggcgcgatcttggctcactgcaacctccacctctcgggttcaagcgattctcctgcctcagcctcccgagtagctgggattacagacgcatgccaccacgcccagctaatttttgtatctttattagagatggagtttcaccatgttggcyaggctgctcttgaactcctgacctcgtgatccacccacctcggcctcccaaagtgctgggattacaggtgtgagccaccgcgcccggccaaaataattgttttctatccttagtgaagagctaaagagaatttccttagaataacagcaaaggaacttaaagtgttcagaaaaacaaagtgaggatggtaggaatcctttcgcctgaaactttggaaaaaggtggaygaattacaactaagtcatcttttagctttgctttcttgatcttccttcaaagtttatgatacctaaattctctcttcaactcataaaatgtgttttatggtttaatagaaaagctataagcacatgacaaaattagttcttattagctatatgcctacagaaccaattttgtggttttcaatatgatatgttcaattccagaaggtgttttataaatcagttggtaggaacctgttttatgtgtaagctgtgtccagatggatgtttctttacccttttatgtacctggaccaatagtaccagaaaccatgggagcataaccaccccacaagaactccacccctgccacagccttcactatttggcaggggaagcagagactctgccatcttcaagccactggtagagcccctttcacatgacctgggaggtaatttcacaagcaaagaagtctaaagraaaggttgtacctaatttaaattattgcttttgtcatattctctaccactcacaggaatgttttattattaatcacaaatcataagcaatttatactcttgattatttcaaaagagccacatccactgctatggttttgaaattattacattatacattattagtcagcttagactaaattatgctgtggtaacaaaccccaaaatttcaagggcttacaacaataaaggtttgtctttcatgctgtacattcattgcaggtaactaagacactattccatgtcactgtcattctgagatatgggctgaaggaacatcctctccctgaggctttgctagtgtttcagtagacagaaaaagaacgcaatgggaacacacacaatggttcttaaagcttcagcttcaaagcagcacatgtcatggcactcacactttacaaagcaagtcagacggctgctctggggacctgcagtcgtgcaggagaggggctcccaaatcagacagccactcctggcatcaatgacgcagggatctatagtccttttatgctgaggggtggtgaatccaccacagttaacaaaatcttgagacttgccataaacaaattctcatctgtttgtgtgatgaggtccagatgatggcccacttcagtagcaaagacagtgcactgtgctcaccacgccatttcatcttttccctgggttgataggaagatggccttctcaacccctttgcatctgtgtggggccaggagactaaacaccgccagttgattatgaggaggaatgacgtgtggcacttccagacctagctcacaaacgtggcaaaatccactctcccccaactccttgagcctgtctctccaaattgctgcatagaggcaatgtttccaggagaacctcacctggccagaaacatctgccttgaacatggttagaacaaatgaaacttttttgtattaaaacacwtgagattctgtggctcttcgttactgtgttaccctatcctgaccttgctttgtggtttatttaatgatgcacatttactagagtggtgtacattcaatagtgaggtggccacatacaacatacccctaaaacattgctgaaagtacacagccatttctactataaaaatataagtatatgagtgaagaactgatttttgaattttgctttaattaatttaaatttaagtggtcacatgtgggtagtggccaccgtattggaycacagaaccttaagcagtaggaagctttttgctacgtgatgtattataaatctttccactgtctcagcaatctaaacataaaaccaacatgtctaaatttcacactttctagatgatgaagagtcataaaatgaacagaaagtctttatatggtgtttcagggggacagttgtgacattggagtgctggtcaaagttctttattattttttatttgtttccaaatatggagtgcagaaaaccaaatggtggaatggacatttttgccaaagtataattgtggtctttaatgatgtaaaataaaataccatattcatttctgaatttttttcatcgtgaagtgtgtgagatgtgacttgacaactttgcaaatgtcgtgcctctgcttaaatctctgcattatatttatggaaatgtttgagatcctggaaaccatttagaggtgttataaaatactttatttcttgaggtccaaaagacttcaaaataggggctgagtgatataatggaaagaacactggattaggagccagaatatctgggttaygttgcctgctctctcactaactggctcagtgaatttgggcaggttatttgaactctctggatctcggtttcttctatggtgagtttatgggcttagattaatcacccacctctaaaattccaggtcttttcttttttctgactttaggtcaggtcttttcttgtgaagtattaaaactgagcccacccatgtcaatataacttaactctttgttccacgaaattcgtgcccaggaagataagacagtaaattaataaataaattcactgtttgctttaggaaagtcttgcaaatcaatttatcaggacaaacagtttgctcatctgggcaaacagttgtcttattaaaacaatatattgctcacctgggcaaacagcttgacaagtttgtgaaagaatgtcactatgcattgtggttttgaaaatgaatctatgggctgggcgcggtggctcacgtctgtaatctcagcactttgggaggccgaggcgggcagatcacaaggtcaggagttggagaccagcctgaccaacatggtgaaaccccgtctgtactaaaaatacaaaaattattcgggcgtggtggcgcgctcctataatcccagctactcaggaggctgaggcatgaaaatcgcttgaacctgggaggcggaggttgcagtgagccaagattgtgcccccgcactccagcctgggcaacagagcgagactccatatcaaaaaaaaggaaaaagaaaaaagaaaatgattctatggaaacagyagacactggggactccaaaagaaggacaaagatgtaagaactacctattgggtactatgtttattatttgggtaaggaattcagcaggaacccaaacctcccacatcacacaatatatccatctaacaaacctgcacatgtacccctgaatctaaattttgttgttgttgttgttttttgagacggagtctcgctctgtcacgcaggctggaatctactataaatgcatttttttttttttagacggagtctcgctctgttgcccaggctagagtgcaatggcacgatctcggctcactgcaacctccgcctcccgggttcatgcaattctcccacctcagcctcctgaatagctgggattacagaaacctgccatcatgcctggctaatttttgtatttttgtagagacggggtttcaccatgtgggctgggctggtcttgaactcctgacctcaggtgatccacccacctcggcctcccaaagtactgggattacagtcatgagccactgcgcctggccaactataaatgcaattttatttactatttaactgggagtagaatatcttagtatgtaagtctaggtatttttccaactagcacaacacttcagatagtttatatattggtgagattaattacaagattagtgagcacatcatagacattgagttaattatgacaaggtgaatgaacaaaaccaattttctgtgtcaaacgtagtttacaactttatgtaaacatttatcatatacattgtaagaaattcagttttctgtaaaaaaatacgtagtcttaagtttacaattcaaaacccatagaggttccctgacattacttgccaacatttaagagctacttattagtttgaagagagacagagtatgtgcacatttaaacttaaggcagaaatttgtgtctgttggcctaagtgttctttgttcactgggctctgaagaccatcaaataaaagtaattcttaacttagtgtttttggcactgaatcttgaattcctttttttttttttgagacagagtctcactctattgcccaggatggagtgcagtggtgcaatcttggctcactgcaacctccgcctctggggctcaagtgattttcctgcctcagcctcccgagtagctgggactacaggcgcccactaccatgcctggctaatttttgtatgtttttagtagagacggggtttcaccatgttggccaggctggtgcatcctgaattcttaaataaccagtaccaaagttatttttcttgaaccttctcactaagtatctttatcgcacatgagttctctctttaattttaactaaggcctaattaaaatattttcaaatttataatttttattttctcatgaagcctgataggaaaagctttgcccttaggctcatagttttacctgaggaaattcaacaatggatctgaaagcagcttattgaggacatgcagttagaacttaagaagaatgtgcctttaaggaggaataaccctgagaaatagttccatgacatttaaattctattgctctgacagagccattctgacaggttttaagtttcaaagttatcagacaatgtgcagacaacctcaccatctcctgagcttcacctcactgttaaccagcctatggtaatgtctttctctttttctcctcctcttcctcctactccctatccttgccctgtcaatattggatataatggcaggtcagaaatggggtgaggcatgaggtgaaaaccaaagagaactgtgcagaaggttaagggttaaataacatcaggcaaaccagccaagtataactagacattagaagttcagctctagtataaaagttaaaagacaaaagtattaaaaatcactatacctgcataatttgttgatgaatacacagtataaaaaggtgtaaagtgtgacatcaacaccatagaatggtgggtgggggataagtaaaagtgtagtaattttttttttttttttttgagacagggtcttgctctgttgcccaggctggagtgcagtggtgcaatctcggctcactgcaacctctgcctcccgggttcaagagattctcctgcctcagcctcccgagtagctgggactacaggcacgcaccaccatgccaggctaatttttgtatttgtagtagagatggggtttcaccatgttggccaggttggtctccaactcctgacctcgagttatctgctcacctccgcctcccaaagtgctgggattacaggcgtgagccaccgcacctggcaagtgtagaatttttgtatgcaattgaagttgagttgttaccagtttaaacagaatgttttgttttatgtaaggtccatggtaaccccaaagaacctacctttagtagaaacacagaagataaagaaatgaatcaaagcataccactacaaaaaaaaatttaaagtcacaaagcaagactgtaagagaggaagaaaggaacaaatgaactgcaaaacaaaacaaaatagttaagtccttaactctcaataattagtttaaatgtaaatggattgaattccccaaccaaagataaacagtggccaaatggattaaaagaaaacccaagatctaacaatattcgtgtgtacaagaaattcactttagacttaaggacatacataggctgaaagtaaagggatggaagaaaatattccacgcaaatagtaatcaaaagagagcaggagtggctttatttatatcagactaaatagactttcagtcaaaatctgtcacagaagacaaagaagatcactatataataataaagaggtcagttcatcaagaggatataacaattataaatatatgtgcaccccacattgaagcatctaaatacataaagcacatattaacagagctgaagggaaaaacagacatcaatacaacaatagcaggatgcctcagtacccctttcaacagtgggtagattatccagacagaaaatcaatgaggaaacagtggcctgaataacattatagaccaagtggacctaacagrcatacacagaccatctcatccaatagcagcagaatacacgtttttctcaaggacgcttggaacattcacaagggctagattatatgttgggccacaaaacaagacttaacaaatttaagaagattggaatcatctccagtaccttttctgatcataataacattagaaattaataacaggaattatgaaaaatggacatatgtagacattaagcacacactcctgaacaactacttggttgaagaagaaatcaaaagagagattaggaagtatcttgaggcaaatgcaaatggatacacaacataccaaaagttacaggatgcagcaaaagcaattctaagagggaagtttagagggataaaggcctacattcggaagaaagatcttaaacaacctaatttcacaccccaaggaactagaaaaagaagaacaaactaagcccaaagtcagcagaaggagacaaagattggagcaaaaagaagctaaggagacagtagaaaagatcaacaaaactgagatttgttttttgaagagaaacaaaattgacaaatcctttatctagctttaccaagaaaaaaagagagaactcaaataaatgaaattataaatgaaagaagagatacaggcataccttggtttattgcactttattgtactttgcagatattgcattttttacaaattgaaggtttgtggcaaccctgcatggagcaagtctgttggcaacgtttttcccgcatgtgctcactctgtgtctctgtgtcccattttggtaattcacacaatatatcaaagtttttcattattgkattatatatataatattatgtatatataatatgtaatatatataatacgtatataatatataatatatgttatatattatatgttatatgcaatatatgttatatataatatatattatatataatacatatatattatgatattattatatcacaatgctgattgtgatcagtgatctttgatgttacaatagtaattgctttggggtatcacagactgtccccatgtaagaaggtgaatttaatcaatagatatcatgtggtctctgactactacagtgtgggctctgctactgttctgactggcctttccctctcattgagcctccctattccctgagacacaacagtattgagattaaaccaattaataaccctataatggcctctaattgttcaagtgaaaggaagagttacacatctctcactttaaatcgaaatgtagaaatgattaagcttagtgaagaaggcatattgaaagcccagataggcctattgtgtcaaacagtcaagttgtgaaggccaagaaacgttcttgaaggaaattaaaagtgctattccagtgaacacacaaaagataaagcaggccaggtgcggtggctcacgcctgtaatcccagcactttgggaggccaaggtgggcagatcacaaggtcaagagatcgagaccatcctggctaacatggtgaaaccccatctctactaaaaatacaaaaaaaaagtagccaggcatggtggcacgtgcctgtagtcccagctacttgggaggctgaggtgggagaattgcttgaacccaggaggcggaggttgcagtgagctaagatcgtgccattgcactccagcctgggtggcagagcgagactctgttaaataaataaataaataaataaatagatagatagatagatagatagacaaataaagcaaaaaaacctattactgatatacagaaagtttgagtcttctggatagaagatcaaaccaaccacaacattccgttaagccaaagcttaatccagagcaaggtctttcttcagttctatgaagactgagagaggcagtgctatggaaggagagtttggtactagcagagactggttcatgagatttaaggaaagaagccatttccattacataaaagtgcaaataagcagcaaatgctgatgtaggggccgcagcaagtcatccagaagatctagctaagattattagtaaaggtggatgattttgaggggttcaagacttcagtggaggaaggaactgcagatgtggtggaaacagcaagagagctagaattagaagtgaagcctgaagatgtgactgaattgctgcaatctgaggataaaatgtgaatgaatgagtacttgtttcttatggatgaacatccttcttaaagatggaatctactcctggtgaagatgctgtggatattgttgaagtgacaacaaaagatgtagaatatttcacaaacttagttgataaccagtggcagaatttgagaggattgactccaattttgaaaaaagttctactgtgggtaaaatgctgccagacagtattgcctattacagagaaatctttcacgaaaggaacagttgatcaatgcattaaacttgtcttattttaagaaattgccacagccaccccaaccttcaacaaccaccaacctgatcagtcagcaggcctcagtaatgagacaagaccttctaccagcaaaaaagattgtgactcactgaagacttagatgatcattatcattttttagcaataaagtatttttaaggtatgtacattgttgttttagacataatggtattattgcacattactagactacagtatagtgtcaacataactttcatatgcactgggaaaccaaaaaatggatgtgacttgttttattgtggtatttgctctgttgtggtggtttggaactggacctgcaatgtatcagaggtatacctgtattatagctaataccaaataaatagaatcataagagactactgtgaataattgtatgcctacaaattggataacctggaagaaatggatcaattcctagaaacatacaacctacaaagattgaatcataaaaaaactagaaaatataaacgaccaaataagtaaggagattaaatgagtcatcaaaaacctccagcaaagaaaaaccccaaactagatggcttctttggtgagttctactatgcgtttaaataagaattaacaccaatccttctcaaactcttccaagaaattcgagaggagggaacacttccaaattcattttatgaggccagcaacaccctcataccaaagccagataaggacactacaagaaaattccagatcagtatcactgatgaacatagatgcaaaagttctcaacaaaataccagcgaacctaattcaacagcacactaaaaacatcatacaccataatcaatgaaatgtatctctgagatgcaaggatggttcaaatatatgcaaattagtaaatgtgatataccacattaacaggatgagggataaaaatcacatgatcatctcaatagttgcagaaaaagtatttgacaatattcaacatcctttcatgattaaaaactattaacaaatcagatacagaaggaatatacctcaacataataaaggccatatatgacaagctcacaactaacatcctactcaatggtgaaaagctaaaagcttttcctctaaaaccaagaacaagagaaggatgcccacactcaccacttctgttatacatagtactagaagtcctagctagagcaattaggcaagaaaaagaaacaaaagacatccaaattagggaaagctaaatagtctctktttgcagatgtcatgatcttatatattaaccctaaagattccacagttagaactaataaatgaattcagtaaagttgcaggatacaaaattaacatacaaatattagttgcatttctgtatactgacaactaaccagaaattaagaaaacaatcctatttacaatagcatcagaaagaataaaataggccaggcgtggtggctcatgcctgtaatcccaacattttgggaggccgaggggggtggatcacatgaggttgggattttgagaccagcctgaccaacagggagaaaccccatctctactaaaaatacaaaaaattagccgggcgtggtggcgcatgcctgtaatcccagctactcaggaggctgaggtaggagaatcgcttgaaccgggaggtggacgttgcggtgagccgagatcatgccattgcactcccgcctgggcaacaagagcaaaactccatcccaaaaaataaaataaaacaaaataaaatgaaataaaataaaatacctaggaataccaagaaggtgaaagatctgtacattgaaaactgtaaaatattaatgaaagaaattgaaggctggggcrgaaggattgcgtgattccaggagtttgaggctgcagtaagtcatgattgtgccactgcactgcagcctgtgtgacagagtgagaccaaaaaaaaaaaaaaaaaaaattgaagacagaaataaatggaaaggtatcctctgttcaaagagtggaatagttaatattgttaaaatgtccatactactgaaagcaacatacagattcaatgcgatgcctatcaaaattttaatggcatttttcacagatatcagaaaaacaatcctaatatttgtatggaatygcaaaagacyccaagtaaccaaagcaatcttgagaaagaaggacaaagctggaggaaccacttcctggtttcaaactacttcctggtttcaaactacattacaaagctctagtaattaaaacagtatggaactggcctaaaaacggccactagggtcactgggacagaatagaaagactagaaataaacccaaacatatatggtcatctaatctttgacaagggtgccaagaatacacaatggggaaaagatmatctcttcaataaatagtgttggaaaaactggatatctatatgcaaaagattgaaattggacccttgatttacaacatatacaacaattcaagtgaattgaagacttaactgaatgtgagatttgaaatcgtaaaagtcttggaagaaaacatcagcaaaaagctcaaccttggtcttggcaatgatttttttggaaatgacaacaaaagcacaggcaacaaatgcaaaaataatgaaatgggactatgttaaactaaaaaaacttctgcacaacaaaggaaacaatcaacaaaattaaaagacagcctaaagaatgggacaaaatatttgcaagccatatgtttgataaggagttaatatccaaaatatataaggaattcacataaaggatttcacrtaactcattagcaagaaaacataaagcccaatttaaaaacggacaaaggacttgaatggacrtttttccaaagaagacatacaaatggctgacagacatgtgaaaagttgcccaagattactaatcatgagagaaatgcaagtcaaaaccaccatgagctatcaccttgcacctgttataatgactttatcaaaatgacaagagatagtaagtgttggcgaggatgtggagaaaagagaatttttgtatattgttggtggaaatatcaatttgtacaggaattatcaaaaaacagtatggacgttcttccaaaatttaaaaaaagagctaccatatgatccagccatcccacttctgggatgaaataaaatctgtgtcttgaagagacatctgcaccccatgttcatagcagcactattcacaatagccaagatatggaaacaacctamgtatctgtcagccaatgaatgaataaagaaaatgtggtgtgtatacacaatggaatattatttagccatgaagaaggaaatcctgccatttgcaaaaacagaaacgaacctggaggacatgatggtaagtaaaataagccaaacacagcaagacaaatattgttttgtcttacttatatgtagaatctaaaaagttgaactcttagtaacagagtagaatggtggttgccagggtctgggggtgagggattaggggagatattagtcagagtgtacaaacttttagttttaagatgaataagttcagtggatctaatgttcaacatggtgaatatagttgacgatactgtgtttacttgaaattagataagaagatagattttaagtgtcagcactgcaaccacacacagatgataactgggtggtgatggatatgttagttaatttgattgtggtagtcagtacacactgtgtatgtatatcaaatcatcatgttgtacgccttgaatatgtacaacttttctttgttaaataagtactttaaaattttacaaaagacatttacaagccacacttactcatcttgggaaaagctatcagtcatttaaagcaaagcatcctttccttttcaagattttactttttttttttttttgagacagagtctcaggctagagtgcagtggcacgatctcagctcactacaacctctgcctcccaggttcaagagattcttatgcctcagcctccggagtagctgggattacaggcatacttcaycatgcccaactgatttttgtatttttggtagaggcggggtttcaccatgttggccaggctggtcttgaactcctgacctcaggtgatctgcccaccttggcctcccaaagtgctgggattacaggcttaaaccactgcacctggcctcaagattttacttatattttaaatgtctacatcttgaatttcaattcttattctacctagaagctaaaagcattggcagggttatgagttggggtggaaatatttgggcctgtggaagataaattcatattgtttgaagaaaataatctgcttataattatcagtttattataatcaggcccaaagaaggaaaccaaaagtcttaatattttcttagtgataaagtggaggaagtaactgacaaagtaattttggctctttaccagggatgcttcatataaaggagggagaacaatttccttgacaaccaattaatatgtatagcttaaggctatgactgtattctgcaagaaatagattacatttctgaggtctgcacatctgaagatattataaactagctaggagatttttatgatgatatgatacagatcagcaatacgtaagacagaaagggggyttcacccagcaagagttaggatttatagtcccagtrtgcccgagttttacatattgtgaactttgctaaccttcacctttatcaacaagctgtgagtgactctccagcacaaagctttgagtatcaagcatgcatatagtaaaaaaaaaaaattgccaggcaccgtggctcatgcctgtaatcccagcattttgggaggccaaggcgggtggatcacctgaagtggggagttcgagaccagcctgaccaatatggagaaacctcgtctctactaaaaatgcaaaattagccgggcgtggtggctcatgcctgtaatcccagctactcgggtggctgaggcaagagaatcgcttgaacctgggaggcagaggttgcggtgagctgagatcgtgccattgtactccagcctgggcatcaagagcaaaacttcgtctgaaaaaagaaaaaaaaattatactgatgatttgggggagagcaccaaatacccttaaagtttttacggcacagactttttagtaaatcttatgaggggatgattatgggaataatatgcatatatmtatatatatatatatatatatatatatatatatatattccaaaaatattggcaaaaataatgaagaacctgaaagtcctccatggtcagagttaaggtcagggtcagggatgaatgttgcattagttggcaataaaaagcagccattgtacagtttgacaggcctgtgtgaatatcctgctttgtagctgagtgttcttgcttgttaatctgcttcccctatccccactcttttttttttwtwttaatctggtggttgagaggtgcttccaagcctacctattttatttaccacttcctcgttagttttttgggcttcttaaaatggtcctccactcttatgacttctggctgtttgtacacaagaactgtccacctctctcctcctgccgtcaagggtgttgctaaacctatcatcctcaacctgaagctccttccacatccttcttgccagctcactatcagtcatttcctgagactgacatcacaaaagagtcattagatttaagccctggtttcagcaattactggacctgttgtgattctagacagggttcttaacttttaattttccatgacattttttcccttgacatcccagtccaagctgttgacttttgcatttactgctcatttctacctttaatattccattttcctctgttaatattatatgctgtgaaacccaggagaagtcagcattactatggtcttgggtagaactgagagagataaagacatgaatttgaggctgttgggggatgagttgcagagaggcataaatacgaggcagaaaataagttatgagtgagaatacaacttattaatagcttttgtaaacttctggcaaaaaaagatattgaagataattagagttgaaaaattatatargacatcacttasgattgggattcaatcacattttatagaaaattcaaataagagttgcttaagcatgaaagaagttcagaggtaagtagctcagggcttgtatggcaactccatggtcacagggggcccaggttccttctcacattgttttctcccatccttggtgctggcttacatgccaaatgtctcctcatgaccacaagatgctcctggtgttcccagaccaaactgagggttgggctgctatttctcgtggcccaataacgagaagcagatgaactggggaggaagagtttttatttctgcaactggttatggggggaaggcctggaaattatcaccagaccaactcaaaattacagttttccagagcttatataccttctaagctatatgtctacgtgtaagtgtgcattcatctaaagacataagtgattaacttcttctaatctatagctaaggtctgagtcytgaagaccttcctctggagcctcagtaaatttacttaatctaaatgggtccagctgctggggtgattacccttattatgtctcctgcttaaatcacggaggtttggggagttccttcagacctccaataaacttgtttgtggaggtctggggagtttcttcagacccacaataaaactcgtttaatcctaaatgggtcctgttaagaattcctttgttattttgttatgctttaaggcccaggaaaagcctaggcaaaactcttggtgggctttygttacattccagcctttgtataagggcactggcttttttaacttttaatatttaacttaaccactcagtcagtactgaaacagttgttatggaggcctgcgttagtgagagctggcctgccacactggtgctccagctattatgtccacgttccaagatggaagaaagtataatggcaaaagtacctatctctcagctgaatcagtttgctttaaagggcttccttggcttccatccacttctgcttacacttccttgaacacctccagaaaccaaggaggttgggaaagctttaggctgaggacattatcactccaaataacatatttttaagtcaggaagtgggaagagtggatattgtgtaggcaactcacagtcccttccaccatagccgaccaggacagagatagctggatgatggtttgctctagttgagcctaaacaagctcatggctccctctccttaaactacttttatattttctttctctaagttcagagcaaagctttcatattattttatgaatgtttcttaacaagctcatcgtttctggtgttttgctgcaattctgcagtagatagtatggtatatttggtggacagattcagggccaccaggctttgaatagcagtggtgctacttagaagctgagaggttatgaaccttatatgcaaccatagggaatagtgttgttactataaataatgattgtactgaaccttatatgcaryagtgaataatgttattataaataatgattgtactgaaccttatatgcaacatagggaataatgttattataaataatgattttcagactgaggcagttttctaaaaattcaagtgaaagatcacattactttacatgaggaccacaaggcacattcaaaagatacggttgattcactttgttaaacaataagaatataagtgtccaaatacagaacaaaggaaataatatgtccaagaaacatttttctttgcttaatactaaaagcctcttgatctgtttcctatatcctagtcacaactgaattttaagaaagtcgaggtcatgttggtaactccatgtcaatactgctttktgtactaactgcaagatcaggaatcgtccctcattacttccatcttggctttcaaaagagcctactgtaattttttcttctgaaatagtatgaaataacttttttcctgaaagaaaatctcctttctatggttctttcttctgaaacaaggctttccttctctgagcttccagctagaataatttcctctgacatactctgatctaggaggattgtagtgtggtcacaatgcctcagctgatttcagttaattttcttgagctgaatcaaatgaatgtcttaacaagttgtcctttaaaaggatagacgtgcttttatacaaaacttgcatttaaatgaaaccactagacttcttcatacaatgtaatgaagtcttggtattccagcgatttggcayctaaatgcataggcactcagtaaatattggagggaaggaggatggtggaaagaaagaaagggggagcagggaaaattaggggggaaattattttttcttcctggggataggtttcatttttaattgggaaatgtaatgtgaaatgtattactttcaaacttgaggacccagaatataacttatgatgatttaagttttcttccttttatttacattttaatgataaagacactcattggccaagacccagaaaaaaagtttaaataaaaatttacattttaatgataaagacactcattggccaagacccagaaaaaatagtttacctatattttatacgtgtttgtttaaaaaaaaaaaacacaatctttgaaaaatctggagaatttatttcgggttataatagtcagaaaatgtgtgcctttaagttttgcttctgaatagacatattctgctaagcaagcaatctcctcttagactgcttgctgagcacatatactttcygtatgctgatttttaaagtgtctgtatttggttggtggctttagtaataagagactagcttttaacacagccagaagaagctgatgtgaaccascagaaataacactgatcatatataatacktatggaacagtggttgcccaccatttttgaacccaagatttcctgacatttatcactgtgccaacaaaaagaaaaactaggaacctggggaggacttagagagaggaagcatggacagctgccagcctgggcagatggcgtctgtttggttgagacagattcaccaggaaacaagatcagatcctagtttgagacccaaaacctggtgagtaagaacaagtgttcaggacttcaaggggcccagtaggcaattgtgggaaaaaatctggaggtcctgaacttgcccaaattacaggggtaggtgagaaaaggtaatccaaggggtaatatttttttctgctttttggtgttatctatattttctttaacaattatatatattacttaaaggaaaaaactctaggtcttatatattcctgactaagcttcatcaatatgtatttgcttcttttatacaaagtaacattgttttcatttacagattgccattaggataccttagtaatgatgtccagttatgatgcagatatttcaaagtttattgtttatttatttattattattttggaggcagggtcttactgtgttgcccaggcttgggtacagtggtgtgatcttggctcactgcagcctcgaccttccaggctcaagcagtcctcccatctcagcctcccaagtagctggaactacaggtgtgcaccaccatgcctgtctaatttttatattttttgtagagatggggtctcgccatgttgcccaggctggtcttgaacacctgggctcaagagatctgcccgcctcagcctccccaaatgctgggattataggcgtgagccaccgcaccaggcccaaagttaaaataacttamtgaataaggtttggatgatgtcaggtaccccttttttctcaggggaactggctcctacttagatatcttatgaccattagtgggacattataggatagcctagaaacagaaacactcacgtcagtgtgatttatggctaagctggcactcgacatcagtgggataggagggggtaatacattaaatggtgcatgggaaattgattattcgttcagaaaataattgaaatggatctgtacttcatttcatacacaaaaatcaatttcagggagattaagggacttaagttataaaaggcaaaactttgaaacttttggaaatagtataggagaatagctttatgaccttggaggagggaaggatttacaaatagtgttagctataaggcaaaggtttggtcattgagccatcttaaaatcaaggaaattacttcatcaaaagacatcgctaaaagagtgggagagaaaaaccacacactgggagaaaatatgtgccatacatatgtgtggcaggcacacctgacagcaacaaccgaagcataccctgagaatgaccctatggtctaagaagaatgtgtgtttggagttctcagctgaggaacctggtagtggccaacccggagactgattccttgtctatgaggaacatctgaacccccggcccatttcggattaaaggagggttgccaggtgaaggttgcaggaggggagctaagtaaaaatgctatataaactgcatactttttagaaacggtagtggttcgtccatccagcctgctaccactggaccgctgcatatgtaagtcccctcgagaagccctatatctcatttgccagctctcggtctcttctttggcctctcttctttggcctctcgaacctgtgctatccctatccaactcaataggggtctggcacaatarcatgtaactaacaattaggaaacagaaacctgtcttttagaatgtgggacttctcttcatcaaaagcactgtaaaatgagttaagaaacaacccataaatacttgaggaagatacttgccatacatgtaactgacaaattaataaaggaaaaaggtactctggagaaaaatgaacaaaagccytgaatagaaactacacagaagtggaaatgtgaggttgggcgtggtggctcacacctgtaatcccaacattttgggaggcctagacaggtggattgcttgagcccaggagtttgaggccagcctgggcaacatggtgaaaccccatctctacaaaaaatgcataaattaactgggtgtggtggcagacatctgtggtcccagctacttgggaggctgaggtgggaagattgcctgagcctgggaggtggaggttgcaatgagctgtgatcatgccattgcactctaacctgggcaacagaggagaccctgtcaaaaaaaaaaaaaaatgaaaatgtgaatggtcaataaaaatgtgaaactacttaacttcattagtaatcagggaaatgcaaatgagaagcaccaggtgatactgtttcacactctccggggcggccaaaatttttaagtcttaamaaacaaccctaacaatgtagagtcacaaacaggaatccttagacactgctggtggcagttgaattagtacagccactttggagaactctgcagccttgtcaggaagagttgaagctgtgtgtaatccacaacactgcccacactccacagcaatgcttctcaagcctggcataatatattagcatcccaaaatgagcatgttggaaatacttacacctggcccttaccccagacctgtgattctcaaatggtatgccaagatgccctggggaaccacagcaaactcacagaagacgatgggatatcttaaatgttcaakgggaatgcagtgatacttggcatctgttgaacgcagtgtgaattactagctcaagacacttcagttcagtctcaatgttaccccacgcatcatccctttctattatgcgaagctggattttcagtggttgctgtaacaaaaagcagatatcatgaaaatcagtatggaagaggaaataagggtgatagagtccaatatgattccaaagtttaagaagttgtatagtgcccaacgagtgcacacattccattaataagtaattgaggttatttaagaatgaaataaaacttttttctttggtattttcatacagatttttcaaacagctactgcattgttaggacaaaaaagacttgttaacttttttggacctaactacttaaatggaattgttaggaatttgttctaggggtgcctagaaccctgaaaaaattgagccacttagtagtgtcccttcaactgagaatatttgggaatctctttcccaaattarttaactcagaatggagatggaatctctatgtctttgtttttaaaaagctccccaagtgattctaatgggttcgtaaggttgagaaccactgcttgagagactcttgcacatgtgacttaggataatgctactcaaattgtacctgggggccagcgctggtttgcaaattatttcctacagatctgcagcaagtttatatgaatcatactttcagtgaataatggtacagtttttgtaatcttttgtcttctgattaaatttactgaaatataattttatgtcaaattttataatggaaaaattgaggcttgtactttgtgcttttttctcatatttttctaatatttatgattttacagctttgttgatgtataagtgatcaatttgcactctttaaatatgtgcaatatattatatgtcaattttgacatatgtatatacttgcgaaatcatcaacacaaccaagataatgaacatatccatgactctctaaagtattttctcatccctgtgtaatctctcccatttggccctccacatcccttcataatcctccactcctgtccccgccccagtgcaaccactcatctgcctgttgtcactatagattagtttgcattctctagcatttcatgtaaatggaatgttactgaatgtactcttgcttttgtctggcttcttttacttagcataatgttttgcaattcagccatgttgttggataygtcagtagtttactcctttttattgccgattagtattccattgtatggatatgccacaacttggttttttattcaccaattgwtggatatttgaaatgtttgcattttggctgctatgaacatttgtgtgtaaatctttatgtgatcacgtgctttcatttgtcttggataaataaatacctaggagtggaatggttggattgcatggtaggaatatgcatatagtaatttatttttattgcatttcacaaataaaaagcattagcccacaaggattagaaataaaactctcccaggccgggagcaggggctcatgcctgtaatcccagcactttgggaggctaaggtgggctgatcacctgatgwcaggagttcaaggccagcctggccaacaaggtgaaacctcatatccactaaaaatacaaaaattagctgggygtggtggtgcatgcctgtaatcccagctactcaggaggctgaggtaggagaatcacttgaacctgggagatggaggttgcagtgagccgagatcacgccactgcactccagcctgggagacagagcaagactccttctcaaaaaaaagaaagaaggaaagaaaactcttccttcagcaaatgtattttgaaaagtactagcctaagttaaatgcccaasagtgttcacagctacattgtttataatagcaaaagactggaaacaatccaatcatccattgtcaagagaatggattattaatatgaagtatatatccagtagactactttataacaatgaaaactacattgatgtagctgcagtttatctactacattaatgtagctgcagctacattaatcagaatgaataaacggaatttaaagttgagttccaaaagcaaattgcaaaagagtgcatatggaaggatttcatcatatgaaktttacaaacagtattttactacaatattaaatagcattttatttacagaaacatacatatatggtaaactataaagaaaatggtgatacaaaatgcaggatagtgtttacttggggagtggccraaggtacaatgagagagataggaccaaggaggacagacagaggcctttgaggctagtgggtcttggtcccgttcttaaactataggaattcattttaatgttacattttgtgtttatattttgtcataaattttttgtgcatattcaatatgtaaccacaaaatacaaaaaaactctctaaacagttgacaagggagtttattaagcaaatagaggtaccaattacaaaccatcagggttagaaaaaaaatccaggctttaagtaaatataaatctaagtaataggctattgactattatcttagaaaaacttggggtattacaccaggttatcacagaatatttagttragaagtatggaaaatatgatatgctatttatttgaatgatactcggtaggcatgtaatgtgatgattaaatcagttaagaatatgtgatagattttttttaaaaaaacatctcatttaaaatgcatgtcttttgtttttatgattattgaaaaatggttttcagaatacaaaatgagaatcaaaaattggtaattagatattctgtgtttctcaaatggayggactttataattgggtggagttatgttaaaagctagaaaaactgaagaagttaagaaagaattgaaaattcccattaagagaaaaaagaaaaagctgcaacctttgctaatataaaccgtaagagcctatgcctcttgaaatttctctgtgtttgtctttgtacatttttaatgacttaatgagaaaaaagattcatcaggactcctttcctagcaggaggtttartgtttcacaaatgagtagggagctgctctcataatgaggtaaacggccacctgattcttggataagtccaaggaaaacctttacaccagaggaagcaacagcttgccagtgttcaatctgagactttccaaggtcagaagagaggaggattggtattgatatttaataagcatttactgtgtccaaggcattttggtacgaattktatatctcttatctgatatccttgccttttaggactaggctgtttttacctttaaggtagatgttattattctcattttacacatgaggtaactgaaacatagaacttaaaaaccttgccaaacatttcagaggaggcagatttaaacccagatgcatttgcattaaaccccaatggatttgattccaaagcacgtcgtctttctgctaataatagccaacagtyattgagtacttactatatttataccaaggtctgttccaagtgatacatagattttctcttttaagcctcgtggcagtatgagaaagaagctattattatccccattttacagatgaaaaaatggagtcacagaatgttatgtaatttgcccaatgtcacacagtaagtggcagagttggtccacctcaggagcccacactcttaacctcttttggccttttatgagtacatctgccctttcaaggatcaggcttgagtctgtcagggaggcctcatgtctcctattaacttttgagccatacgcatcatggaaactggtttctcctggctgggtacttctgagttgcctggcctcctgtgagctcttcttttctaattgaatctactctctaagactctttgctgctggaatatgcagcagtagtttgagagacacttctcagtcagttctaacaygtttagctaggttcttcctattttttgtgcttcatcagatcatttgggctcagtgttttctttctttttatttttttctttttttttgagacagtatctcacgttgttgcccaggctgcagtgcagtggtgcaatctcagctcactgcaaccctgcctcctgggttcaagcgattctcctgcgattctcctgcctcagccttcagagtagctgggattacaagcacctgccatcacagccggctaatttttgtatttttaatagagatggggtttcactatgttggtcaggtggaccttaggtgatccacctgcctcagcctcccaaactgctgggattacagacgtgagccaccgcgcccagtctgggctcagtgtttttcagtggaataaggatgaatcattagaagagctttcatacctcttaaactctcaaattccatgccttaataaggatttttattaatacttcatttaaaacaaacagtaattaagcatcattttaaccatttgatgtgattataactcatatgctttctactccaaaaatatttgaagtagaagaaaccaatacaatgggataaacacaaaaaaatgcagaacaatgtagagaaaacagagataattatacaaaaccttaaggtattttcgttattgctgttgagcatttaatgctgaatttcctggcagctgaggcaacagaaaggtaattggtcagataatttttgttatatgttcaaataaagtaaactagttcattggggaggatagggtaccatgtcaggccactagccaacccttttcttcctacaagttaaattatatctgaatatcctctggagcactcagatcttaaaatactttagaagagactgtaaagaactgccagtgattgtctttaaagaggcgtcatggcagtgctgtaattcttgcttagcaacacttatatctaagctttcttctctgagggaaaggccaggttctaggtcactccctcactttgttccagtctctgcccaaaggtcacctcttccctgactgccctttctatatgaggttcccaccgaacgcatctgggttgccctctatccctgtccaacatagtagtcactagccatatatgacaattaaaattaattaaatgacaaaataaaaaattcagtactttggtcataccagccacatttcaaaagctcartagccatgtgtggcaactgggcatattggcaacacagatacgtcatcgcagaaagttccaytgggcactgctagcctatgctcttgccttaactttttcaacactatgccatgccatgcacctattgatttgtttatgttccactagaatacatgctctggatcacagagttttttttttttkttttcccagaacatagctgaatcctcagtgcctaaagcagtgcctgacatagtacagtgctttgtaaatacttgccgagtgaatgaacaacaaatgaatgaatgaattttagtattattttgcagtttcaaatcaaaastattttgtctaatgtccctgggtgacctagtacacgttctgccacagtttttgagatgaaagaacgaaaattctgtgatcaaagagaacattttaaagataaaatgatattaaatatactagtcaaaattttatttcttttatcttttatattatgaagaataatgggtacgaaatttctgtttatcaattaacgtatcatcctgaatatgaacacagaaaatatcaattttctttgcattaagaagtcatgtaagtagaaggagaaaacaaagtacttattacatagctaactggacttacagtcacatctaatttaaagcaaatttgctccatgcaatggaatatactaaaagtaatattgtgcaattatagctacagacatgataggaaatcataatacattctaaaagtatatagaaaaatgtcagtttacttcaacttattttaaacaaaaattacccatgaaatgattgcagtacctaaaaagaatttgcaatctgaacaaaatataactagaagcacgactaccctatatctcctataaatacagattgaagctagttttgtgatttcagccaaagatgcagcttcagtaaccttgaaaaacattgtttcctttctattgggcctggctttgtcaggagatactcaggaggtgatggtgaaaggaggtacctggtggagccagacgagtckggtaaatcagctttaacaagcagccagatgatagatgtcagttgggtgtcatgcccaattctagttgctgacaattaggaattagattaaaataggagtgttttctccttcaccctccctttcttaaaagcagccattttctgagtagtgttagttcttagttctcagtggatttgcaaatgcagatcatgaggcacctctagcttgggcaggattggtgttattttgctatttcaagtaaaaaacatgatggttagtgtccttggataacctcatatactttcattgtttttcaaatcaggtccagtgaagggccaagttcttcataaatatcatggctaattttggaaacccatatgttcagttaaggtttctgaaactggaataaatatgaatggaggatttatcaacatttggatatttgcaatttcaattcttgattcttttttgaaaatctattctgggtctayatctgaaatgtttatctcctttggtgctagatccagagtacaatttttgaaaactttaaatcaagggtggaacaataaattcacttgctcttaagactttaggggttgttttagctgccaagagagcattgcctgtgtgctgcgaaaaatacgagagccacagaatggccaaattattgcttttactcaggcagagtgaagaaaatggccctgtgacagacatttccagtttcctgtacatagaaatggggaaacagttgtgaaaaaaaaaaaaaagccagctggggttcttgacacacagttcatgctaattttaaattgtactaatacttgactatatagtgagggatcctttgcaggatgatgatctgttgaagactcagcaggccactgtggggagagggagagaggctgtcagaaccttcccctccagaggccttttaatggatactgaattcagaattgacctcacagaatctgatcattactgatgcaagagcaaagtcaacatcatctgcaaagataatttctcatctattcatgagtacctgtgcttatcaccacatctggaaatctgactactcaaataagaatttctgtcgagagactgaacaagccaggcaccaggaatattttactctgtatgtacagatggacatcgatactggaatatttctgtctcactgatgcttagggaccatcttttgattttgatccgtgtcaagattctaaggcagtttaactaagacatgggttttcagtgtttttttgtttttgtttttgttttaatttctgtttctgtgagtgtaatttagggaggagtaccagcttgttttttataagttgtttcttacaatgattaacacataatcttttctgccttaaggtttataacaaatgtgaaactaagtttcacaggttaattccagcctaatcttttcatagatgatagcgtagcccagaagcaatatgctgtgacattttattttattttatttttgagacagagtcttgctttgttgcccaggctggagtgcagtggcatgatctcggctcactgcaacctccatctcccagattcaagtgattctcctgcctcagccacccaagtagctgggattacaggcatgcacaagcacgcccagctaatctttgtattttaacagagacggggttttgccacgttggccagactggtttcgaacgcctgacctcaagtgatccaccacctcagcctcccaaagtgctgggattacaggcgtgagccaccgtgtccagcctaccgtgacattttaaatttcaaaatgtaataaaatcacaagttatgccagaaagccaccgtacttctcattgaatatagtatctccttggtgttcatgtccttatgttcttatataactctgtgtgccagtgtttcaccaaatctatcaactcttttaaggcagagactacatttatttattttttaactttttgtttgaaataacaaaactttctgataacttcagacttagaaaaaagttgccccaaaatactacactgattttcatgtacccttgatacagcttccccagatgttaccatcttacataatcatagtacagtgaaggaaacagaaattgacgttgatacaatagcatcactaactaacctaaataacttatttcagtttgccgattgtcctactagtgtcctttttaaagtccaggatccaatctagaatcccatacaacacttacttgtcacgtcttgttagtctcatctagtccggaggagtctttctataattttcacgacttaatacttttgaagagtcccgaccagtgattttgtacaatgtccccagtttgggtttgtctgatgttttcttaggataagaattagcttatgcatttttgacaacaataccactgaagtgatgttgtgcccttcccaatgttttttgttgttgttgtttttgtttttgttttggagaaggggtctccatctgttgccctgcctggagtgcagtggcacaatctcagctcactgcaacctccgtctctcgggttcaagtgattctcckgcctcagcctcccgtgtagctgggaccacaggcacacaccaccacgcctggctaatttttgtatttttagtacagacagggttttgccatgttggccaggctggtcttgaactcctgacctcagatgatctgtctcccacctctgtctcccaaaaagctgggattacagatgtgagccaccgcacccggcccccagtgtattatatgagagggtacatgatgtcagtatgtctcattgctgttgatctaagttttggtcacttagataatgtggtgtctaccaggtttctccactgcaaagttactgttcttcccattagaattaataagtactttgtggggagatgctttaagactctgcaaacatcctgtttctcatcatacttttgcccattaattttagatactattgatgattcttacctgtaacagttattagtgtttgctaaatgctgatatattttatttccatcattccttctatattattgtaattctactgtaaggaagagctgttctttcttctgctatttattgatttattatgttaatgtggatatataattagttactataatttttttctcaaaatatctcagatttggccattggaagccccttcagacaggctcctgtctccttttgacatrtcctcatyatcttttaaatgcatgttgtaactctggcatcacaagatgtgtctggcttattttgctccagccctagaatcagtaacttctccaaagaccctagttctttttactgtagactggtatttagaaacaaaatctgggtgctggatatgctcattgctactggtatatcattgcttctaggccctctcagcttacagtgctaggaaataatgtgtctgtatatccagacacatgtttctctctccctctctctccatatctatatgcctatgactatctacctattaaaaacaataagtttatctacttattaatacttccacttacaattcaataccactagtttccttttagatatctctttccttactcgtggctttttctccaacagttagaaacctggcattcattatctacaatatatttacttatttgctcaaccctagtatatatgtaaagaagtttcagaactgtgatttccataatctctatgagaaacaagtttaccaacaagactatatagcatccaggtgcagtcctttttgtctttagtcttaaggtatataataaaagtactggtttccaaaattaggttagatattttctttcttacctctttcatggtggctgttgttttttacttgtaatacagctaggttcttttgttactgttcgtgttccattttgggttcccccaacaccgagaggttggttttaattattctttattagggggatgtgaaacatgattattgttctcagagtcagaactctgtgaaaaggggccggtcgtggtggctcatgcctgtaatcccagcactctgggaggccaaggtggttgaatcacttgaggtcaggagtttgagaccagcctggccaacaaggtgaaaccccttctctactaaaaggacaaaaattagctgggcatggtgatgggcgtctgtaatcccagctacatgggaggctgaagtaggagaattgcttgaacccaggaggcagaggttgcagtgagccgagatcataccactgcattctatcctgggtggcaagctagactccatctcaaaargaaaaaagaaccatgtgaaaaggcatttcagaaaagtgtcattccacctcatcccttctgtcacgtttcagtctcccattcttcccatctaccccgtaagtgaccagtttagtttctacttttttcttctgtatttctttttgcacaaataaacaggcacatatatgttttcttatacagagatgatattcagtgtctttttttgtgtggtactgggcaatttaaatgctgtttggtaattttaactcttaaggatactgtttataattgatctgtccttaatgccaatgtattagaaagcacactaaatgattgttttcttttttgtaaaatatttgtgagattttttaaaaaatgaaggtgacatgaattttgatgggcttattaacactgaactatttcttgataagagttgtctaaaaaaatgagaacatatgccaggcgcggtggctyatgcctgtaatcccagaactttgggaggctgagacgggcggatcacaaggtcaggggatcgaaaccatcctggctaacaaggtgaaaccccgtctctactaaaaatacaaaaaaaaaattagccgggcgtgttggtgggcacctgtagtcccagctactcgggaggctgaggcaggagaatggcgtgaacccrggaggcggagcttgcagtgatccgagattgcaccactgccctccagcctgggcgacagagcgagactccgtctcaaaaaaaaaaaaaaaaaaaaaaaaaggagmacataaagcaagtaacaatgtttttcaagttttctttaaygcatyacatctttttttcacaagatattttaaaattttatttttccttattaagcgaattgaattatttcaagcatcagtgagagctgctagactgttatatttcgggggtcttgcrgrgtagcttttcttacacatataagcagaagaamacattttcccaagtcttaaaagwgggttatgatgcatttcaktgtgtactctttttcttcccatatactctgcaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggaggtaaataaacaaattccctatgagagatttgtgagagggagaaataagaaagttctctccatagcagagaggaataacacttttgttttaatcagaggagctgtattaagcacgaaactactaatactgagctagcaacttttcttttttagtgaaatgatagctagcttgttctgagatgagcttttctctcttttattgtttcttgaaaattaagttttgtatgtattgcggacttcggaattggccttactatttctgcaaaggtattttaaaaatacagtgaccttagcacttcctccctgcattagctggtttaatacaatgtggagaagaacggttggctgtaatgctctgtatctgcctgatttccagctgacagtggtgttggctcaggacactgctcatagggaatgacagcctaggcgagtgtcctgagaagtctttgagtctggtgatgcagatccccaaaggatttttctggttatagagaaggcagcaaattatggctggtatgaattaggtcagggagtctctcttgctctgtgagtgttgagcatccaccaaactcagtattccttgttagcttttccaaggcagcatcacctgccatatcattttcaaactggcagagtcatcctttagtggaggggtgatgttggaaacagagatagccaaaagtagcttcatccatcaaacccctgtaagaacatttttggaagctayattcaatcattcactccgtattttgatatgaaagctatagaagagacgcagacgtcctctaactcctacaccaatgcagtgatcattgacaggtccacaaccaagtgggctcactagttgagcattttagtgatagaaatatgtaggatgaaaatattcttcaatattgtaaagtataagacaagcaatccacatttgaaataagtgacatattacaaatagggcttcactattataagatataagttgtccagaatttattggaattttctagataatttacgtttacacatgtccatattacaatgaactaaatgaatactgacagcaaggtcacttatgagataaggtttacttatctcgttatctttggatatgcccaaatatagcaatatgacttgtgaagacagagaaaggatctaatgaagtggaagttagtgttgagtactaagaagaagaygagacagttttcaggataccaggacctcctcatttccctccaacgtgaacaactgttaaaaacagagctactctctggttccttctttctgagacagggtgtcactctattgcccaatctggagtgcagtggcacaatccagcatccattgcagaagtggacagagggtcatgtggagccaaagcccaccattctggattaaggaagtcaccaaacatttgcagggagcaacctcagcagccgtgagcagcagggtcatgtgcaagttggcagagaggatgtggcatgggcaacgtgaggaccgtgtgcacacgcatgcaggtggtttatggagaagaatgtgaccaatgagtcgagtattcttgatggccagttggatggatcctytgaaagctgcaatccccattgtgtgtagcagctgcagctgagccaagaacagccaaggttgaggatggggcagggaatccacagatgcttttctgtgtgagtcaacgtggtgatgattaatggagcatcctcacttacacagccacgcttgaaggcagttccaatgagtagatttatgatgcatggcagaagttaattaattaagcatgaagttacaagttaggaatgaatggaggcagcaaaagaaaaaaaatttgaggggcctttcattcagatcagttctcaaacttgaaggagcatctgaatcacctggagaactcatcagaccatgaacacggggccccctcgcagagattctgattcagtagatcgaggtaggacccaataatttgcatttctaacaagttcccaggtgatgtgggggctgctgctctggaaaccacatattaagaaccactaatttagattttttggcctgcccaaagctgaggaaggctcacaattgggacattgctataagcaccatgatctcctgaataaatcaattggttgtgattcttcaatttttatgcattttacatagtagatttgcagtaagagaataacttgttatatccacatttaggtatttttgatctaaaacagcttgaggcactttagcctatgaatgtgtttattcagatttgtcaggtaactaaaagaaaaaaaagatcttgtgtttctttgtcttctatgtgtgccaataatgtatttgttaatgttctttctgatgagtgagagctggtgatattactataaccctgagtttttgtttttgtttttaatccagcagatacattttattttgctgtacctaagagaattattattaacatttagagctaacataaaaggagaayaggaataaattctattttttggtgtattgatacacacttttaatggttggtattaagttgaaatctcagatttgatttccttttaggctcagttttattttttgtactataagcattaactgatgtacagtgattggaagagagatcatgtaacttagaacagttatgacatgatggaccatgagaaatatacaaggataaccaacccaaaatatagtaaatgatcagtttgacagatgctgtgtctctaagaacttaattaatgggataatttttctttactgaaaggactcatttcctgttttagtaggattgttggtcctggcaaaggtgtgtgtgcgtgcatatatgttgggtgcatcgtgaaagatttacccatgtgtgtgtgattacaatgtcaaattctcttccataaatagtagttacaggatagtatggtggaaaatggaaaaattgctgaattaggtattagaaaatcaatattctagtcagctctgctgaaagttttagtattaaattcatgatatttgtaaaatttatgttaagattatattgatatagagtacatacataaacataagcaattatcattaataatgttctgcatactccaaaaatatcattgacgatatgactcattatgtagatctatattcttagggtaaagaaacatgagataaatatctctgaatttatcacctcaaaaattctttctcttgtgatatgaatcaggcagtagaattacacatttttatttctgccttgactgttaagaagctctgcggctatgcttaagtataaaaaaactaacctagatttttttcatctaattctcacttttaaacgttttgattagccttattgtatatatgtttttaatggtaaactgctttaaataattttatatactatactacaaggctacagtaaccaaaacagcatggtactggtaccaaaacagagatatagatcaatggaacagaacagagcccttagaaataatgccacatatctacaactatctgatctttgacaaacctgagaaaaacaagcaatgggtaaaggattccctatttaataaatggtgctgggaaaactggctagccatatgtagaaagctgaaactggatcccttccttacaccttatacaaaaactaattcaagatggattaaagacttaaacgttagacctaaaaccataaaaaccctagaagaaaacctagccattaccattcaggacataggcatgggcaaggacttcatgtataaaacaccaaaagcaatggcaacaaaagacaamattgacaaatgggatctaattaaactaaagagcttctgcacagcaaaagaaactaccatcagagtgaacaggcaatctacaaaatgggagaaaattttygcaacctactcatctgacaaagggctgatatccagaatctgcaatgaactcaaacaaatttacaagaaaaaaaccaacaaccccgtcaaaaagtgggcgaaggacatgaacagacacttctcagaagaagacatttatgcagccaaaaaacacatgaaaaaatgctcaccatcactggccatcagagaaatgcaaatcaaaaccacaatgagataccatctcacaccaattagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagaactagaaataccatttgacccagccatcccattactgggtatatacccaaaggattataaatcatgctgctataaagacacatgcacacgtatgtttattgcggcattactcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctccgtaaactattgcaagaacaaaaaaccaaacaccgcatattctcactcataggtgggaattgaacaatgagaacacatggacacaggaaggggaacatcacactctggggactgttgtggggtggggggagggggagggatatctttaggagatacacctaatgctaaatgacgagttaatgggtgcagcacaccagcatggcacatgtatacatatgtaactaacctgcacattgtgcacatgtgccctaaaactttaagtataataataataaaattaaaaattaaaaaatttaaaaaaaaatgtaaaatgcttccaacagtgcctgacatgtggcaaaacaaattaataaacgttatctgtatcacaaaaaataaaaaaataaataaataaataaataaaaataaataaaaataattttataggccgggcatggtggctcatgcctgtaatcccagccctttgggaggccgaggcggctggatcacaaggtcgtgagttcaagatcagcctggccaagatggtgaaatcccgtctctactaaaaatacaaaaaatttagctgggtgtggtggtgggtgcctgtccctagmtgcttgggagtttgaggcagagaattgcttgaacccgggaggcagaggttgcagtgagccaagattgcgccactgtactccagcctggygacagagcgagactctgtctcaaaaaataataatgataataataataattttataaaatacagggagtataaasaaaaactgatcacccaaattggagaaccaaattaatagttaatcttaacctaattaggagttaatcctacagggccaataataggcagagtgaagaaatctctgagttctcttgacccagcattatttttggtaagagcataaagaaagcagattgctataggatttaaatagatatttagtaaacaagtttgaatttcattttttctatcttcaacctgtaggtatamtatactagaagatagcctaaaatttgggtaatatttacttttatacttatttatactaaactaaactaaaatccacattaatgaaatcataaaataggataatgaaacttaatactacttaattctcccaattactagctaatgtctcaaatataagatatgttagaattaactgcaatatttacaaagtatacaaagcaattatgcagcattcctaaccagaattggtatatatgggataaaaagatgtcacataagataggccccttcaggtggaatgcagaagattggagttatcaaatgaattatcgaccttagtagagattaagcctataatttaaagtgaaaataacaacatttattgagtgccagacactgttctaaataccttacgtgccttaactgctgaatctttctaacaaccctactgaggcagttcctattatattatacccctattttactgatggggcacgtggatcaaagagaggtcagatcatttgtccagagcacatgggtaccaagtgacaggccatgatctgaactcaggaacactggctctgatgtgccattctttgccatgtcaccgtagctgccaagagcataggtttccctcttccgaaccctgcctcaagcaatgaaatttctagaaaagtatatgaagttttaatacgatagctgctatggtctgaatgtgccccttttaaattcatgcactgaaacttaatcatcaatgtgataatattaagaagtcgggcccttaggaggtgaatgagattagygagtttatatgagggctggagggagctagctaggccttttgrcccttttgtcctttccagcgtatgaggacaaggcattcatcctctccggaggacacagcaacaaggtgccatcttggacgcagagagcagctctcaccagacactgaacctgccagcaccttaatcttagatcttcagcctccagaactgtgatcaataaatttgtgtgtttttawaaattctaatgcaaggtttcttctataaggttattttgtctatgttgaaaatctatgttttagtttagtttacctttatcaatgatcttagctagatctgctggatcacttgctgcattcagttaaagacatcagcacttgctacttcaccttgcactttatgttatggagatggcttctttccttcgacctcataaactaacctctgctggtttcaaacttttcttttgcagcattctcacctctctcagccttcatagaattgaagagaggcatccgggtgtggtagctcacgcctgtaattccagcactttgggaggccaaggcaagtggaccatctgaggtcaagagttcgagaccaggctggccaacatggtgaaaccccgtctctactaaaaatacaaaaattagctgggcatggtggcgaatgcccgtagtcccagctactcgggaggctgaggcggagaatcgcttgaacgtgagaggcaggtgttgcagtgagccaagatcgcgccactgcactggagcctgagtaacagaaagagactttgtctcaawaaaaaaaaaaaaaaaaagaatcaaagagagcccttgctctggattaggctttggctggtttgatcttctatccagacctttcttcatgtcagaaatgagactgtttcgctttcttatcattcatgtgtcaatggagtagcacttttaattttcttcaagaacttttcctttgcattcacaatttggctaacttagctaacttaacttggctaatttggcatatgcttaatcatttcttcctttccttgaaagtacgattctttcacttggacactttgaggccactgtggggttactaattggcctaatttcaatattgtcttatgtcagggaataggaaggcccaaggagaaagagatggggaatggctggtcagtggagtagtcagaacacacatgtttatgggttaagtttgctgtcttatatggatgtggttcatgtcaatataacagataaaataataatgaaaaagcttgaaatattgcaagaattaccaaaatgtgacacagacacacaaagtgagcacatttaatgtatccagtaaaaaccaaagtgtttcttacagtctctgatgtttccttctgagtaattggtcattgggagctgtggttacacatagctgagtgaagcggacacttctgtgaaggcatggcttggctctwgctgggaagttttctgtttcctggcctgttcctgtctctcttctcctctccatacttgttgggaatggacctcatacctctctggaatgatgcagtgcaccaaacagtgaagaactgttgttgtttttaactgatttacataactgataataatatcatagctaacatttattgagctcaccatatgccaggtatgaagcttagcactttactacgttcattattgcatttaattctctcaacaaacttgcagcgcatatgcgattccacaggagagagctctatttcttttggttgaaaagttctttctaatacttgctgagctacagtaaacaaatatgtctattaatgccattgggaatttggaagcaaagtcttaacaaaatatagacaattcatttttgaataattgtgatttgattatgcttttggggaatatcagattaacaaagtgggtttgtttgtaaggattagtttgcaattcaggctcatagaatttttgtgtgtgtgtatacagttgtatcgattttattttattgagatggagtcttgctctgtcacccaggctggagtgcagtgttgcaatctcggctcactgcaacatccacctcccagattcaagcgattctcctgcctcagcctcctgagtagctaggattacaggtgtgcaccactacacttggctaaattttgtatttttaatagagacggggtttcactatgttggccaggctgatctcgaactcctgacctcaagtgatccactcactaaagtgttggggttacaagtgtgagtcactgcgcctggccagttccatgaattttaacttgtaaatagattcatatagccacagccactatcaggaggtagaccagtttcaccacttcagaaatctcccttggtcagtgctactctttgtagtcagagccactcccacctcagcctctgataaccaatgatctattctctattactatagttttgttttatttttttcttttcaggaatgtcatataagtggaataaaacagtatgtaaccttttgagattgggtccttcagcatgatgccttggagattcatataagttgttacatgtgtcaatagtttgttcctttttattgctgagtattattccactgtatagatacattgtggttgcattaatcagttcacctactgaagaacatgagttattttcagattttggtgattataactagagcttctataagcattcatgtacacttacgttttcgtgaagttttcatttttctagagtaaatacttaagagagtgggratactaggtcatatggtaagtgtatggttaagttttccagagcagctgtaccattttgctttcccactagcaatgtgtaaaagttcctgttgcccctattctttccagcccttggtatttgacagttctttttttctgtttttttttttttttttttwaracggagttttgctcttgtccaggctggagttcaatggcatgatctcagctcactgcaacctccaccttccgggttcaagkgattttcctgccttagcctcccgagtagctgggattacaggcacctacaaccacacccggctaattttttgtatttttagtagagacgaggtttcgccatgttgaccaggctggtctcaaactcctggcctcaggtgatccacccacctcggcctcccaaaatgctgagatttcaggcgtgagccaccacgcctggccttgacagtatttttaaaattttagcaactctaataggtgtgtagtgatatctcattatggttttaatttgcatttcactattgactaagaatattgaacatcttttcatgtgcttgtttgccttccatatattctctttggcatagtgtcttttcaagacttttgcccatttttaattgggtgtttcttttcctaggtaagtttttttgttttgttttgtttgtttgctttgagacggagtctcgctctgtcacccatgctggaatgtagtggcatgatctcggctcactgcagcctccacctcctgggttcaagcgattctcctgcctcagcctcctgagtagctgggactacaggcacatgccaccatgcctggctaatttttgtatttttagtagagacagggtttcaccatgttggtcagctggtctcaaactcctgacctcaggtgatccacctgtctcrgcctcccaaagtgcttggattacaggcgttagccatcacacctgacctatttttaaattttatattaatatattaactggatttttgtcaaatagagaattmtctttaaataaccatctcctcacttcacacttagtctgggaaaaaatgagagcaaatttctgtgcatccagggagcatatcaccaaccaggcatgaagcttaaagggagagtgcaggctgagtggccagcaggccatgggcatcccacagggccaggccaggacccaggcttcagcgacccttctcccagcccacctagtggccctcaaatccatgatgggacagacatgcattctcctgtcccagttgagaagccccttctagatggaagggagaggagaaaagccataggaaagaaatcccagaaacactagcaggtaagtacaggggcttcctccccagctgcggtgaccttgctcctgataacacccaacccctggagctcttcgccagtgtgcctggggctggagcctggcggggaagggaatgtgggctcacagtttctggatgttggcctcccacagcttggcacagaccaggggaaggcatgtgaggagggcctggggaggtcctcggggaagataacacagctcaggaggttgagtgtaaagtggctgccagaccaagggagctggatggactgtgaaggaggaggtggctggagagcctcctccatgtaaagctactagagcaaaaatagaacaaggggggacacccgtgccccagaggacagccctaaagatggtaacggggagcacggctgagcagcgccctggattctgagctagtgtggaaagctgggggccaggggcctctctcttccttcatcaccagttgctggtaactttacagtcagatttggaggaggaacaaggccctccatcgcctcccctagcctctgatgctgccccaaggggaggggtaagaatgggcaaagagggtgggaaacagggaggtgggagggagtctactgggtcttcttattttcagaggagggggctgtaatagtgtagtggcagaggctggttcctaggtatgtaggtgttgtgtgggttgcctggcactgacaactgcttctgtggctctggctttggctgccagagcagaggggccaatggggccactgaccagaggttccatgagcccagatagggcagtggcagggattgcaggcatcccatagctccatccatcatgggaggtcctggatagaactcagatggggactgtggattggggtagccaggagggcaaaggtacattccattggcaactggcagaggaaagacataggctctgttgggtatgtaagagtacccgtagcctccattgggggcctcgcccctggaggcttgaaatgccacctggagcattcattgtccaaactgctgtaaggttaacttgtatgaaccccagccctcccagccatctcccgcttcacccttcactgttcttttgaagtagttggcagcaaacaggctagttgatctcacagtccttcatcaggtgaaaaggcatcacgaaggcttcatggagttcttcttcttggacagaaagatgatcggtaaggggtaaggtagacgatgcctttcttggtccctttgaaggactctggcacattcttcttgtcattgaatgtaagttccacatggacgtaggacattaggatgttcttggtgttcttgatcactctgccaccctttgagtgattcttgttgagcacgatagtctcttggaaaggggtcctaagactctcgatgcagggccttgagttcgtttttgcataaaggagttggtttagattgaggttcctttttttggcatataaatgtccaattgtccatttgttgaaaagactactctttctccattgacttgcctttgcacttttgtcaaaatttattggccatgtttgtgtaggtctatttctggaatctgtattctgctctattgatctgtgtgtctatcctttcaccaatacacactgtcatgaagtcagagaggtaacaggaagccagatcatgtagggccttgtagaccattgaaaggatttaggcttttatcttgagtgaaatgaggagctacaggaaggtgctgggcaaaggaggaacctgactttattgaggcaaggataggaatgtgaggttactgcagtcatccagatatgcaaaaatggtggattggaccaggatgatgggtagaagtggtgaaaagtagtcatattctgaataatttttgagagtagccccaatgggattttctaatgggttgaatgtagagaatgagagataggcatgagaaaagaactctagtctgagggtttagcttgaccaacgtgaaaaatggagttatcaattgagatgggaaaaccttcaaatgaagcacattttaggaaggaaggtcagaagttcagtttcgaacatgttaagttttaaatttctattagaggtccacctgtggatgttgagtgaatagtgggtgataagggctaagagcttgggagagaggtctgggaatggaggtatacattttggatcctggcggggcacctgggatcacgcctgtaatcccagcactttgggaggctgaggcgagcggattacttgaggccaggagtttgagacgagcctggctaacatgacaaaaccccatctgtactaaaaatacaaaaaattagccgggcgtggtggtgcatgcctataatcccagccactcaggaggctgaagcaagagaattgcttgaacccgggaggtggaggttgcagtgagccgagattgtgccactgcactccagtcttggcgacagagcaagactctgtctcaaaacaaaaacaaaaacaaaaaatttttggatccatcagtagatagatgctatgtaaggccatggcattggtgaaatcaccaagggcagatatgtagagagaaaagggcaagcactgagccctgggtcactgcagcattgagaggtgggggacaaaaaaagaaactggtaaaggagactaaaaaatagtagtgaggtagaaagaaggtagacaatgctttctgagagccaaataagaaaatgatatccaggaagtaaatgatcaacagtgcggatgctgctaataagtcaaacaagacgaggacatatattgaccattgggtttacgaacaaggggtcattggtcacctcagtgagagaagtttccatagagtgttgggagaaaaaggctgaggatagtaagtttaagagagaataaaaggagaggaattgcaggcagagaatagaagcgtttttcatggagtctgtttgcaaataggaccaaagaaatgaggaggtagctaggggacgagatgggctcacgtgcaagttgttgggttttattcctttttaagatggaagaaataacatttgtgaatgctaatggccatgaccccataaagtgggaaattttaatgatgtaagaaggaaagagaagaaagcctagagcaattgatttccttgagtaaaggagaaarggatggaatctagtacaaaaatggagggattgcccttagaaggagctagaaaatttaatatatggtaacacttggaaaagcagaatatgtggatgtggatgccagcatatgggtagatagatgtgagtgaagcaagtcctcttcagtctgcttccatctcctcactgcggtggaagcaaggtcagcagctgagagggaaggtaggggaggggctgagatttgaagggacaaaagtgggcgataatcacctgggagagtgaaccgtaggagtcatgggagtgagtgcctgccataggagagaagatccctcaaaaagaggaattcagggctggatgcagtggctcctgcctgtaatcctagcaccttaggrggctgagatggaaggattgcttgagcccaggaggtcaggactgcagtgagccaaggtcacaccactgcactccagtctaggcaacagaatgagaccctgtctcaaataaataaataaataaataaataaataaataaataaataagyaarcaaataaataaataggaattcaagaattgagatcatctgtgtgggtattgagaatgccaggaattaagaccagaaattctagagatgatggcaatggcaatgagaaatgaaggggaatgagttggtgtttgctacrtaacagtaacagtgctggatagcggatgatagaatctgatgacatgaggtttaaagcacagaatttttagagaggagagaaggagaatgctctgaaagcagccacgtggagcaaaagcggcgtctgtctcacctcacyttccagccatgtggagcaaaaggggcatctgtctcaggcccagtggcatgggagtgaaatagcacttcagagagttgcaggggaaacagtgtccccaagggagagtcaggtttctgttaaaggaaggtgcattatgcacatctgtgaaattatcatgactgctgtcatcccatctgctcatagaaccagtgaatattgattggtcataaaatgcaagcattattttaaggagcatggacatttaatttctcttttaaggactggaaataattttttccatgatttggaaagtgatattatatttgtcaatgagaaataatgtaatagctttttaatagttcacaaaatgatgtcasttgctctytattcaaaaatatctttagcctttttgaggttattttggggagatgataaggacaggcatctccataatcccaaatatttgggagaaaacttcaaaaattaaagcgtatttaggctgagcatggtgactcatgcctgtaatcccagcactttgggaggtcaaggtgagtggatcacttaaacccaagagtttgagaccatcctgggcaacatggcgaaactctgtctctacaaaaaatacaaaaattagcagggcatggtggcrtgtgcctgtagtcccagatactcgggaggttgaggctgcagtgagctgtgatcataccactgcactccagcctgggtgacagaacaagaccctgccccctaccccctcctccaaaaaaagcatatttaaatattcccrgaatccaaatgttgaacatcatttggacacagcttcaaaatggtaccaattcttttaatttgtgactgctttatttatttatttatttatttatttatttatttwtttattattatactttaagttttagggtacatgtgcacattgtgcagattagttacatacgtatacatgtgccatgctggtgcgctgcacccactaactcatcatctagcattaggtatatcccccaatgctatccttcccccctccccccaccccacaacagtccccagagtggggttccccttcctgtgtccatgtgatctcattgttcaattcccacctatgagtgagaatatgcagtgtttgtttttttgttcttgtgatagtttactgagaatgatggtttccaatttcatccatgtccctacaaaggacatgaactcatcattttttatggctgcatagtattccatggtgtatgtgtgccacattttcttaatccagtctatcattgttggacatttgggttggttccaagtctttgctattgtgaataatgccgcaataaacatacgtgtgcatgtgtctttatagcagcctgatttatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgaytgccattctaactggtgtgagatggtatctcactgtggttttgatttgcatttctctgatggccagtgatggtgagcattttttcatgtgttttttggctgcataaatgtcttcttctgagaagtgtctgttcatgtccttcacctactttttgatggggttgtttgtttttttcttgtaaatttgtttgagttcattgyagattctggatatcagccctttgtcagatgagtaggttgcraaaattttctcccattytgtaggttgcctgttcactctgatggtagtttcttttgctgtgcagaagctctttagtttaattagatcccatttgtcaatkttgtcttttgttgccattgcttttggtgttttatacatgaagtccttgcccatgcctatgtcctgaatggtaatggctaggttttcttctagggtttttatggttttaggtcaaacgtttaagtctttaatccatcttgaattgatttttgtataaggtgtaaggaagggatccagtttcagctttctacatatggctagccagttttcccagcaccatttattaaatagggaatcctttccccatgactgctttatttctgcattagacaataagaaggggccgaaacttctggcctgatatgacagtgacatcaacctcttgtgtagtagcctgtcattaagccagcgccaaatggaaaattaaatggaaaatggcagagagcattgcccaggacataatgtagaaatggcaactctggcactgacataggtttaaaaaaattatgttttaaaagtaatcttgctgggaggccaaggcgggcatatcacttgaggtcaagaattcgagaccagcctggccaatatggtgaaaccccatcgctactaaaaatacaaaagttatgttggcatggtggcgggcacatgtaaccccrgctactctggaggctgagacaagagaatcgcttgaacccaggaggaggaggttgcagtaagctgagattgtgccattgcactccagcctggatgacagagcaagagtctgtctttaaaaaaaaaaaaaaaaaaagtargcttacacatattccctttactgtttttcaaggtcattacatttttatctgttattgttcaccatttaaaaataagcagtggaaagcagcctactttttaaaatgcggaactcgtatggtgtacttagcatatatataaggatttctgtcctctctcttgcctccctccctcccgttcttcccccttcctcctccttccttccttccttccctccctccctcccctttcctatcttctgagtagggtcaaacaccagttctctacttctyggaccataagaataaagatctgtgcacaatccattttgtacatattgattcttggactaaaaatagctcaatttggtttcaaactttttctcccaccctaagttcaggttttgttccttgtgcagcctggtaggcgggcaagtaatgcatagtcagcattccatctgggatgcttactggacaattttaatcttttttttacgtcttgacctctatttccaaagagcatcccagttggcaggtctagcctgattaagattctgttcaggcatttaattctcctaagggaatttacagattaatctaaaaatcaaggataccagaatctactcaggacttaacttcttgaaggttataggaaacatatacttgagcaacctaatgaatgagcttagtgatatcgtaatgaatttttatatatacctcaaattacactttttaatgcatatccaacaaaaatatttttaaaaacaaatactgtagacctaactggattagctgtattagtagatccaaatttaactttcaatttgaattaagttagaacactatggatctcataaggcaggctatatattgattacctagttagccagcttccatatcaccacttgttcaggaacattaaaagtacttttttagaaatagttttctgatatatttttggtttcactaagacagctttttaaaaagcaaaattaggcagggcgtggtggctcacgcctgtaatcccagcactttgggaggccgaggcgggcagatcaccggaggtcgggggttcaagaccagcctgatcaacatggagaaaccccatctctactaaaaatacaaaattagccaggtgtggtggctcatgcctgtaatcccagctacttgggaagctgaggcaggaaatcacttgaacctgggaggcggaggttgtggggagccaagatcgcaccactgcgctttagcctgggcaacaagagcaaaactccgtctcaaaaaaaaaaaaagaaagaaagaaagaaagaaagaaaagcagaattataactaaacaccactttttttttctttctttttttttttttttttctggagttagagtctctcactctgttgcccaggctggagtgcagtggcacaattttggcttgctgcaacctccacctcctgagtggaggttactcaggcaatcctccwgcctcagcttcctgagtagctgggactacagccatgtgccatcacacctgaataatttttatattttttgtagagacaggatcaccccatgttgcccaggctggtctcaaactcttgggctcaagcagtctgcctgcctcagcctcccaaagtgctgggattacaggtgtgagccactgttgccagcctaaacatctcgtctgaggctatcacaatatatactattctccagcctacagtagattatagacatctagaatataaaaatttgtttcctgataggcttggcacacaatattcctacagtcctttgaaaacacacatattaacagagtgacaatatttacaggcagaattactcatgtgtcttattgtagcttacaggagagtgtgtctgtctaagaatggggtagaggttggtttgtaaaaacaggtgtcccacaagctttcttggatagttaactcagtagttagaatgaaggatgtaaaataacctgtcaggataacacctgctctcttgccctcaacaattaatgataatgaaactaggcctgaagaggaataaaaatcttgtatcatctttgaattagtcttttgttggtcgtgcgttccaatgaaatgatgtttcacaaccttttcttcattatcatctctgaaaagatcctttatggctatttttttttcctagttgccacaaaattaaacacaggcatactgtgtcttactgtgctttgctttcttgctcttggaagatattgtgggktttttttttacaaattgaaggtttgtggcacccctacattgagcaagtctactgggaccattttcttttcaacagcatatgctccttttatgactgtgtcacattttggtaattcttacagtatttcaaactttttcttttctttttttttttttttttagacagagtctcgatcagccacccaggctggagtgcagtggtgcgatcttggctcactgcaacctccgcctcccaggttcaagtgattctcctgcctcagcctcccaagtagctgggactataggtgcatgccaccacacccagctaatttttttgtatttttagtagagacagggtttcaccatgttggccagactggtctcgatctcttgacctcgtgatctgccctcggcctcccaaagtgctgggattacaggcgtgagccactgcgcctggcccaaactttttcattattgttatatctgttatggtgatctgtgatcactgtctttggtgttactattgtaattgtttggggatggcctgaactgcatccatataacacttaattgaggccaggtgtggtagttcacgcctgtaatcccagcactttgggaggctgaggtgggcagatcgtgaggtcaggaattcgagatcagcctggccaacatagtgaaaccccatctctactaaaaatacaaaaaaattagctgggtgtggtgacgcacacctgtagtcccagctacttgggaggctgaggcaggagaatcgcttgaactggggaggcggaggttgcagtgagccaagatcatgccactgcactctagcctcagtgatagagcaagactccatctcaaataataataataataaagacttaattgatacttaatccataaatgttgtatgtgttctgagtgctccacccaccagctatttcccatctttctcctcctcctcagacctccctattccatgagacacaacaatattgaaattaggccaactaatagccctacaatggcttctacatgttcaagagaaaggaggagttgcacatctctcactttaaatcaaaacatagaaatgattatgcttagtgaggaaggcatgttgaaagcctagataggtcaaaagctaggcctattgtgccaaacagccaaactgtgaatgcaaaggaaaagttcttgaaggaaatgaggagtgctattctgttgaacacacaaatgataagaaagtgaaacagcctcattgccgatatgcagaaaatttgagtggttctagatagaagatcaaaccagccataacattcctttaagccaaagtctaattcttttttttttttttttttttttttcagagtcttgctctgtygcccaggctggagtgcattggcacaatctcggctcactgcaagctctgcctcctgggttcacgccattctcctgcctcagcctcccatgtagctgggactactggtgcccgccaccacacccggctaatttttttgtatttttaatagagacagggtttcaccatgttagccaggatggtctcgatctgatctcctgaccttgtgatctgcccgcctcggcctcccaaagtgctgggattacaggtgtgagccactgtgcttggccaccaaaccctaattcagagcaaggccctaactcccttcaattcactgaaggctgagaaaggtgaggaacttgcagaaggaaagcttgaagccaatgggttggttcatgaggtttaaggaaagacaccatcttcataacataaaagggcaagtaaacagcaagtgctgatagagaagctgcagtaagttatccagaagatctagctgagatcattggtaaagctggcttcaccaaataacaaatcttcaaatgtagatgaaacgactttgtattggaagaagatgccttcaggctaggactttcatagctggagaggagaagtcaatgcttcaaagtttcaagggacaggcttttgtcccttgggctcttgttaggggctaatacagcttgtgactttgagttgaaggcaatgctcattgaacattctaaaaatcctagggcccttaagaatgatactaaatgtactctacttgtactctattaatgaaacaacaaagtctgaatgacagcacgtctgtttatagagtggtttatcaaacgtttaaagcctgctgttgagayctaccactcagaaaaaaaggttcctttcaaaatattactgctcattgacagtgtacctggtcacccaagagctctgaaagtataaggagatgactgttgttttcatacctgctaacacaacatccactgggcagccaatggatccaggagtcattttgactttcaagtcttattatataagaaatacattttataaagatatagctgctgtagatagtgattcctctgatggatctgggcaaagtctattgaaaaccttctggaaaggattcacmattctagatactgttgggaggaggtcaaattatcaacatgaacaggagtttcgaagaagttgattccaaacctcatggtgactttgagggctttaagacttcagtagagcaggctgggcatggtggcctataattccagccctttggaaggctgaagmgggtggatcacaagcatagagttcaagaccagcctgggcaacacagtgagacccccatctcctaaaaaggatttttttttaagacttcagtagaggaagtactcgtaaatatggtggaaatagcaagagaactagcattaagaatgaagcttaaagatgtgactgaattgctgtaatctcatgataaaacttgaatggatgaggagttgcttcttatggatgagcaaaggaaatgatttcttgggagggaatctattcctggagaagacactgtgaaagttgtcgaaatgacaccataggatttagaatatcccataaacttagctgataaagcaggggcaggctttgagaggatcgactgcaattttgaaagaagttgtaccrtgagtaaaatgygatcaaacagcattgcatgcttcagagaaatctttcttcacaaaaggaacaattggtgcagcaaaattaattttcttattttaagaaattgtcagccgggtgtggtggctcacgcctgtaatcccagcactttgggaggccaaggtgggcagatcacctaaggtcaggagtttaagaccagcctggctaacatgctgaaaccccatttctactaaaaatacaaaaaattagccgggcatggtggcacgcctgtaatcccagctacttgggaggctgaggcaggagaatcgattgaacccgggaggtggaggttgcagtgagccgagatcgcgccattgcactccagcttgggcaacaagagcaaaactctgtctcaaaaaaaaaaaaaaaaaaaaggctgggcgcagtggctcacgcctgtaatcccagcactttgggaggccgaggcaggtggatcatgaggtcaggagatcaagaccgtgctggctaacatggcgaaaccccgtctctactaaaaatacaaaaaaattagctgggcgtggtggcaggtgcctgtagtcccagctacttgggaggctgaggcaggagaatggcgtgaacctggcaggcggaggttgcagtgagtcaagattgcaccactgcactgtagcctgggtgacagagtcagactccgtctcaaaaaaaaaaaaaaaaaaagaaaagaaaggaaattgttggccgggcgctgtggcttacgcctgtaatcccagcactttgggaggccgaggcaggcggatcatctgaggtcaggagtttgagaccagcctgatcaacatggagaaaccctgtctctactaaaaatacaaaatgagccgggcgtggtggcgcatgtttgtaatcccagctactcgagaggctgaggcaggagaatcacttgaacccaggaggcagaggttgcagtgagccgagagcgcaccattgcactccagtgcagtggagtgcagtggtgcgatctcggctcacgatcgttagcgttttttaacactcaagtgtttttggttttgttttttgagttggagttttgctcttgttgcccagcctggagtgcaacaagagctggcatgatctcagctcactgcaacctctacctcctgggttcaagtgattctcctgcctcagcctcccaagcagctgggattacaggcatgcaccaccacacccggctaattttgtatttttagtagagatggggtttcaccatgttggtcaggctggtctcaaactcccaacctcaagtgatctgcccgcctcatcctcccaaagtgctgggattacaggcatgagccaccatgcctggcccactcaagcattttttaattaaggtatgtattttttagatatggtattgaacacttaagagactacagtatagtgtaaacataacttttgtatgcactagaaaataaaaatttcatgtgactcacttttttgagatatttgctttattgcagtggtctgaaaccaaacctgtaatatctccaagatatgcctgtactgaagagtaagattttgtcagttagagtttaatcttggaaagactacaaaccactgtaataacctaagcattatttgattccccaaggaccaattttcacccctttgggggccatattaattttttatggctgctataccaaagtactatgaattttatggctgaaaacagcacgaacttattcccttgtagttctagaggccggaaatgcagttcactgggggtaatgtcaaggtgtagggccatacccccaggaaggctctggggaagcgtacatttcctcttccagcttccatctttttctggcttccagacttgcattctgtgtgttcactgactcatgtctgcttcctccatctttcaaagccagcagccgtgtagcatcttgtttcaatgtcacgttgcctttttcttctgtcaagtctccctctgcctgcctctcatgaggacagtgtgattacacttagggtctaccttgctaattccggataatctctgcatctcaaaatccttaatttaatcgtatctgcaaagcttgtgttaccatataaggtaagagtcacaggttcccaggattaggaactggatatctttggggaccaatactcagccacagaggtgataccactccccaccccttaaaaatgcatgttctacaccagtaaggaagaaagaaaataagaaagaagagtaaaagataataaatatgtaactttggctacaaatgaattctttattatatctcattctatttggggcacttgctattagaacaaagagagaagatatatttaaaattaataggattcagaagagtagagttgatgatgttcacctcattgcgatgtactcacccattcatttattttgcattacccttcctgcctggggccagtcagcagaggagggcagtgagtcactccaaggtcagacagtattattaccctcttattgtgatgggcaaatccaccattaagcttcagattgagagaaacaccattgagttggcaaatgctttcgatgtgtacgtgcagaaagtcatatgtatctacaattttccagacagyggcaaagagaaatggaaactctgtgctgtattttaattggctgcaaaatgtttccttcagaaattaccattccattaagcacctactctgtgcaaacgctttgcaaacactgctgggaatagctgcatgtataagggcatgcctacctttattagactgttcaggggaataaaatgaagttacaatttattctaatactagaatgcagttctctccccatggactgcacctttcaggatagtggcctgaatcagagcagaaaacacctgctggatatcctccaagtacacagtctgattagtgccctctgggaaacatggaggcagatactacttggctctccagcctaagggaagtattattaattaaaaacttaaagccaggttcttctctgtgtatggttatgcatgtcctagatggccttgaaattgatctgttctccattagcaatctgtgaattgtactcctgtctgaaattgagtagaggtcagagctatgaaggttgaattcaacaagaatttttatgaagtataactagagttagtgctctgctctaactgcttttggagacagactttccccagtgtatcccatcaaatcacagactaaaaacagtctatttccccttattcttggccagataggacctaggcacctgaatttttttttaaactagatttccaggaaattttattgaaggctaacagcatagcatttcatgttggataaagaagatgcacaagacgggacatggtaagacacacctgtaatcctaccactttggaaggatgaggcaggtggatcacttgagctcaggagttcaagaccagcctgggcaacatggtaagaccctgtctctccaaaacaaacaaacaaacaaacaaaaaaacaaaaattagctgggcatgatggtgtgcacctttagtctcagctactcgggaggctgaagtgggatgatcacctgagcccagggaggtcaaggctgcaatgagccatgattccaycactgcgctccagcctaggatacagagtgagaccctgtctcaaaaaaaaaaaaaaaaaaaaaaaaggccatatgcagtggctcatgtctgtaatcccagcactttgggaggccaaggcaggtggatcgcttgaggtcaggagttcgagaccagcctggtcaacattgtgaaaccagtctctactaaaatacaaaacaaattagctgggcatggtggcaggcacctgtagtcccagctactagggaggccaaggcaggagaattgcctgaccccaggaggcggacgttgcagtgagctgagatcgtgccactgcactttagcctggccgacagagcgagactctgtcttaaaagaaaaaaaaaaaattcacaaaagaaaaattgtattaagtacaatttaatataatttcttacaagtttattacctaaaactttgcaaataattgaagttagaagctttggattttgtttttagagcttaatccttttctgtaagtggaaatcctttccactggtttattttccttttgattttattttactttgacaccctaaaggtttagtgttcctgtttttaaatctactgatcgtttcttatgagattccttagagtgccctttaagtatgcacagattttgcaaatgcattcattttcttatttgccagggtttaacactggctatgcacatgttagctgaataaccttaggcaagtaaattatcctctctgggcctcgatcttgttagctattaagtgggaataatgacaattcctaactcaagggtstgttgtgaggattaaatgagtccttacatgtgacatacttgaaatagtacctggtgcagagttagggctgggtgagtgttagctattrtattattatttcattgctgtttgcatatatttttaaaatgtatttaggattttctttttttttttgagacagggtctcactctttgcccaggccggagtgcagtggtacgatcttggctcactgcaacctccacctcccaggctcaagagatcctcccatctcagcctcccaagtagctaggattacaggcacgccccaccatgcctggctaatttttttttttttttttttttgtatttttggtagagacagggttttgccatgttgcccaggcttgtcccaaactcctgagctcaagcggtctgcctgctttggcctcccaaagtgctaggattacaggcatgagcaactgcgtctggccagggttatttcttagggatagcattccagaaatataattaaaatttattgatccagaaatataattaaaaataattgatcaaatggtagaagactttttaaatttatatttcatcaattttacacatttgttaggttttaatgtttctactacttgtgtgtgccaaaaaattattgattttcttaatcgttttctatgagtagaaatcctttccactggtttgttattttccttttgattttattttacttttgacaccctgaaggtttagtgttcctgtttttaaatstactgattgtttcttaggagattccttagagtgccctttaagcagagaatatctttccctctccttcctcttcccttcactcttctcaaaactataaaaatataatactcatttctacctgttttygtggcttttatactttcratgtgttcatctacatgagatttagtttgatgtgtggaacagcaagagagtttaaattaaaaatcttcccctaaatggctaaatgtcccagtgccatttacagtgtggtacccctcctgtaataagaatattacattcttatccgtattaattatttcttattcaaacttaccagtggcatttaagaaatcattagttcagttgtttataggtaagaagactcattctttatctgctatttcaaaattaaaatcattgtctttcatagatattttctgaaatgaaatatggaaaacaattatttttacaatgagacttggaaaaaaatcaatactaagtttcttttgtatacaagatagccaataatacctaggcctaaaacgttccaatctagttttttgtctgctaataggtgctcagtatgacggagcttttcttgaggaccatttgaccctgtgtctctctttgcctttccccttatgaaaataagctgacccctacatccaatcaaatcatcatagcaaggttttcatcattttttatggaatgtcagccttgccacctgcttgcctggtacccaatacatataatctctcttcaggctgcaacacacagcacttgaggcaggctgtcattaattggagttacctccaattgcctacttcttattctattcctatcaaaaacccagctgacaggtacacaaggggcatagcccaaattacatgtaatccrtaaatctctccattttttcttaagtcttagttttctcttgatataggattttttttttttttttttgagatggagtctcactctgtcgccaggctggagtgcagtggcacgatctcggctcactgcaacctccacctcctgggttcaagcgattctcctgcctcagcctcctgagtagctgggactacaggcacgtgccaccatgcccagctaatttttgtatttttagtagaaatggggtttcaccatgttggccagtatgatctcaatttcttaatctcgtgatctgcctgccttggcctcccaaagtgctgggattacaggtgtgagccaccatgcccggccgacataggctattttttaaaatgcaagctcttctgaaccatataatatgatgttttaaaatatagactctgaagacaaagacctgggctcagaatcaggccccaccacttattttcaatggaatcttgtctgaatcttgtaatctttccaagcctcagttttttcatctgtataatagggataaaaataatagtaaacaaataaatgtatttcttttgaatatctagtagtattttaaaaatcagataactagaattatataactctatgtgctttattttttacttgtttgctgggaatcaaagagcttagttttgttttttgttttttttttttttgagacggagtctcgctctgtcccccaggctggagtgcagtggygcgatctcagctcactgcaagctccccctcccaggttcacgccattctcaaagagcttagtttaagctcaattcargtgactatttgaggcctggtcaggatatctgctgttatttggaacacaagctgtttgcccaggactaagatcaagtgattttcctaaagcaaacagtgtattgaatgtaatccaaatcatcagcaggaacaaaggaggccatatagcttagcaattaaggcatgggatctgaagtcagagagacttggatttgaatcatggccctgacaagttacgtgcctctctctgcctgagtttcttcatctgttagatgagcataatattgcaatatagtgttactttgagaattaaatgaggtaatgcaaagctcttagagtagttactaggataagtgtccaattaaccatagtttaagaaaaaggataagctgggcacggtggctcatgcctgtaatcccacactttgggaggctgaggtgggcggattgtctgaggtcaggagttcgagaccagtctggccaacatagtgaaaccccttctctactaaaaatacaaaaattagccrggtgtggtggcgcacacctgtagtcccagctacttgggaggctgagatgggagaatcgcttgaacccaggaggcagaggttgcagtgagccgagatcgtgtcactgcactacagcctgggtgatagaatgatactctgtctcaaaaaaaaaaaaaaaaaaaaaaaaaaggaaaaaggatgaaatcacaacttggagcaaaaaaacccaaaggcatatttaaagatttgygtattgggttaaaacaagttttaacatctggaaagaaaaagcatccatcaacttttcttatcaagaaatatgaattatagccaggtccagtggtgtgtgcctgaagtcccasctgcttgggaggctgaggcgggaggatcacttgtgactgggagtttgaraacagcctggggaacatagtgagaacccatcaggaaaaaaaaaaaaaaaaaaargttgattaaaaaaagaaaaacaaaagaggccaggcacggtggctcacacttgtaatcccagcattttgggtggccaaggtgggaggatcgcttgaggccagtgattaaagaccagcctggacaacatagtaggactccatctctataaaaattttaaaaattagccagacatggtgccgtgtgcctatagtctcaactactttggaggctaaggcaggaggaatgcttgagcctggggggttgaggctgcagtgagctgtgatggtgtcratgaactctatcctgcagtacagagtgagaccttgtctcaaaaaaaatcatctttacagttatttkattatttgcagattttcagtgtttattgtttttactttccttgccccactattctgcattcatcaaatattcattgaacactgtctttttgccagagactgctgtaggcacaagagatacagcaaaaaacaagacaaaacccttgctctcatgaaacttacagtcaagtgtgtgagatggacataaacatagtactgtgctgtcatgttgtaaaatgggacctctcattgagaagctgggttggtttgggggtggggagtatgacatcaakagttctgttttgatcatgtttagttcaagatgcctgttatggtcaggcaccgtggctcacacctgtaatctagaactttgggagactgaggtgggtggatcccttgagttcaggagtttgagaccagcctgggcaacacagcaaaaccttgtttctacmaaaaatacaaaaattagcccggtatggtggtgtgtgcctgtagtcccagctactagggaggctgaggtgggaggatcacttgagtcatggtaacagactcgctctgggtttcgctctggatgacagagcgagaccctgtatcaaaaaaaaaaaaaaaatgcctattagaccttcaagtggtgaagacaagtaggtaattggatacacaagtctgggctcagggtagaggctgggctagagaaagaaatttgggagtcatcagtgaatagrtgacattttaagccatgggcttggaggagataacctaaggaatgacgagaatacatctgaagatccagcctcagacactctggtgtacagaagcaggtagagaaaaggagaaaccattaaagacctctgttgggccgggcatggtggctcacacctgtaatcccagcactttgggaggccgaggtgggcagatcactcgaggtcaggagttcaagaccagcctggacaatatggagaaaccctgtctctgctaaaaatacaaaaattagctgggtgtggtggtgcacactcacttcactctagccagtagtcccagctactcaggaggctgaggcaggaaaattggttgaactgtgaggcagaggttgcagtgagccgagattgcaccactgcacaccagcctgggcaacagagcaagactgtctcaaaaaaaaagaagactgagtgtgatggctcacgcctgtaatcccagcactttgggaggccaaggcaggcggatcacctgaggtcaggagttcaagaccagcctgaccaacatagtgaaaccccgtctctactaaaaatacaaaaattagccacgtggtggtgcgcacctgtaatcccaactattcgggaggctgaggcaggagaattgcttgaacctgggaggtggaggttgcagtgagccgagatcgcaccactgcactccagcctgagtgacagagcgagactccatcaaacaaacaaacaaamaaaaaaaacaaaaacccaagaagacctctgtctcctagagcagtcacctagaatcctagagaaaaatgtctttccaaaaggaagaaatgcagaactgtgtgagtaaaatgaagctaagaattaattactggrtttggcaagatggaggttgctgatgacttggcaggagagtttccctgaggtgataggaaccaaggtctgatgagagtaggctgaagagcaaatgtggagaaacagagatggcaagaatcaacagttcatrtcaggattttgctgtgaaaggcagcagagggatggggtaccattattttcattttgttttgttgttggtttctgctgcagtggtagtttatgttgagatgtatattttaaactgatgatccttaaagaaggagaaattgatgaaggagagaggtgggagggataattgcaaaaatgaagtccttgagcagtgagatctgcttccttattatgcatatagatgaaacattaaaatgtaaaacagactcttgtgctgattttaagaactctaagttagaagagggtggggagaactgggaagctggggagcccaagatgcaggattttggctctttagctcagctaggttcaggttcttgtctcacaaccaggaggaattaggcacgtggacaccagagggtgagtagagtagaatttattaagcaaaaggaaagctctcagcaaagaggggggtctggaaaagcaggttgttggctgcccccttcacagttgaatactgtgcttaaggcacaaattcctggcggctccaccccatccttccagtgcgcatgtgggcccttagggtgagccactccatattgatttacttcccttactgcacatgtgttaaggaatggaattttccactgcgggcatgtttaggcaagccccctgtgcaagttcccacatctgcacaaaatatctggtgtaagcatttgtggggcgggttggaggttctccagggacccttcccttactgtctgcctaaagcaagctggctaacttcttacacctgtgtattatacagcaccagtctttagggaaaggaacttcaggtgggtagggtagastatagcaatagctggcaagaaaaaaaagatttgaagaaacaaactctgtggtgccctagggagcagatgtgggatggaaaagtgaggctgggccttaaatcacaagaagcccaaggtgtacagggatctctttacaacagaacgtgttcttatatatgagttatttgaaatagcttaattataccactatactgtcattaataatggataaatgtacttcaaagtaatttattagtttgtctgtgaatatgtctttccttgtctcttttccccctyacctagaatgtaaacaagagagaagagaactccagatctgattttcatggaggaaggtgatacagatcattatggctgtaaggggaggattcttgtgtttcccaggtgtcctgaaaccattcacatggagcctaagttaaaatgctctgggttcgggagtgtcttcctggagatcactaagggcttcaggactccttgagatggagttttcttttctctctctctcttttttttttttagtattttaaaatgtatttcgttaattagcagcagtatgccaaagttgttccattattatattttgttcattcttttgtacaagtgtcttccaatgtgatttgataatgccaacaatttgcaagtgattttattgcagcatgactttggttcccaggaatgctgaagcacaggtcctagaacagaggcttgaaaaggaaataaaagggatttgatcataaatgcttctggggttggcataccagatcattttgagctcaaataggagacaaaagaaaggatgttgggaaagctgtatggtggagaggctgaactgttggaatgaaaagacaagaagcatattattatgttaattccagcaccctagatctgcaatgctgaaaggactgccaaaactaaagcttgtcctacaccacgttcatcacaaagaaattctgtttagacgttgagttaaactttctcaactgtattcagtacaggattaagtggttgagatgggccattctgcagttacactgtttccgttccartctgggtctcctcatgtattagctgtgtggaccttgggcaggtaactcctttgtgcctcaaagaaatggagatgacgataatacctacctcagtggggttattgtgaggataaaatgcgattaatagaaaataattagaatggtgcctgggatacatactgctcattaaacattgtatatttttattattagtgcactgtgctataataggatggctatctagaaaacatcatgcaatttgtaatgcacatttatcatccagttaattgaaagaggtagtgatgggacagtggtggcagacattgaatgctcagggatgaaaaatgagacaggttttatcttgttttgttttatttttgcctctcattaggtatccacctacttttcaaaattgtgttattttaatctttattrcatacagacatattctcagtaaattgaggccaccatatggaagtgtaaggatgaagccaggcgcagtggctcatgcctgtaatcctagcactttgggaggctgaggtgggcggatcatttgagcctacgagttcaagaccagcctagacaacatggataaatcctgtctctacaaaaaaaatacaaaaattagccagatgtggtggcatgtgcctatagtcccagctacttgggaggctaaggtgggaggattgcctgagcccaaggaggtcgaggctgcggtgagctgtgatcataccactcacttcactctagccagggtgacacagtgagaccctgtatcaaaaaaaagaagaagtataaggatgaaatcataagcttaggtcctagttcttttgagtgagttagaacctatataaaattttctccttttggaattttatttttctaatgtttacctcattattttctgactataatagaaaattatccttaaagtttgccattacaaagggaattgtacttctttaaaatgccaattaaaaatatcttcttgttgttcttatatatatttttaagttatatatgcatatgttaaaatatttaagtgaaataggaatgacataaaaataaaatcttcctcctcactacctcaacctccagtcccatgctatagaagtaaatacttaaattagtttgctgtaacaaattaccacaaactttgtggcttaaagcaacacgaatccatctcatagttgtgtagctcagcattctgaaatgcgtctcactgggtgaaaaattaaggcatcagcaggactggtttcttcctggaggctctagggaagaatccttttccttgcccttctcacgttctagaccccactattaacactcatatattgtttcagaaatgtttaatgctccttgatttttatcacctaattgtatattttctagaactctccattcttttatatacagctacatactgttctactatatggatgcaccagatgttatgtgtccagctccctgtgttaatggagtcttggtttattttcaagtttttattttcataaattgcatcataaataatatctttatactttcatatttatgcattttgacaaacagatccatgggataagttgttcttggtgtagtttccaggtaaagcaggatgtacatttacacttttgatacttctttttaaattgccttctcaaaagacatctattatctttccctccagtgatgagtaagagttcatatttccacacggttttggggcgctcgggagtttgttttttttacaaaacttttaaaactttaccactatatatataatatatttataataytatttataatatatatatttaaatatcatatatttataatatatatttataataaatattatatattatatatttataatawatatttataaatattatatttataataaatattmtatattatatatttataataaatattatatattmtatattayatattatatatttataataaatattatataatatatactatatattwtatatatattatatatcttgtatatattatatatataacttctctttttacttcgtttcacttgagttataaatttgccatgtttggaggttttcgatggtcctagcraaccagtttccctagaagcaacttcccttcagtccgattcacatcaaagatgtgacttcaataccatctgatgttcaagctatttattttagcagtggtcttacaagtcggatagtgggagcaggtgggtggcatgggccagattcaatcagaggtcagatgactgcctgtccaggagggtctccatctggagactattctcagagtttgggagattcttcccatttcttctacctgcatttagttcagtcaattatcaggcgtttctttcataagaggaggttaagctagtcttataagggtaagctttgttaaaggtttacgagatttgcatccgtgatgaggtggccttatgtcctggaaatccctgggccagcttggaaatccccaggccaggtggcctcacgctgctaagtggcacatagtgtcagtcctgtgagagcttgttaatgccttatagctatcattaatcttgtagtcatgatatgtctcctataggatgctacacagttggttttagcattttactatcgttttgttgttgattacttttgttttctttcgttttttgtttctgtttttgagacagggtcttactctgtcatcccggctggagtgcagtggcatgatcatggctcattgcaacctctgcctcccgggttcatatggaaggcagaggattctcccacctcagcctcctgagtagctgggactacaggtgcacaccaccgcacccaggtaatttttgcattttttgtagagacygggttttgccatgttgcccaggctggtcttgaactcctgggctcaagcagtcggcccgccttggcctcccaaagtgttgggattacaggtgtgagtcatcgtgcccagccagcatcttactatgtttattagccatttggattcctttttctttgaattgctgcttgttaatatattggcccttttttctgttacattattaataatgccaggaattatgctagttgctaygcaagatgcagacttgaggaaaacctggtcccagctttcaaaatgcttactttccaaatctgactcatcgtttgactttaatgccccactggacttctctaacagcattttccattttccctttcaaaaggactcaaaatatacaaatttaatttgatgataagagctcaagaaaggccgtggattctttttttttttatttttatagtaaaagtgatcagactgtttcctcttttaagaagaaaaagaaagcagaggtcaatattaagcttccaattaatgcttattcatcacaaatagtaagtaaataatgacagaaataattccttagtcactctctagcacacttctkttttatttttaacatttttcactatgtgagatttcctagatttgttttattttctgtttccctctaactgcaatacaagctcttgtggactggaaccacacctgtcatattcatgctgtatctcacctgtcatattcactgccaaatcccacctgccataatcactgccgtatcycacctgtcatawtcactgccgtatcccacctgccataatcactgccgtatcccacctgycataatcactgccgtatcccacctgtcataatcactgctgtatcccacctgtcataatcactgccgtatcccacctgtcataatcactgccgtatcccacctgccataatcactgctgtatcccacctgtcatatttactgctgtatcccacctgtcataatcactgccgtatcccacctgccacattcattgcggtatcccacctgccataatcactgcccatatcccacctgccgtattcactgccgaatcccacctgccataatcactgccatattccacgtcatattcactgccatatcccacctgccatattcactgccgtatcccacctgccataatcactgcccatatcccacctgccgtattcactgccgaatcccacctgccataatcactgccatattccacatgtcatattcactgccatatcccacytgccatattcactgccgtatcccacctgccataatcactgcccatattcccacctgccatattcactggcagatcccacctgccataatcactgccgtatcccacctgtcatattcactgccataccccacctaccatattcactgctgtatcccaagcttccagagtaggctctagcatttgtaggtgctcagtgaatatttgctgaattagcaaaatagaaaatttaaatctcttaacaggtaccacgttttgacataatcacttgtaacatctatttagaaatccataggcagcacaagcacataaataaaaacctgaccttccccaagatctttcctcctctgttcagcatgctgtgtcaagagcagcacattgtgtggtcactgtctcattcaattgggacagtcgcatcatctgccccttgctgaatcgagcctttgaattagatgaaggaaatttgggccaagtcttctggaatttagtgactactattatctagtttccctctggtgcaattagaaatgagcaatgaaccaatatataaccttgcttaaaaagcaatttcctttactattctccttgtttaattagtctgttttgttctccctgagctcgagaggcattttttctcccaaagcagaagcattaagtaagatgcattcagtgttttcatgagattcattcattcttcttggacaagatcttggccactgtattagtctgcttgggctgccataacaaaatatcacagaccaggtggcccaaacaacagaaattgatttctcacagtyctggagtctgagaggtctaagatcraggtstctgctgatttggttcctgctgagggccctcttcctgcttgtgacagccaccttcttgctgcatcctcacgtgacttttcctctgtgcttgcatggagagaaagagacaacaagacagattcgctgatgtctcttcatataaaggcactgattccatcaggccactgatcccatcatcccccagcctcatagcctcatccaatcccatttamttcccaaaggccctatctccaattaccatcacattgggaactggggcttcaacataggagtttgggggaactcaaacattcagttcataacagccaccatgtgccagtcatctggacagaggttgaaaaagccctatccatgccaaaatcttacctcttaaggtagtagaggcatactgctaatgtgaacctttaaaaatgctcatttattctacagatattccttgtttatgccatattactcactggcttaaaaatcttctaatgatgaggcatggaacttggagaaaccacccaaagtttctaccatgttctgcaaggctgtgatcaggcacctgcttacctctcacactgctccagccacactggcctgcgtgctgctgctttctcccttagggcctttgctctggctgttcattctccttgtggtgctttgccccagatagctggctcattctcatcattcaggtctcacttaagtgtcatctttcataggacatccctgatacccaatcagaattactcccttggccagctggcctgtgccagatgctttgctggatatgaagacacaaagatcagtagtgcggccaggcgtattaaaatattacccttaatcaatgttgactcgacattaataatagagcatattaatgataatattattaattaattattattaatttatcaatagagcagatattgaacacttactatttgcaaggcattatgctaagtctttgccattattataattattgttattttattttttattcttttagaggtagggtctcactctgtggcccaggctggagtgcagtggtacaatcatagctcactgcaaccttgaccccctgggctcaagcaatcctcctgtctcagcctcctgagtaggcaggactacagccatgcactaccatgcccagctaattttttaattttttgagacgggtttttgctatgttgcccaggctgatctcgaacttctggcttcaagcagtcctcctgctttgaccttcaaaaatgctgggattacaggtgtgagccactacgccctgccctttgccattatttatctaatttaaccctcacagccatcctctgatatacatatgattatcatccccactttgggtcagatcataaaaccgaaccttaaggaggtcaactcacctgccaaaggccacacacaggaaagtgatagagctgagatttacccagttttgttgagcttcaggttttaaagccagaaagatttctcttttagaaaatgataaagaaaagtttttttattttgaaaaattgaacaaataatagataagaaggaaaattgtaaaaagagacagtgatgactaatgaagataaagttgttttgtaatcagacagaccctggtttgtattctgacccagccaccaattggctgtgtcactgtggattcaacacttctcttatctttgttttttatctgtaaaaaggaagttatgagcattacacgaaataaacactgacatgaacagattctcattcaatgttagtttgattttattgaataatattaacaaattacagtatctaattatgcagttcatcatcagacacaaataagcacttaatttctttttaatgatataaaatcttttctggctgggtgtagtggctcacgcctgtaataccagcactttgagaggccaasgcgggcggatcacaagttcaagagatcaagaccatcctggctaacatggtgaaaccccgtctctgctaaaaatacaaaaattagctgggcatggtggcaggtgcctgtagtcccagttacttgggaggctgaggcagaagaattgcctgaaccggggaggcggaggttgcagtgagcagagatggcaccactgcactccagcctggtgacagagggagactcygtctcaaaaaaaaaaaaaaaaaaaaaaaatctttttaaagcatcactaggatcagaaatgcaaatttttcagaaatttcaaaaatgtggagaaaaggttggacattttgttagggaagtaaaagcatatacatataaaattatatttgttctggaatataaaatatgttatttgtattgctcactatagatctagkgattgtaagaacttatgtagcattttatcaagcctccatatctctttggagacttcaaagactttagaaaggtatagataatatcaaatgttggtcaagatggtagtcaacaggaactctcaaacattgagagtaggcatgtaatttggtacaaccatcttgaaaaactgtttggccttatctagtaaagctaaagatgtatagatcctaagatctagcaattccagttggaggtatgaaccctagaaagscttgcacttttgagtcagaagatgtagacaacaaaactcacagcagcactgtttgtaacagagaaaactaaaaacaacggaaattactatccacagtaaatagaatgaattacagtaaatatggttatacaatggaaccttatgtttgtgcagtttattcaagtggttgcatgtggccacagttcattttgttctcaatatatataatatatagatgatacatgtatgtgtgtatacatatatttcattgtgtgactatactacatttaatttttccattctgttgtcatttgacgtttcagtttcagatagttagctattatgaaagagctactatgaacatccttgttcatgtattttggagcatgtatatgagcatttctgtttattatacgcctagaggtagaattgcagcagagtatgcttgttcagctttagtagagactgccaaacaattttccatagtggttgtaccagtagacaggcccaatatgtgagggtttgcttactccacagcttcaccaacatttggtattttttcatttcaatacttactttcattttcattttatatttcatttcaaaactttcatttcagtattttagttcattttgatgcattttcattgtagtcactctagtgagtgtatagtgatattgtactatggtttcaacttgtattttccttatgactaatgaaatcgaagaccttttaatatgtgtgttggtcatttgatatgctattattttaaagtaataaatatagggtccagacctatggggcttagcgggtgttctctccgtgtgtggaracgagagatctaagaaataaagacacaagacaaagagataaagagaagacagctgggcccgggggaccactaccaccaagacgcagagaccagtaatggccccgaatggttgggcgtgctgatatttatcgtatacaagacaacggggcagggtaaggagggtgagtcatccaagtgattgataaggtcaagcaagtcacgtgatcataggacagggggcccttcccttataggtagctgaagcagagagggaagacagcatacatcagcattttcttctatgcacttatcagaaagatcaaagactttaagactttcactatttcttctaccactatcttctaacaacttcaaagaggaaccaggagtacgggaggaacatgaaagtggacaaggagcgtgaccactgaagcacagcaccacagggaggggtttaagcctccggatgactgcgggcaggaatggataatatccaacctcccacaagaagctggtggagcagagtgttccctgagtcctccaaggaaaggaagactccctttcacagtctgctaagtaacaggtgctttcccaggcactggcattaccgcttgaccagggagccctcaagtggcccttatgtgggcgtaagagagggctcacctcttgccttcttggtcacttctcacaatgtcccttcrgcacctgaccctatacccgccgttattccttggttatattagtaacacaacaaagagtaatattaaaagttaatgattaataatgtccacgatcatctctatatctaatttgtattataactattctaactgttttctttattacactgaaacagtttgtgccttcagtttcttgccttggcacctgggtaatcctccacccacaaataaataaaggattattggaaaaattacttaataagattgattacgatctatgtaaagcaatgtatcagtggactgaggcttggttatcctaacagtgacacatgacttgagaatctcagtagcttaaggcaaggtttaactcttgttcttgctgcatgtctatttccaacagtcagtgggtctgctccacatcagcatcattctggcagcttctgtgaagggacagcctcaatatggggcattgctggtctccaggcagagagaaaggagagatggcaacacaatgggccacacacaagttcttagaactttggctcagaagtggcacacacttcacttacactcacatttcattggccaaaggagatcagatgtccaagactgatgttagtgagtggattatataatctaaaggcaagggcttgtaggaagaggcagtcaatatttgtgaacaagagaatgatcagtaacatctttctgcagagtaggcttataagagtattactgtaggatagagaaaacaagctgtgtgtctgtgggctgttgtcaacacatatatatacactacacactttttttttttttttttgagatggagttttgctcttattgcccaggctggaatgcagtggcttgatcttggctcaccacaacctctgcctcccgggttcaagtgattctcctgcctcagcctcccaagtagctgggattacaggcatgcaccaccacgcccagctaatttttgtatttttagtagagacaggatttcttcatgttgatcaggctggtctcgaactccccacctcagatgatccacccgcctccgcctcccaaagtgttgggattgcaggcatgagccaccacgcccagcctcactttttttcttttgttttgttgaactggttgccaacgtttaaaaattatgacatttaacaaagatgcagatttctggcttcttttggaaatcctaagctatagcaagaatcatttggaactgagttgtagctgcccttctggtgggatgtgcactctctggttttccatgactgtatctgcctgtcttctctgcagcagtgcctttcaaacattttttacgtagctcacaataaacaatacattttacattgctaccaaggactcgcatgcatgtgtgtgtgtctgcattcatatataggtatagatatgcatatacatatacattccaaagtaaaatacatcaaggaaacagtgcttaccattactcattgaaattgtctgttctattctatcctattgtattctagtacttttttttttttttaatgctggaatcaactccctaaattgatttcacaaaccacttctgggtcatagcccataggttgaaaacatggttgtctatcatgttacttgtctgtttctcctctaaatgctattggttagttttctagcctggattcctgtctaagccctttagggtttcaggacaattcactgtgtgggtgagcagcatctgcttcccttcacttaaacctgggcaattactggttttgcccaagggtcttaaaacttaaactgcttgaatatctggcagtttccccgctgacttttcccttgtctgatttcctatttcaataaaaatagccttgtaggcgaatatgccactgattcggagaatctcagtttcctgactgggctaggcaatcaagggcaaatgaaagtgagtcctgttgtacaggaaggagagttctcagatgatgaggatggtcatggggactttgttaccgaaggaggcccaagctcatgatttcacaggattgattcctccatctcactgatcatttaacaaatacttatggatgacccatgtgccagaccctgtgctagggaactcatccaaaacttacaaaaatttctcctagatgcacagacgatgaatagtaattacctcttcctgtgttttacccttcctatttcttcttttcttcccttgacccagaaattcatcaattgccctagggctgttccggcttagtgcttgttggtcagttggatgtgcccttctgctcaggtctttgtgggctctcactggtgttcgtatgcatatagaatggatgtctgcatcacattgtagggacagtgtatggggatgtgaagacaataagtgaaagtctgccgcccactaagacacaagcagcattgctataaactccagtggaaaaaggtgatattatagggaaggaaaaccgtattgtcatattttcatggaattcagtgaattgcattttgaggaccagtgccattttgatgctggaggattccaccacctttgtggtgttgtttcctggaagagattctactactgaagtggtgttggcagcaggtgtacccagcaaaatcaggtagcaaggcctggtggaacttggcagaaaggagctcactggggccatcagagacagtagtgaggcccccttgtgccagttagggggcagcagagacccaaaagtggattttaccagaaagggttgaagcaggagaggaaggaaatggcgaatgccttgacaggccatgtttgtgagtccaggaagacaactcatgggagctctcagaaataattgtggggtgaggtgagtgcatacttggatagagatgttacagtacctgacaggggcaagacccagtaatatatgggttgttactattaaacgtgaccccattttaagtcgtgggtttatataacaaggttatttatgcttgttatatgctttatgtgcattacctataaatgtccttaaacttttatcacagtgcaaatgcagctcattaccagaatccgtgagcactgtcttcaaaccctccccattgccttgacattggctttttcttaattctgtctctttttttggccactctgctcttgatcttgtgtctacatctgagcctgaaattggagagtccttggctactctataatctgagtcttctacttcctgctttccctattcagtctcccatttccttctccagccccatccctggtactagcaagtccctccctgatgtcttcaccatcygttcctttcagacacctgccacccttcacattagcaaaatgacaaaaaataagaataaataaggtgagtatagtagattgcatagtggcccccaaaagatacaccacagagctccacacatactaacccttggtccctcagaatgtgacttatttggaataagggtctttgccaatgtaattaagataaggatctagagatgagtccatctcctgggttacagtgagccttaaagccaatgacaagtatccttataagagacagcaaaggagaaggtggccatgtgaagacagagacagagattggaattctgctgccataagacaaggaatgccaggggcaccagaagcaggagctttctgaaggtgcatggcccctgccagcaccttaatttcaagtgtctggcctccagaactgtgagagaacaaactctgctgtttaaaccaccaaatttaggctgtgagtggtggctcacgcctgtaatcccagcactttgaaaggccaaggtgggcggatcgcttgagctcaggagtttgagaccagcctggccaacatggtgaaatctcgtctctattgaaaaaaaaaaaattagccaggtgtggtggtgcacgcctgtagtcccagctacttcggagagaggatcacctgagcccgggcagccaaggctgtagtgagctatgatctggccactgcactccagcctgggcaacagagtgagagccggtctcaaaatcaaacaaaaaagccactaagtttgtggtaatttataacagcagccctaggaaactgagacaatgggtgaccatacagcaccaaaggacttctatttcatgattggtgaacattttaaaataagaaaaggccaggcatggtggctcacgcctataatcccagcactttgggaggccgaggcgggtggatcacgaggtcaggagttcaagaccactctcgccaagatggtgaaaccctgcctgtactaaaaatacaaaaattggccaggtgtggcggtgggcacctgtaatcccagctactcgggaggctgaggcagagaactggttgagcccgggaggcagaggttgcagtgagccaagatcacgccactgcactccagcctgggtgacagtgagactccatcccaaaaagaaaaaaaaaaaaaaagtattacagaaaagaatgtgagaacatgtttcaagtattaacaaataaaagaatgcatgctaaataattatttgcaacacatcatagagccagttctcacctggcaataaggtactccaaaagttcattcataagtaaattgagactcagaatgcatatttttcctgcaggagtcatgtgatatattatggatgttttcaaatattaatccataataatcattttaagttaatcatatgcggactatagttttcttgaagcgagggattgttctacacgtatttaagtcttgctgtctagcagagtgctttgcatgggtagggcctccaataaatgcttgatgagtagtagttcattaaaaaattctttaaaattttttttaccacaaaacatctgcaagtagagtagttcattttttaaagcaccatacactaatatttaatagcagctgttttagagtcagattgcaaggcttcagatcctggctctgccacttacagaatgcaaatcattaagcaaatttacataatctctgtgtgcttcaatttatttgtctataaaattgtgatattaatacctatctcacaatgctgttgtgaggagtaaatgaattattatgtactaaatacttagaacattacttgcatgtacggattcaataaatcttaaatattgttattagctcttaagtatatctcctcaactaaattataaactctgaggaagaggcaagatcctatcctttttaaaatcccggcatctacacaatttcttgcatattgtgtgcactcagtgagtatttgttgaactactaaaaggaatgaatgattggctatatgtttacaataccttctccataaaaaatacatatagaattgataacattctaacatttgttacagtaaaaaatgtttttagaaattaaatagaattttttttttaagacagtgtcttgctgtgtcgcccaggctggagtgcagtggcatgatgtcagctcactgcaacctctgcctcctgggtccaagcaattctcctgcctcagcctcccaagtagctgggactacaggcacgtgccaccacaccctcctaatttttgtatttttagtagagatggggtttcaccattgttggccaggctggtctcaaactcctaacctcaagtgatccacctaccttggcctcccaaaatgctgggattacaggtgtgagccaccatgcccagcctaaatagaatttttaagatgtcagagcaaaaaggaaattattaccagtgtgaaattcttcactatattttagcccctaagaggcagagaccttgtcctgtttctttgtaactgctgcattttgcgtgatgttttgcagaataggcatgtgcgaccttgtacacagaaagggcttaagcaaatccttatgcagattcctggagttatttttctgtgctggtcgctcctttccagaattctactctgcaacttccagctgccttagccttctgaactcagagccccctctccttacctccacgaggcctctggggtctctgggtttccccttcttgcacttgcagtttatacattgcctccaagcagaaggcccaggtgtttctcatgctcatcccatctgtttcccctctaacagagattagtcttacaaggcctcgtgttcagtctgaaaacagctgcttcctgtacttcgttcagttctctaattgctcacaataaaaagctaagtcctttcttacttcatcatggcyagaagcagttcccatgcgaatgtcttggttaaaggagaaaaatgtataaggtaactataaactaagactttcacatcaattcagttggttcttttgttaagaattacagggttgggcacgatggctcacacctgtaatcccagaactttgggaggctgaggcgggaggatcccttgaggccaagattttaagatcagcctgggaaacatagtgagaccccgtttctacagaaaaaaaaaaaaaaaagtaaaaattaggcacagtgtcrcatgcctctagtctcagctacttgggaagctgaggcaggatgatcaatcccttgagcccaagagttcgcggttacagtgagctataattgtgccactgcattcagcctaggtgacacagcgagatcctatttaaaaaaaaaaaaaaaaagacaaaaagaaaagaaaattacagtataatttttctgtgttgaagagcttctgctggacaaattttcagtcttggtcggcagtttaactcaagaacagactcttctatcttcacttccagcttacataaattagaatggagaagagaattctaaagtataaagaatgtacactgttctctgccccaattacacatctgtctcacggcttgttaggcagcatgatgaataagcgtgtcatctctctccatttatttgtgcatccatttttatatccatagtctatagagactttcattgcttctcacaaatttgtttaaacttttaatagtgatatatacagacttcctcatctaagcacagacacgatttctatttaggtcatttctgtgcagtcacttcctcttcctaggtcatagccctgtagttctatcatacatagactgtctattttaatagaaacctgcagcaatggtggaaggaggggaacgggagtcatttcatcagaaagatgcattgtatctactggagaattttcttgtcttagaaacactagaaattatattttytggaaatttcaaattttactaaaatgtggtcattgtcaattatgtaacaggggctttccttttcaatatagcgactatcagtaatagtgctggaaatatgataacaggccacattctaaaaattcatttcctctttaattaggacctaactcttggaaactccttcatgtgagctgccacaacatcatctaaaagcaaactgccaaaaaatcatcttaaaccgcatcatctaaaagttattttggcaaaatgcatggtctcaaatggaagataatgacagctaagatagaatttagaatgagccccagcactttgggaggccaaggcgggtggatcacttgaggtcaggagttcgagaccagcctggccaacatggtgaaaccctgtctctaccaaaaatataaaaaawtagccaggcgtggtggtgcatgcctataatcccagctactcgggaggctgaggcagaagaatcacttgaacccaggagatggaggttgcagtgagccaagatcacgtcaccgcactctagcctgggcaatagaatgagactctgtctcaaaaaaaaaaaaaaaaatttagaatgagcacgaagttaatgaataatacctcagtcacattctagtaagaaaccattcctccytgtgggaattagagccctgcccccagaaccctggctctgaggtttgacttctgttatgtactgrcagtccccattacgctcatggttccatggtgccagcacaggagtggctgatgacagaggctgacatgtcatgcacatcattctgtctatctcattgtttagtgtctcttccttggtaaatgctctctgataggtgttaccatgcaatcgaaagatcacacacctgatactactatgtgtctatccatttgcctctttcctagacatcttatccctagcctttcaaactttctccttctggatccctgcatatgtacacagtgtatacaatgaactgtaattaaataaactacataatttacttattgattaggtctcttttaaactatttcttgtgagttcaagaaagcagagatctttgtagtttttttgttttgtattttaattactactgtatccctagcacttataatagtgtgtggcagagaacaagtactcagtaaatagttgctgggtgaatccatactaaatataaatctttgtcaattagtatatgtgtgagaaatatctattcctagttagaggctggtcttttcatttactttattgtaaatgatgtttgaatgaacagaagtatggaattttaatgtagttaaatttatcaatccttattaagctatttttttgtttcttatttaagaaattctctgctgcaaagtgataaatatgttctggtatattttcttctaacccatctttcccccactgatctgcaatgacatttttgttgttaattaacttttattaccagtgaatctgtttctaggctctctattttgtttcattgtctgactatcctttttaaaataagtttttttagagacagggtctaactctgttgcccaggctggagtgcagtggcacaatcatggctcactacaccctctaactcctgggctcaagtgatccgccgcagcctcctgagtcactgggactacaggcatgggccatcacttctggctaatttaaaaagtgtttttttttgaagaaatggtgtcttactgtgtagcccagactggcctcaaactcctggccttcctcccacctcagtgtcccaaagcactgggattacaggtgtgagccactgcacccagcctatcctatttatttttatttaccattatttatttttaattgctggacagtttgacaagtccagtttgagctagttatgtatcacatcccatttgcaagggttgtttgtcttgttcaaaggacaatgagtacaaccaatgtcaacagaagttgtttttcttccttcgaagagaagggatgcgccaggatggagagtgcctgcattcctgcccatcagggtactatggacactgagccccagatatgaacagatgtgcaacttctctcggagaaaacaaaataaaaaatacgtcattggtccatgttcaactgcccatcgtaaaaaagaaatacatcattggataagcaacttcattcaaaagtcagtgccacagcaagcaagaaattagaagcttgtaaaaataagatggaattttgagctgggcayggtcgctcatgcctgtaatcttagcgctttgggaggccaaggcaggtggatcacttgaggtcaggaattcaagaccagcttagccaacatggcgaaaccccgtctctactaaaaatacaaaaattagccaggtgaggtggtgagtgcctgtaatcccagctacttgggaggctgaggcagaagaatcacttgaacccaggaggcggaggttgcagtgagccaagatcgcgccactgcactccagcctgggtgacaataaaaataaataaatgaaatgaaaataaaataaggtggaattttcacccattgacaaaaagttaataattattattrtatctaatttctggacattgaatagctcataagccaacctacttatgagcatctgttttctggatgagcttcaaccgttgcaagtggatttttcttctttggactacttgtcaaactgtagtgtgaatcagaggagtttaatacagattgctgaagtttttgatttgtaggtctgggatgggacttgagaatttgcttttttccaagttcccatgtgatgttgatactgctggttctgggaccacattttgagaaactttgttgtcaataatgtgcccacagctgcattattttttttttattttcccaagaattaatgtcatcagatttaaatagtagtatatattaatactgaatgacaagttagaaagatagatttgtttaaaagataatattggaaataggcacatgaatattttgaacttaaaataaatgtttcagtgatttttattaaagtaatatgaatattgtcctccaaaactttgatgatagagttttgtttctttaatgtgaattactttcttacattgtgaaaacttagagcatattcttcctcaggcctaagtactgtataggaactattaagtgagaactttaacagtaattctccatatgcaaaaaagcatttttactagtctgtacttaacaacttgcaaatttgcttttatccraaaggaagagaattagagaaatgattttagtaagaaatgctaaaatcaaaaagataggtaaatatttaaggaatcattgtagtattcccaacagttttatagatgaaattttaagttctctgggttataacttgctttstgatgccattataaacctgayggctgagacactggtcgatcacccattaggaatatatgctaaaattgttgctttcagtttttaaaatatggcttaattttatgtttgcttaaaattggtttgttttggcctggtaatatctcgggtcccacacatatgatcattcacaattatcatatcgggctgagcagggtggctcacgcttgtaatcccagcactttggaaggccgaggtrgacagatcacatgagtttgggcccagcctggccaacgtagcaaaaccccatctctactaacaataaaaaaattagccaggcgtggtggcacgtacctatagtcccagctactcgggaggccgaggcaggagaattgctgaacccaggaggcggatgttgcagtgagccaagatggcrccactgctctccagcctgagcgacaaagccagactccctctaaaaaaaaaaaaaaaattattattatttagttttatcttctctatctgttaatgagagagactaaaataatgatgaagaaaacattttaatatggtatatgaatagtaataaaataatataataagatgtatctccaaaatctgaatctaatggtactatattcgtattatagctgattctttacaaaaagcagtcttggcttactggaaaattcacattttaaaagtcgatcagtttcattttttctggagaatgttagctttactgaaagtataaaagtttcgttgttgtagacaccaggtcctaataaaaacaagtaaaagaagaaaaagtttgttatgggtrgaactgattaagtgaggtaccactgaagaattaaagatatctcacacatactttgattaattaaatggtgaataagaacttgttttaatctcattattcaagtcactaaaatgttaaacaggtaagacaaaaaggcaattattacaagtttttacgtaaaactatgataagattttttaaaaagtgaaacaccacccatacacactgaattcatttggctggtattgattctgaatatgtattttataatatttcattggccttgacccacaaactaaacacagacattttctcaattagtcattttcaggtttattgcctaagatgctaattgaaattcagggcaggcaaaaatacatcattggcctttgtatatctttgaaaggccttctgatgggaccttgctccgtataaaggcttctcttctctgcaaactgaaagggaccctgtgtgtgaagtgtgttcagtggggtcttcaaggaacaacatagagagcagccgctggccagccggaagccaccatgcgctgtcctcaacagagcagctccaggctgtatgacccccaggcaattaggcaccaaaagaagatgytcacactttccaaaattctttcccagggctgggggaagggagccagacttggagcccctatgtggaacttagtctccaaggaaagaaagcatgttctcatcctacaaacactccattttctccctgaattagtgtcctttctttgaaccagatgagacttcgctcagagctggaggctatggccccttagttctgtttccacagtgcttccagccctctccccagtttggaggcccccraaatgaggcgcttatctctttgattttgtgaaagaaaatgcacagttcgtctatttggggcttctgaaagatgttaggccctgaagaaggttgactgggagactgagtggggagtgacagaccatgaccttaattactgaccttttgttatagattaacttccttcctattttattgttcctggcccagaccwgatagcacttgagataaaagatcccttgattattacatccttaatgtggaatgttaaatactcccttcccccaaggaatcactgcctaaaaccagtcagattgctgcgactgtgcactaaccttgtgtggaaaatgctgtcatcctgttaagcttccccataccgtgcctgtataaacaatcctcaaacctcgctgcttcagagcactaaccccatctttttggagtcctcctgggtgaccctcctcaaactttgtgctcagtattttaatcctattgcctggatctcgatttaaagttgataattttcagagaattcttcattttctctttgcatattttattgtttcctttccatctgtttttcttttacttactgcctgaagccaagagacaatgtcaaggtgtcttagtgaaaggagctcatacttaagggttcctgggtcaaaacctacatctctcatttcttagctctatgatctacctgtttccttaatctctctgggcctcagtttacccattattgtagtaaaacatgtactacaagttactttttatttaactacttatgccatatttaattcccaaccactaatattacatattagttatatattgttaaatcataatgttctttcactatttcttttatgactgagaaatttcttttcaatgtataaatcatatacatgttgctcctggacaaaactgagggtcaggctgctacttctcstggcccaataatgagatgcagacaaactggggaagagaggttttatttttgcatytggttacagggagaaggcctagaaattgtcaccacaccaactcaaaattacaaagttttccagagcttataaaccttccaagctgtatgtctacatataagtgtgcattcatctaaagacataagtgattaacttcttttaatctataactaagatctgagtcctgaagacctttctctggagcctcagtaaatttacttaatctaaatgggtccaggtgctagggtgattacccttatcttgtctcctgctaaatcacagaggtttggggagttccttcagacctccaataaacttgtgtgtggaggcctggggaatttcttcagactgacaataaaacttgtttattccagtctggccaacatggtgaaaccctgtctctactaaaaataccaaaaagttagcygggcgtggtgacgtgcacctgtaatctcagctactagtgagacctggcctgccacaatgtggttaaggaaacatattaaaacatttttaaaaatcaagattttccatttcaatggccttgtaattgattgaaaagtttattttgagtcacatggtgttctagactcttgtggagggtttagattggaaaataagtaatgacagtgaagcagttgttatgttcgtataaaagaaagaaaagaaaaacccacaggactttatttggttttaaaagtctatctgcaaagatatagtttataggaaaattcaattccaaatgtttctcattgctctggagtgtgtgaagaagaggcctaagaatattcttaggaaggcaaaaactttcagatgcagttcatatgcttgacacctctgtttcacttttggctgacttgtgtagtctgatttttggtcactgacaggctcagcatcatgagtgtgcaagacgtaagggaggcaggaccttgtcttttcaatggtgtcttcctgggtggctgccagaattcatcattattgcactctactctcatagcctcgatttctgtttttgtttgcttttactgaaattggagtagtgacacagagtcagatcattgaaaagactcacaagattccaaagggtatactggtagagtataaactggaggataaggtacagcgggagaaagcaagtaccagcagacacagagggggctgagactcctgcaagcagcgcctttcctcaggctcactggrtgtgctctgtgtttgggtgtgaaccaccaagatgcatgcatgatatctgttttcagggaagccaagatacaagtgtacagaaaagccattatacccccgtcacattgctgaaactggatgattaaaccacgtaccaagcggtgtctaaatttcagtaataatgatcagctagtagagggtgcctcaaggcagtttcagactttaaataacatagtagaaatcactagctagtccatttcatccttatcattgttgcagaactttctccttagttcagctaaaaccgggttcttgtcacacaaccggaaaagattaggctcagggacacatagaagggtgaggggcagaatttattgggtgaaaaggaaaaaggaaaaagaactctcagcaaagcgagagggagtcttgccaacaggccctccacctcacagactgaacaccaggccaccacacaggaactgaagaggccaggctcctccccgctgaacaagcgtaaacttctcttggctccaccctcttcccccagtgtgcaggtgggcattattcagagagaatcagctgagaaagggcaggctttatccgggaccagcagtccagttcttcagccttcaggctcttttaggcttgaaggcagggtttcgtgggggaccttggtaagaagagttcttttcgacactttaatgtagattgtaagaggtagaaaaaaattgatcacatttaacatatagttacttaaaaacacatctttgagttttctagacttctaatatgattgtagaaaatcagcgtggcagccaacttaagacagatcaatacctcgaagtctgtaactttaataagaacatcagaactgaaattctatattagttaccctattgtactcacagtcatggaatacagaacaggaaagattctggaaacacattttgatagtcagggtcacagatattgctctgtttcagtaaccaggttttctacttatgaaagttatttaaaaggcaatgaatattcaaaatgtgagcagctattgctaccattagctccagaatcagttctgaagaatttgtaggaagtcatcttgaaaataataaagcaatatatttttcagaaatagtatccactaaatcataatctgaggccactttactgaggcgtttatatttatatttatattaatttgttattttacacagaaagggaaactatgacctaaagacagagataacaataatctgattagcattagccaccccattccaacaacaaatcacgttaataaggcatttttagaagtagcaaagcatagtggttaagaacatatgttctagaactagacagtctgagtttgactcctgataccacttattttattctaaaacttttggcaaattattacataacctcccttgcctcagttggccaagctgtaaaatgggactaataatggtgtccaactcacaggattgctatgtaggctaaaaggttaaaagagttttatatttctaaaacaatgtgcttgtaatagtcttggcacattgtaaacattgtgtaagtgcttattaaacaaataaattcatgcttgtaattgaagatcgccatatgagatacacattctagtgatctatatgtttatcattagatatatgatatatacacacactcatatttcagtcccctgagggattaacttttaatcccttgatttgcaaatcaagttgtaaattacacgtataaataaaatacctttgtagtgattcgttcattataaaattatgctaactatgttggttttcatgtaggcataagctggctctataaataaagtttgaaaataagtaaggtataaaggaaccctggcgggatagataagatactaggaacagtggtttgggagtgaggatgggaagtagactgatgtggaacaagatgggagtgagactttttttagtcaccgtctatatttttataatttctgggtctggaatcagtatctcctcatcctaacttgttcatatgatgagttagagtcatatctgcctgctgttagttttttcaaagaatcttcaaatggggcaaccccctttgggtcccctccctttgtatgggagctctgttttcactctattaaatcttgctactgcactcttctggtccatgtttgttacggctggagctgagctttcgcttgccgtccaccactgctgtttgccactgtcgcagacccgccgctgattcccatcgccgctgactcccatccctccagatccrgcagggtgtccgctgtgctcctgatccagcgagactcccattgccactcccgattgtgctaaaagcttgccattgttcctgcacggctaagtgcctgggttcgtcctaatcgagctgaacactagtcactgggttccacggttctcttccatgacccacagcttctaatarctcatcgcatggcccaagattccattccttggaatccgtgaggccaagaaccccaggtcagagaacacgaggcttgccaccatcttggaagccgcccaccaccatcttggaagcsgcttgccaccattttgggagctctgtgagcaaggatccccggtaacattttggcgaccaygaagggacctccgaagcgtttgtctcttccagaattgaaactgtaaaactacaaatggttcttcaaatggagccccagatgcagtccatgactaagatccaccgcagacccctggacyggcctgctagcccatgctccaatgttaatgacatggaaggcacccttccggaggaaatctcaactacacaacacctactatgccccaattcagcaggaagctgttagagcagtcattggccaacctccccaacagcacttgggttttcctgttgagagaggggactgagagacaggactagctggatttcctaggccgactaagaatccctaagcctagctgggaaggtgaccgcatccacctttaaacacggggcttgcaacttagctcacacccaaccagagagttcactaaaatgctaattaggcaaaaataggaggtacagaaatagccaatcatctattgcctgagagcacagcgggagggacaaggatcaggatataaacccaggcattcgagctggcaacggcaaccccctttgggtcccctccctttgtatgggagctctgttttcactgtttcactctattaaatcttgcaactgcaaaaaagaaaaaaaaagaatcttcaaatggctattgatgctaaagaaagttctgaaggagcattctccaatgcagttatttcctacagaagattttaagtgattttttaaaaaactgcctcttttytaaaaatatttcagcttttattttagatatgggggtacatatgtaggattgttacatgggtatattggatccaggtagtgagcatagtaagcaataggtaaaaaaatgacctcttattcaagagggtacctcattactatttacaaagtgctttcaaacattctttctcatttttttctgacaactctggacgtccccccctacttttagaagaaaactaacagtcccaaaaatgttttggtgtaagtcaatatatgaacccaggtccatgtccagaactgtttaccactcacctctttataaaacggtaactgtggccaggcacggtggctcactcctgtaatcccagcacttygggaggccgagggaggtggatcacttgaggccaggagttcaagaccagcctggccaatctgttgaaaccccatgtctactaaaaatagaaaaattagttgggcatggtggcacgcacctgtaatcccagctactcgggaggctgagacaggaaaattgcttgaaccggggaggtgggggttgcagtgagctgagatcatgccactgcactccagcctgggcaacagagcaagactctgtcttaaaaaacaaaaacaaacagtaacagttacttctctgaagctattattttttatcctgttacatatatcaaagacttcatttgggtaactatattcacgattattttaagctttctttttcattaccaatagttgggctaacctttattttctggatggtaaaggtgttttatagcaacaaaaacaaacagctaagtcaatccgtccaggtaccctgttaaagcttcaaagactctggatcagaatgatctctgctatacacacatacccaaagaataaacaaaaatgctattgctaatawctctcagtcccttgagggattaacttttagtcccttgatttgcaaatcaagctgtaaactatattaattcccccctttctgtacctttcctttcggatgatgctcatctagcattttgctgtcttgaataccttctcctttctcatccctatatattttcattctttatttgagtataattccactttaacacattaccttaatgcaaaccattatctccatttttgctcacttctttccctttcacagcacctcttctcaataaaagtctatatgtagtgtgttcccatggtgatgggaactaaaattacttataatcaatggtttttatattgtcgctgctgcttatctcttgggttaggcctctctttgcagccaggtcacaggtaagtctatgaaggtgagatgaaacaatatttaccagagattgaactacttctggaatatttgtgaatccagccttcaccattattgcaccatctagatttcacatctgtttagtgtattaccaatatttcctttttccatataatgaattcttttattgtagtaattgtggtatcagggcaccatggatattcatagttataagaagatattatcatagaagaaaattgtcatgccatcattcattatggtgttttgcatctttgaattttaaacagagaaagagaaagaacagtcaagctagtaagcaagagataaccaatctactttgggaaatgaccaatggttcttgatttcagggtagattatagaaaagagaaaagattatagtattttatatctgcaaaacttattccaaaacaaatcagtaaatccaggttaaaatacccaggtcagacagtcacatttttactaataaaaawtaactagcagcccgggygaggtggctcatgcctgtaatcccagcactttcggaggccgcggccggcggatcacgaggtcaggagatcgagaccatcctggctaacacagtgaaaccctgtctctactaaaaatacaaaraaaaattagccgggcgtgttggcgggcrcctgtagtcccagctactcaggaggctgaggcaggagaatggcatgaacccggagggcggagcttgcagtgagccgagattgcgccactgcacgccagcctgggcgacagagcgagaccctgtctcaaagaaataaaataaataaataaataaataaataawttgcagcccattgagtgaactttaaatgatcatgctactttgtgaaatagaatatcacattactagatctgttgtgtgctggacaaatgccagcacaatgcagtactttgctgatatagtgtggaatagattttgtgctgcagcaaagctgtctatagacttcaaaaaacaaaggttatatgagcattaaccaaactgtttaaaatcttacagtttcaaaggaccacatattctatgattccatttatatgaaatgtccaaaataggcaaatctataaagatagaaaatagattagtggttacctgggacttgcggggatagaagcattacagggtcagggcagtgaccttccctaaaagatacagaatttattttctaggtgatagaaatgttctaaattgattgcggtggtggtcacaactatgtgacaatattaaaaatcattcaattgtatactttaaatgagagaattgtaaatatatgagttatagctcgataaagtgataccaaaagaaagatcttccccaaaaagctttcccgtaaaaatacatgttccacccaattaaaatgcaatgtcaatacgtattcgtttattttattgcttaaaataatgtgttcttttgcacaaagaagaaaaaatagaaatcagaatgtaagaagacaagtcatttatgatttattttgcaccatttatttcaactgtttaaaataaaagggccgattttatgctgctgtcaaggttttgcttatgataaatgtttgaagtgacactgaaatgtgaactggttgtgagacaggctctccttggcttctaatggaggcaggtatcccatgggacagatgcttgtattgcttcaaattcattgtaggagaattaacccttcgtggtgccactttcttcatatgaattaaagtgaaaattgccagggtcagtggcttacgcctgtaatcccagcactttgggaggctgaggcgggtggwtcaccggggtcgggagttcgagaccagcctgactaacatggtgaaaccccaactctactaaaaatacaaaattagccaggcatggtggcacatgcctgtaatcccagctacttgggaggctgaagcaggagaatcacttgaacctgggaggcggaggttgcagtgagccaagatcatgccattgcacgccagcctgggcaacaagagtgaaactgcatctctaaataaataaataaataawtaaaaataaagtgaaaattatgcagtatgggtttcactgtagttttactactcttgtatagaggaggaaaaatttctcctctaccttcttacaatctctggctaggcctaagaattaaacttatataatacagattaatagaagagaagcatacaaattttattataattttacttgcacatgaaagtcctcacaagacaatgaagacccaargaagtgaccagaagtagtaaacttatatatcttttagatgaagaaatgataaatttgtgaagaagtgataagacaaagcagtttggattataggcagtaaattgtgaggaagtcactaaaaatatagagggggaaactaatggaagataagggatattttagtaagtttgtacagatctatttcagagtcaattccaagtctcaggtgataaagatgttcttttcttcctggtacagggagggcacctttctcctggaaattttaatggtgtgtttttaagtagaaagggggaggtcaaaaggctttcctgcatctgctatttctccattgctttcagctctaaataatcagtatgccaaagtggcatattttggggtggcacgtcctgaagtccttcacttgtttactcactcgttgctaatcaggacttgatcatctttgtctcacccctttttacagccgtccagccctatgctttttattttatgccattatttaaatctgatgttccattcagttctctacagttggaagggtctagcttgggctacctttgkattgttcaaaatgcttttttaaaaggacaaaggtcttgtggtcaaatcagtttagcgaatggtgcataccatatcttgctcttacagagtctcagtgcacactaacatattaaagkttctgagaaatccagaagaaaaaacaagtatgtaactttatttaacctaatatttcccaaacttttttttagtgactcacagaaacactccgtagaactagcctctgcagaacaccctatgggaaatggtgttctggagtcataattatctccccctttattaccttattactctttcccagctatgacagatctttttatatttctttttttcttcccgaacatgtttgttttaagccacaattcaaacttgctacatttactttttcctggttattgcccagttgttaagtctggattgccctgggaagatgctgattacatggtgctctgaataccttgcgttctttgccagtagctctcctaaagatttgtgatgcatacattactgcccaacagagaattgggcttgcctcattgcaatttcagaagacaatcctcctgcgtccatcagcttgttattggctggcaccacagagatgtgtttctctggccctcattaattgtaaccaaccctaagagagttaagttgtatcaggcatgtgtayaccttacagtggataagtttgtcagatactttccttagtgcatattttttaaagagatagaataaagtataaatacacatggaatggatgtcaccaataagggtttttaaacactggagaattttatatgggcctgctttgtagatatccttttttttttcaatctatgaactcaaatatatgaaatatgtctgtaccctccttcttttggctgcccagctaagctcatcccaacaasgcttcccagctttcttcaggtcaccaccaatccaatccaggctggaagtgatgagactgagctgtggaatacaaggagcgtgcatggggtgctcttctggatcctggggatatagtggttaaaccgttactgacaacatgctctcatggctcttagatctagtgggggaaagatagccaataaacacacaaagaaatcaaatcttgataaacacttttcagatcactaaaatcagattatgtgagtgtgaccaagtggctgctgtagaaggaatggtcttagaaagctgcttttggagatgacagttaggttgaggatcctagtgaaaagagtgtgaacaaggagaaagaaatccaggcagaggagacagctgctgcaaaaactctaaagcaagacccagcttcaggtcttcttcttyttttttttttttttttttttgacacagggtctcactctgttgcccaggytggagtgcagtgacatggtctcggcccactatagcctccacctcctggactcaagtgatcctcccacttcagcctcccgagtagctggaactataggcacatgccaccacacccagctaatttttgtattttttgtagagtcagggttttgccacgttgcccaggctgcaccttgaagtctttcaagaaccaacagaaggccagggaggggagcaaagtggatgagtgggagaaggatacttcctgagctctttcaaggaggtcagggcaagtcgcatagggttttgttaaccctgacgtggatttgagaawcatcagcacgcaaggaggtatctaaagctggaggcctggatgaggttgcctttgggaagtgaggaaacagcaaaaggaggggcttggtacagacctggatggctcaacctttagaggttgagcagagacgaggggactgcaaagaagcagccaggcaggtaagagttcagatgtcygggaagccacacgagaaagtgtttccaaaagcaacacatgctgttgaagaagcccagaaagaggaagatacagaggtggccaccgatccaatgacaacgtgcaagttgttgatgactttgacgagaccaggttcagtgttctttgggargattgaggaggaatgtgatttaagaatagatgttcatgaccgtagaagtggaaatatgaatataaaggttaaggtttgtttgttttaagatgggacttactgtctttaaactgtctgcagtagaatggaagcaactaatgaaaatgaaggtggggatagaagccatatctccttggggtttttttcccccttaaggaaatatgaggcaaggttttcagggagggaagatggactgactgtaggaagagagagaartaaataacttgctatactgtgaacatgtagtatgaccactggacagtatttacagcctattagaatttgagagattcaggactatttgttttttttaagtccatcactcttatcagtgattttgaccaaatttagttaatacygaagtcaggatctgaacccggggacgtcttgctcagagtctgggcatttgaccactccactccactccactccactccactccactgcctctccacgagttacagctgaaactagtccccagtcagcacagatctgtcatttctccagttctcctcagctatgagcrtgcatagagaaggcasagagttaggttttatgaccaaaagagagagatgagacagaattaaatgtgtttgcaagtcagtaagtatgckatgatggtgaaatcaaagaagtgaagaaccaccgttgtagataatgagcaaattggggatcaaaggataggaaacgttgatgaggtggaagagygagtggtttgattggaagaagtgcagagcctgatttggaagaatcagaggtgcagttattggtgataacatgacaaatgatatgggtgtgagtggctcatgtgggtacaggagcagatcacctgtgttgagaaggttgaggattgagaagtctgggcctgtcccatggatctgacatccaggggtcccagccttyttgttttctacaaaagagaaactcagagcctgtgcccctggaattttcaaataaagcatgtgcttgtcccaaggtatggagaatagcggccgtgcagccaataatgtcactgggctcacttgggctaaagtgggtctcccctttccttccctgccctccctctacccygaaactttccttaactactgaagatcaggccttcttggccccaacacagaaatccctgtggggtggggggcaaggagaactgttgtccactcctgtctgcaacaaaagaagagttcatttttggccaaatgaatgacaatgaatattagggtcttggactgccagaactccctgccagtggcactccctgggagagaaggcctgttcccacacccctctctccagctttctccacctggaccrgatcagttgttctcccttactcccctctaggatccagaattcctggtttgactatcaaaagtaacactacttataaktatttataggatacatcattgactctcacattcactttattataaaatttctttttctmtaacaactctaggtacttttattgttattaggccattgttccttactctttgttttcttgtattatcacatcagtcagcgaccaaatcctgttcattctaactgagatgttccccgatctgtcccctccgtattcttcatgtcttctctcatgttgggcattggagcagctgcttaatttgttctctttgacctttcttgctaaagtccaccctcgcaactctcaacagagtcacttggcaaaacgtaggtctgatcgtgtggctgttttgcttaaaagtctttgatggttccccagrttgctttgttaaacaaaggaatttctactttaaaagtagaatttcctgcggaatctttctcaagttactttgctccaaccacactaaaccgcaccgttccctaaaccacagcctagttaagaactttaaagattccaagcactgactatattttggttcctcccactacttcagaggttcgcgacactagactaatttaacattttattctacaaaatagcaccgaacttaggcatatgtggaaaataactagctgttttccagatttttctgtttctgtcttctcttttcttttgatcactgctccaggcttgctggggctgtaaggaaatgctcagtctaactggagaattttagcattgccttcaacacaaatataaggctacttctgtttgaaggtttatctctggctggaaaatctgccctcctctatctccatttagttaacctttacttttccttcaaggttctacccaatgataacttcctttataaagtgttccctggctcacccaggggtaatcaattgcttagscttttgcgtgtgaacttctgctyktgttaccataaattatctgtatgtctagcatccttgctcattttaccatgttatatcattaaatcctcataattatcatgtaatcttaagtattaggattcctgttttgcagatagtaaacaggggtttgttacccacctaaccaagctattattaatatctaatgtgacaatgggtataattaatttataaaagactaagagcattaaaactggaaggcagtattatttttaatatattgactctgtgtggtgacaagcgttcatctgtattttttcttcttgccaatagtgaagggaatttatgattcctacataaagaaatctttttaatgttaattaaactaaactgtaagaatgctgctatgctcaggtgcaatgcaaataatgaggtgactctatccctgccatctcaggctaatcccctctcccctgaggagctgagactcagctccctggaggtgaaargctaaagcattcccctgttgtgccattttcttccctttctctcatgcattatttttcttactstggttattcttgatgggaatttttagcagagctcagygccatcttatcccaggaagaaaaaaaaattgtaggagataaatgtatgatgaatggtgcaaaacacaacagttgmaatcttttaaatttattgtgaaattaaagaacatgcccctagaatataatcgctggcaattcaaaaagcaaggatttttagcaaaataaataagaccagttttcttcctctgggccttgtgtctgttcatctcagtgagtctttcagcttaaccagtgttgcagcccaagctcttccttgtccttaattagcatcaggagttttcattagttattttacgagttgttagtgatcctcattagctttgctgtggtcttaaattttcttgacatttactgtttcactgcataagattttatggttaattcccagagtatataagccagattattagccgttatattttttacaatgtatatattcccatttcagaatctcttgtatcttaacatttttctttacaattttatataaatgactgtcatccagttcgttgggcttcctgatatcttttttatacatattaaataaggaaaaataagtaaatatatatatcattcactcagttgatagatttttcaagaaagaaaaaaattaagataatatgtttctacaaaaaaagaatgtaatgaaatactgtaatttgactttatagccaaattaggggaacactactatttttcattctacaattattccacactatgctgcaagtattgcccaaggaacagaaggcagaaaccaagtaacttgacaatatattagagaagaataacaagtcaagttattttgaagatttaggtgtattttatttcaaagtgcattgttctccctttgtgcctccttctcaaataacacaacacaggaagctgtcatccatgtaatatatattttttgggggattaatcacttgtatacctgttttattattcattccatggtcattagggcctaaaatgtaccaggtattagggacacaggataacaaggcagcaaaggatcattatattcagatgcaaaaggaaatgtaataaatataaaaygtataaaaagtaagtagccagtttcaaataataatcagtgtcattctgtcaacacttattttctaagtatgtactccatgctaaatactaatctataaagtaactctgatgggtgagtggagggcgaggggagctattttatattagttgctcagggaaggtttccctgaggagatgacatctgaaatgagacttaaataacaagtaaacacagaagagtttttcagctgagtttctgggagtctgtggatagatttcaggaggtctatagacttggatcagaaaaataattacatctgtattttcactcaactcagactgaaatttagcattttcttctatttgaatgtaracaacaaatctcagtagtactagtagcacttgttactttgttaccagtagaaagtatagtttttttaaattatatctcagttttcacaggtgtcttgaaatgttatcattgctttgaaattatgagatttcttggatgtgatactagatctgattctaattgtgttaataaagaagcacatgtattactgtattgattatgtattactgggtaatgaatgacccacaatttgggagctttaaacaataacccatgattctgttggtcagcaatttgggctgtgctcagctgggtggtgtttttttttttgtttttttttttgagatggagtctgtctctgtcgcccaggctggagtgcagtggcacgatcttggctcactgcaagctctgcctcctgggttcacgccattctcctgcctcagcctcccaagtagctgggactacaggtgcccgccaccacacctggttacttttttatattttttagtagaaacgaggtttcaccgtgttagccaggatgatctcgatctcttgaccttgtgatccgcccgcctcggcctcccaaagtgctgggattgcaggcatgagccmctgtgcccggcctcggctgggtggttcttaaggacttgccaggattgctcatgtggttgcagtcatctgacagccccactgggccaaatagtccaagatggccttcctcccatgcccagcagctggtgctgactgcaggctgggccacatggctccaacaggctaccctggggctcttcacatagtcacagtgttacaagacagcaagagcatgagccacaaagccccgtgaggctcaggctcagaactccccagcacttccactgtcttctgtgggtcataacaaatccaaaggccagctcagtcagtttgagagggaattccatgggttgtgacttcagggaagtgtgattaattgggggccattaatatacttacctgtcacctaccaagtcctaatttttttttttttttttttttttctgagacagggtctcactctgtagcccaggctggagtgtagtggcatgatcatggctcactgcaggcttgacctttggggctcaagcartcctcccacttcagccccctgactagctgggactaaaagtgtgcaccaccatacctggctaattttggcatgttctttttttgtacaaaataatcttctggatggggctcmccatgttgcccaggctggtctcaaactcctggactcaagtgatcctcccatctcagcctcccaaggtgtggggtttacaggcatgaaccactgtgcccagcctatgtcataattttaaaaattattataataagttggccgggcttggtgactcacacttgtaatcccagcactttgggaggccaacgcaggtggatcacttgaggtcagaagttcaagaccagcctggccaacacaacgaaatcctgtctctagtaaaaatacaaaaattagccaggtgtggtagcaggcacctgtaatcccagctacttgggagactgaggcacaagaatcacttgaacctgggaggcggaggttgcagtgagccaagaycatgccactgtactccagcctgggtgacagagcaagactctttcaaaaaaaaaaaaaattatagtaattttaacatgttcggtgttttctgtaattttgtcttttacactttttaaaatattattctgagaagaggtacataggcttcagcacattgtcaaagagggtcaagcacattatgagattaggagcccttgatctaaaggcagggagttctggaaagaggagtatagaagcctcaaggcagaagcaagctggcatgtccaatgggatagaggagcagaaggaaagctcctgcggccagagccaaagattgaggggcagagtggttggagacagaggtagggccagatcatgtgacttctttgaaagcttctgaaacttgcaaagggacctccacttccccactgcaccatacccacagagtgtgaaagtaggtattgtatgtaaattgtattttatgattttttggggtcattgytaacttttttcagttatcytggcagaaataagaaaattcttttttgctattccatatatctattgtgatatcagagtctgttgtttgtttgtgtgtttgtttgtttaagacagtcttgctctgttgccaggctgaagtgcagtggtgcgatctcagctcactgcaacttctgcttcccaggttcaagtgattctcctgcttcagcctcccaagtagctaggactacaggcgcgtgccaccacrcccagctaatttttgtattcttagtagagacagggtttcaccatgttggccaggatggtttgatctctcgaacttgtgatccgcccaccttggcctcccaaagtgctgggattacaggcgtaagccaccgcacccagccccagagtctgttgtttatagaggatgattgggcgtagctttctagagctgggaaaaccacctttmaacagtattatataccaatatttactatttcataaattcaggcatatttgcttaaaataatctcctgtagagaggcaagaaacagaagcccatttttttgtttttaggaaattcatagaagccwttggtaaggttcttttaagttggcaaactctattttcagaagacttctatgttgacacttgtgacctacagaattgctttaagaggtcagcactgataaaaacagagggaagctgtaaagggaggattaggctaaagtcaactggtggagtaggcataggtgaattactaaagtgttgatgaaatgactctgttggagttaccagtttattataatgagagctaaagtgaaaaacgccagacagcctagaagcattctgaataacaaggagctccaaccccttatatataaatgaggttacatatagtaggttgaaagcaggtttccaaaacaaccaattagtttgtatagcttcagcttcaggattgatgattacattccataggatattacattaaattgatgaaatctgcacgtctctggggaactccttacaagctagccagtgagcttttatgatgataagatacagaatggataaaaatcttctgatgccaaaaaagctttggccctgcccaagttaggatctatattcatattatcaccaggtaaagtgtcttgcaaactttcttagctttcattcctatcagactgcagttcatgactgtgaggtgtcaaagactctctccttaaccaagcttcagtcatgctctgctaatgtctcttttggaccaggcttcaagcttgctccacccccagctttggcttgcccagcccagccttagcaaggaattctgctaagtcatctcccaaccctagatatctaattacccttgatatctgatcaagttcttcatcctccacctttttgatgtctaagtccttggactgcctttagcaagagtcctgttaggccagcttagcaagaattcccctgcccttgatgtgttcttttagcaatttcccatcctttgacatcctcatgctgttcttggctataaatcttcacttgctcttgctgtttcagagttgagccccttcttttsccccctccaattgcaatggttttgaatgaagtcttccttaccattttaacaagtgtcagaataatttttttaacatctgtctttacaccacagtcaacaaccccttatcctccccaaaactctgagctaacgccactacttagagattacagtgtctgcctattttattagctggaactgcatcagtgattttggagttgaatttttcattttttacatgaaagattatgtgtttataatttgttgttttcacatatgcataaacagaactaggaagagctgtactcaggagtcaagtcagaagaaaaaacatcaccatgttcaaatagacaactgaacatgcctctgaaaaccagagacaaagggagttatttacagttaacatctatagaatatgggccgggtgtagtggctcacgcttataatcccagcactttgggaggccaaagcaggaggattgcttgagcccaggcattcgagaccagcttaggcaacatggcragaccccacctctataaaaaatttaaaaattagctgggcgtgatggtgtgcatctgtaggcccagctactcaggaggctgaggtgggaggatcacttaagcctgggaggtcaaggctacaataagctgtgattaaggcacctgggcaacagagcaagaccctgcttctaccaaaaaaaaaatatatattaaatttgtagaagtctgggcacagtggctcacacctgtaatcccagcactttgggggctgaggcagaaggattgccttcacgagtttgagaccagcctgggcaacatagtgaaataccatctctacaaaaaatacaaaaatgagccagttgtgctggtgtacacctgtagtcccagctacttaggaggctgaggtgggagaatcacttgagcctgggaggtcaagactgcagtaagccgtgatcatgccactgcactgtagcatgggtgacagagtgagamcatgtctttaaaaaaaaaaaatctgtggactatgaagcaagatgagagacatttgaaagcatatgtcggaaagtcaggtatacttctagagctggctctctgttaggatagagacctttaaaatgtttctagtgcttgcagatgtcaccctaccctcctgcaaagataacagtgcatttacttctgtcactgtagattagttttgcccaggtattcttttcttagggctgccgtaacaaagtctgggtggctttaaaacaacagaaatttatcgtctcacagttctggaggccaaaagtcagaaatcatggtgtcggcagggccatgctcccyctggcagctctagggaaaggcctttccttgccccttcctggcttctggtgtttgctggcaatccttgatgttccttggcgtgtagatgggtcacttcggtctttgcctccatggtcacgtggccatcttttccctgtgtttcttcacatagtcttcccatcccacatgcagaagtatgtgtcagtttctgtgtggctgaatttcccctttttataaagacagcagccctatcggattgggcctcctctaatgatctcattttaatttttgcctttgtaaagaccctgggagttaggacttcaacatgtcttttttgggagacaattgaacctacatagcatgtttttgaactttacatgcagaatcatattgtatgtagtcttttgcatctggcttatttcagtcaatatattagtgagattcatctgtgttgcaatagcagtttctattcattgtcagtcctacctaccactatatcaaggctctgcaaattatggtgtgaaggccaaatgcatcatgacttatttttttcgcatatggatatctaggtattacataagaaaatgtggtttttggtttctatgatacttcttcccatatttctctttgtttgaataggaaacaaatctaattaatccttaattaaaagaaaacttttatatcccatctttccatgactatgaatatgttacatgtataaatgtttatatctgttatgtggtcattatacattttgaactaaaacatagcttatacttgccatataagtttatggaaaaagttaaatattttacttaattgattgatttatatcctgtaactttacacataagtcctggtaatacaagcttgttgttaaaaaaaaaattgaaatgatccagaaggacataaaatcaaacgaataggctcctctccttatccctgtggcttgcccagtctaattctttataagtcaccgctattgacagttttctggatattcttacaaatattttttctgacatggaagtgtgcatgtatctgtgtatgtgtgtgttccctgtatttctaacatacctgggatcctaatatgcatactaatctatgacttgcttttyacatttaataatatattgtgactacatttccattttagtacaataaagtttctcctcattctttttttctgtttttgagatrgagtcttgctctgttgcccaggctggagtgaagtggcctgatctcggctcactgcaacctccgcmtcccaggttcaagtgactctcctgcctcagcctcccaagtagctaggattacaggcgcccaccaccacgcctggctaattttttttttttttggtatttttagtagagacggggtttcaccatgttggccaggttggtctcaaactcctgacctcaggtgatccacctaccttgacctcccaaagtgctgggattacaggyrtgagccacagcgcccggcctttctcgtttcttaaaataattttataatgttccgttcaatggatgcatgataatgtgttccccaaatagcaaacgtttagactgtttccaattttttgtgtaagtatacatggatttgtttctgtttctatttacttctatgaaaacatacttaagaatgatttttagatgttgaattgctgggtaatatatatgtgcttttaagtttttgacagataccactaaattgccattcgaaaaaatgcagtaacaatttacaccccatgaggtrtttttattattatttttaactaccaggactttacaccttgtaaaatctacaataagagagttatayattgactgtttactctgttgtttcagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggtaaggtttaagaaattttttgttatactgaagatggatctacatcttctgaccactagggttaaatctccaaacttgtcagaatttattgttactcttttatcttctctctataacatttatgtactgcaatgtcccaaccctcctatttcagctaaaatatagaaggaaaaaatacacctgtaagtagtatagtgtacactaaagtttyattgaataagaaaaagaattttagtttttattttagctctgtgttcatttatttcataagtcaaatgtatcgtaacaaatttaacctgacaacttytcattaaaagcctgagtcttagccgggcatggtggtgtgttcctgtaatcccagctacttgggaggctgaggcaggagaatcacttgaacccaagasgtcaaggtagcagtgagcccagattgtgccactgcactccagccttggtgacagagtgagactccgtcttaaaaaaaaaaaaaaaaaaaaaaaaagcctgggtctgtaagcttgtctatgagcttagggtctccctacaatcactggtctctcactcccttaaaattttttctgtaaattgctttcaaatcgtagaggggaatggattatgaagtwtaaatcaagaaragcaaaattayaagaaaaagaggccgggcgtggtggttcaygcccgtaatcccagcactttgggaggccgaggcgggtggatcacctgaggtcaggagtttgagaccagtctggccaacatgatgaaaccccgtctctactaaaaatacaaaaattagccaggcatgttggtgggtacctgtaatctcagctactcaggaggctaaggcaggagaattgcttgaacccaggatgcggaggttgcagtgagccgagattacaccactgcactccagcctgggtgacagagtgagattccgtctcgaaaaaaaaaaaaaaaaaagaaaaagaaaatgcctgttttctttttcagctgtaacctgactacaaagattacattcgtacatttaaatgatttttttgctgtaatgggggtttgatagcttaattttcctgattggtttgcattgtggattttcagaactattaataattattgaatctgtaattttagaagaatttatttatgaatacagttgaatcragtagttaattaagcaaaggtgaattggatgttcgagttcttttcaaggtgcttcctcagcgacacctctattctggtctaaacgctgttgccacctctcagttcagatsaacagcctatgtgccaggtgctgtgctaggttggacagacacaagaatccayagggcatgattcttgtcctctgtaaacttagaagccagcccagatgtatgcttttacctcactcccttcctgagttggtatctacatgatacactgattgattgattgattgatagatataagggttaagagggaaaagaaaaaaaatccagaagagaaaaatccatgtagtggcacaattaaaatttgatttcttttttttttttttkgcgacagagtcttgctgtgttgcccaggctggagtgcagtggcatgatctcagctcactgcaacctccacctcctggttcaagcaattctcctgcctcagcctccsgagtagctgggattacaggcatgagccaccacacccagctaatttttgtattttcagtaaagacagggttgtaccatgttggccaagctggtcttgaactcctgagctcaagtgatccgtccacctcagcctcccaaagtgctgggattacaagcacgagccacagcgtctggccaaaatttgatttctgatcattgccacttcccccagatttggagtgctggggggaaggcatgtaaggggacagtttcagtccatcaaaaaagggctactggagtatccccatgtgtttctgcctcattccttccgtaagcactgaatccccatatgtgtgctgagggctggccattccagaggctccccaggtcttgatttggctgggataagtgagctcacagtggagaaatgtagacttagaaaaatacatttgtaaagatgcttctcgaatactttttaaaataagaaggggtttttttttkttttttttttttgagagacggagtctcgctcygtcaccaggctggagkgcagtggcgcgatcttggctcactgcaacctctgcctcctgggttcargcgattctcctgcctcagcctcccgagtagctgggactacatgcatgtatcaccacgcctggctaattttttatatttttagtagagatggggtttcaacgtgttagccaggatggtctcgatctcctgacctcatgatctgccsgcctcagcctcccaaagtgctgagattataggtgtgagccaccacgcctgacctaagaagggtattttcttgtggtcctttttttggttattgatgaaacacatagaggatttgaaacaaatttacttgaagtgcaactatttaaagtggcccttccttccygattcctacactcctcactgctctctagagcatggtgagagcacgatcagcagcctccctggagagccttccctgaccgcatgtggagactgatggactcaggaggttaatgaaggccagtattagatattcttgaaagactgccaaggtatcccttgagtattcattaacccagatgccggttctgggagaatttgtactgtcattcctgttgtgagtttccccatgcccttctcccagtaattgaaacatggaatccaatggttaactcagaagttttttaaaaaggaggggggacttacacattttttatttccaacatgccatatgctaattttcccaattaagtatctaattaattcattcaaaatcattttctgcacagagcaccattctggtttattccctgaaattgggggaactgaaatgccacaagtctctcccagctaagaaaatgctgtgtttgtttccagtagtaactgatctttctttatagatgctagcatctatcataaactctctctaatcaataaagttttttggttttttggggttttcttgagacagggtcttgctctgtcacccaggctggaatgcagtggcttaatctcggctcactgcaacctccgcctcctggtcttgtgactcggcctcctgagtagctgggattacaggcgtgtgccaccatgtccagctaatttttgtatttttagttgagacagggttttgccatgttgccctccctatgttgcccaggctggactcaagtgatcgcccacctctgcctcccaaagtgctgggattacaggcatgagccaccatgcccggccctaattaatgaagtgttaagtacaatattgtatgtacaaatgccacagagttttttaaagagatgacaatgagtagcattcggtcacaaaattggactgtgttactttgtactgaagttcccaatacgttgtatagtccttcagcctggtttgatgtttctctaaacagcaaagctactaccattttaaaatgcttagttcaaagaattttcccttctgaagtattatttttcttttagttatttattattttctaagtacagtgtaattattgtttaaaaaacacctcttactttctataaagagtctatttattcatttgtttacattccatttccttccattaacatatagcacctacgatagagcctgatccacagtagatattaaataaatacttgttgaaagaataagaaaactggccaggcacggtggctcatgcctgtaatctcagcactttgggaggctgaggaggatcacttgagtccaaaagtttgagaccagcctgggcaacatagggagacctcatctctaccaacaacaaaaaaaattaaccaagtgtgatgatgcacacctgtggttccagctacttgggaggctgagatggaaggattacttgagcctgggaggctgaggctgcagtgagctgtgatcacacctctgtactccagcctgagcgatagagtgagaccctgtctcaaaaaaaaaaaaaatgggaaaaaaaaaagcaacaattcagtcacacttctaatatgaaacatttcctccaatgtcaggtaataatatataagaatatcmccctgggtgcaatggctgatgcctggaatcccagcactttgggaggccgaggtgggcggatygcgaggtcaggagttcgagatcagtctggccaacatagtgaaaccctgtctctactaaaaatataaaaaagaaattagccgggcgtggtgacaggtgcctgtagtcctagctactcaggaggctgaggcaggagaatcgcttgaacccaggaggyggaggttgcagtgagccgagatcacgccactgcactgcagcctgggtgacacagtgagactccgatccacctcaaaaaaaaaaaaaaaaaaaaagaggctgggcatggtggctcatgcctgtaatcccagcacttggggaggccgaggcgggcagatcacctgaggtctggagttcgagaccagcctgaccaacatagagaaaccccrtctctactaaaaatacaaaattagccgggcgtggtggcacatgcckgtaatcccagctactagggaggctgaggcaggagaatcgcttgaacctgggaggcagagattgcagtgagccgagatcatgccattgcactccagcctgggcaacaagagtgaaactccatctcaaaaaaaaaaaaaaaaaaagaatatcataaggtaatatcataaaagacctaggaaatgtattcagttgttttatttcatttaaccggtatttcaggkgtatctctctatgagatcatgtactttttagagacaaaagatacagtcactggctcaaagagcttgtagtcccaatagggactcctagcaatttgtgtaaatgaatattaaagccacatgttaggtttggcaacacagggatagattaagatctttagagttcctaagctctgaaaggattatgatatctaaccttgaccgtcatgtagttaaaaataaagttattaaactatgaagttgccataaggaatcctaataaagcacttatttttcctatggtgactgctttgatgttgtctttaaaatatcaaacaccagtttttaagcaccttcttgttccgtttcttgcttcctctgctttgctggggctctaatcacatggtgcagccttacaacaacggcacagaaaggagtgatgagtttgcctcagtgggcaccaaagacttcagttaggatgagattcttaacttaggtgttaaaagaggaataagagttttccagatgacagccttttcccaggcggagaaacatgaaacagctgggtgaatagtaggagcttgtaccacatttgagtgagtggtgtgagtgaagctgcccagacagaaagagatcagggccaggcacggtggctcacacctgtaatcccaacactttaggaggccaagtcacgaggatcacttgagtttgaaaccagcttgggcaacatagtgagacctcgtctctacaaaaaaamaatttaaaaaatgaggcgagaggatgacttgagtccaggaggttgaggctccaatgagccatgattgtgccactggactcctgcctgggtgacatagcaagagatygggtcttacaggaagtctaggccatcaattgaataaatactactgaattttaaactctgcagtgcaaactaaattaatgtcttcaagtcaagaccagagttagcaaactttttctgtgaagggccagatagtaagtatcttaggtttcataggtcacatgatctctcttgcgactacccagctctgctctggtagaagcagccatagacaacatgtaaacaaatacatgggagtgtgttccaatagaactgtctacacgaaaataggtggtgggctggatttgctccggaggacatactatttttttttttttgagacagaggctcgctctgtcgcccaggctggagtgcaatggtgcgatctcrgctcactgcaagctctgcctcccgggttcacgccattctcctgcctcagcctcccaagtagctgggactacaggcacccgccaccatgcctggctaattttcttgtattttttagtagagacggtgtttcaccgtgttagtcaggatgatctcgatctcctgacctcatgatcctcctgcctcggcctcccaaagtgctgggattacaggcatgagccaccgtgcccagccaggacatactattattggacaacctctggtctaggccatcagtttaacaaagattgcagcaaaacaggtctacaatgcaaactaaagtaatgtctgcaaatataagcttatcacataatctggggcagtcagagggttggttgaaatactaggaaaggttggcaagaggtgtcctatgttgtccagggaaagaaaaggaaagggttgagaggaagatgactttacagtattttttttttttttttttttttttttttttggagacagagtccagctcttttgcccaggctggagtgcagtggaagcaatcctggctcactgcaagctctgcctcccgggttcacgccattctcctgcctcagcctcctgagtagctgggactacaggcacccrccaccatgcccagctaaattttttttttttgtatttttagtagagacagggtttcactgtgttagccagtatggtcttgatctcctgacctcatgatccrcccaccccagcctcccaaagtgctgggattacaggcgcgagtcactgcgcccggcccaactttacagtatttaagcaggcctgaaagaaaccatgacacaaggaaacacactgctgtctgaagcaatttccaagttgcctttcttataaccacactgagggcaatccttgcttctcctttcataaggaggtaaaggcccttctgatttccatactccttcatcccaagtcacctgcaaagcagtaaatcatgttgagcatgcgtttctggattcctctcttcctccacacttcatcctcagtttccccctgcttcctggctaacaaattgagattcctataatcagagaatgaacctttcatttcactaccagagataaagtaaaaaatgcatgtttttgcttgaagtaacaayctagttgaaatgcagtcagtcagcaagtataaaggaaaggtgrctggatgctttagtgtgggaaaggttgtttgctcggtggaaaaggttggagagagtcagtcacagggcaggagcagtgaactcaaatgaccacaagcagcttataaatagcattaagtacaagatgtaaacaaaaagtagaggccgagtgcagtggctcacgcctgtaatcccagcacttcgggaggctgaggtggaaggattgcttcggtccaggagtttgagaccagcctgggcaacatggtacaaaaccttgtctctacaaaaagaaaaaaaaagccaagcatggaggtatgcgcctgcaatcccagctacccaggaggctgaggtgggaggattgattgagactgggagatcaaggctgtagtgagctgtgatcaagccactgtactctagcctgggcaacagagcaagaccctgtcacaaacaaacaaacaaaagaaaaagtagatggaaaaggaacagccagtgctcacttacaggtgatttttgtgctctgtgaaggtgggcccagtgttgcctgaattatttatttatttttatttayttatttttagacggagtcttgctctgtcgcccaggctggagtgcagtggcgcgatctcggctcactgcaacctctgcttcctgggttcacgccattctcctgcctcagccttctgagtagctgggactacatgcacctgccaccacgccccactaattttttgtatttttagtagagacggggtttcactgtgttagcyaggatggtcttgatctcctgacctcgtgatccgcccacctcagcctcccaaagtgctgggattacaggcgtgagccactgagcccagcccgaacttttgatttttttaaaaaagaaatcagaagttttcaaatgtttgtgaaatcatcagttttctaaatattggcaatcaattccaaaagttttataacgtgttacaagccaaataaagcacatctataggctcgatggtctatgggcaccccttgtgatctctgctttaaatcatttgatgtctgaattggtggaagggacacgggagcacacaccagcctggggagcccacyagagtacagaatgcaaactacagggacacatgcctttgagcaggtagtagatagccagggcctgtcaagttattaggtgtcccaggccaggtaataactccttggagttgtgaaaagtatatttcatttccatgccatcatgtttgtaacatgctatttatagtgcccagttatcatttttcccaaagtgcaatttttctcccatgaagtactcataatcttaagtaatgtagttgatatgtaacccagaaactcctacttgattagaagacagttattggtagtatgccattgatagatttgttaattttttgttatatttattcaaatgcatattcatggtagaacaattagcactttctagttttcattctaaataatggatattataaataatggtctccaatattgactcttttgagtaattctatcagggacatgttgaaattccaatgaccattttttttttttttttttttgccttagaggcatcttttgtacataatgtatttctttttttttttttttycctcaagacagggcctcactctgccacccagattggagtgcagtgacaccatcagggctcactgcagccttgacctccctgggcccgagtgatcckcccacctcatcctcccgaatagctgggactataggtgcacgccaccacacctggctaattttcytattttttgtagagagagggtttcattatgttgcccaggctggtctcaaactcctrtgctcaagcaattcaccgagattacaggcctgagattacaggtgctgagattacaggcctgagccaccgtgcccagtcctcataatgcatttcacacaccatagtgtggtgagcacattctttcactgaaataacactatccatattcacatatacaactggcattgttagaaacatctgctatacatatgtctttatgagttgcatcctattagagcaccacagtgtttcggtgaccagtgagtgctggtttaccatcagctttcattgttcccttctgacggtgtatttctcagttttttcctgggcccagtgctgcccagagtaaaggctacattcttcactcctcctcgcagccaaatggcataagactagtaccagccaatgatatataacaagtgatgtgggtaacttttaatgtccttaaagggagacagtgtgctccttattttgtgccaccrcttagaacatgatcaaatggcaagccacctgagatagtatggtctagactagaaggctgtacaacaacagaggaagagcctggctcctggatgacctcatggagcagagattccatgaggaatctcctcctgtctacctccatactgttacataagagaaaaacctctggctgggcgtggtggctcacgcctgtaatcccagcactttgggaggctgaggtgggtggatcacaaggtcaggagattgaaatcatcctagctaacatggtgaaaccctgtctctactaaaaatacaaaaaaattagccaggcgtggtgacgggcacttgtagtcccagctactcaggaggctgaggcaggagaatggcgtcaaccaggaggtagagcttgcagtgagccgagatcacgccactgcactccagcctgggcgacagagcgagactccgtctcaaaaaaaaaaaaatagaaaaagttccatcttgactaagtcactcttgcttaggtgtctgttacatcagccaggctacatcccaactaaatctctaccctaacctttgcgagacaaaccattgcattgagattatataaagggaagttgggggagaaagagaaatatatgatgatgatactggtcaatgttccctattcttcagtttttaaaatattttttaaaattcragttcaaactaatatatrtgctaaaataaatatgaawctragcacatagtktgtattagcatctaatatcatgatgactttattttactttttctactttattttttcattctccatagttctttattcagcaaatgcacattgaacagcagaattstgttttamacmccatgaaggaacwctgaagcactatgaggagcaatgaggtggataaaaaagtacttactttctctaaggagattacagtgtacttgtggagataaaatgtttcttaaaaggtggcatgtgataagtgccatggaaaggatcccaaggaggcatgtcggctcagaggagacatccctgtcacccgtgggccttcatgaccaagagattgtttgaggaggtttatttttattgcatttcaaaagaatattacctcaataacaayatatggccaggtgcagtggctcacacatataatcctagcactttgggaggccaaggccagaggattgcttgagcccaggagttcaagagcagcctgggcaatacagtgagaccgtctctacaagaaataaaaataaaaaataaaaaaaatagccaggtatggtggcacatgcctgtgatacttgaggagctgaaatgggaagatcacttgagcccgggaggttgaggctgcagtgagccatgatcataccattgcaccccagtctgggcaacagagcgagaccctctctcaaaacaaaccaaccaacaaacaaacaaacaaaagcaatgtaggtattttttgttactggatagtttatgtaactgttctttcagattctgtctatcctttaagcacataacaatgatctttgcattttcatcttactctcaaacattttactgagattatgttattataatcgttaacaaatttatctctgggtataaaaatttcctcattattaataaggaaataaaacaaagtaatggtgatgatacaatcttttcttagattgcaaatattctcataagttattacaaaaaatattccctatttattgggcaaacagtgcccscttttgaccactggatcctatgaaagaaatcctaagacaatagactcttcatctctgctaaaaattgaattatatagagagttatatagatgtatattattagatctaattatatataacatttatgttatatcactataatacctaattatatattttatatatggtatataatttctaaagaaactatcctatataactttaaggatatattgtgtgctttttattatttattttttagactcatgttgtattttgttaagtgattaggtccactagagtgtttaatggcagttttgtaagatccacattttagttttatgaatcttctttatcctgtctgattcaggttgaatacgaaggcttaaagcatgagattaagcgatttgaggaggagacggtactgctgaacagccagctggaagatgccatccgattgaaagagattgctgagcaccaactggaagaagccctygagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctcygacttattcagtgagctgaacatttcagaaatacagaagttgaagcagcagcttatgcaggtaagaactttgtktagggccgctagagtgaatttcttgtagattgcaggtagcatgttgtgggacttctgattctcgcatttcacttctagatttcttttcttttttcttttcttctcttttcttttctgttcttttcgagacagagtcttgctccatcgcccaggctggagtacagtggtgcaatttcggctcactgcaacctccgcctcccaggttcaagtgattctcctgcctcagcctcccgagtagctgggactacaggtgcccgccaccatgcccggctaatttttttgtatttttagtagagacggggtttcaccgtrttagccaggatggtctcgatctcctgacttcgtgatccgcccgccttggcctccaaagtgctgggattacaggcgtgagccaccgcgcccagccccagctttcttttctaaatattgcttcttcarctagaaacttcgaaagtgcagtattttagaaagacatgacagaaggagcgttaaagagaaatgcagtctctcatttgcatcacttcaagaaatgaacttctgagagccacaaattgagctccaatgaagtctgagaaaagacagaaaaaagttccttgggccgggcgcggtggcttacacctgtaatcccagcactttgagaggctgaagcgggcggatcacctgaagtcaggagttcaagaccaacctggccaacatggtaaaaccccatcgctactaaaaatacaaaaaattagctggacgtggtggtgggtgcctgtaatcccacctactcaggaggctgagtcaggagaataacwtgaacccaggaggtggagattgcagtgagccgagatcgccattgcactccagcctgggcaacaagagtgaaacgtcatctcaaaaaaaaaagaaaaagaaaaaagaaaagacagagccttaatgcatttctgattaacaaaagaattcaaaagctttatatacaagtaaaatgatggaaaccatgcagtttttcatcacaagcaactgtgtttatagcttccagatttatggttacatttcacaggaatacttgaagccttaaaagacgtaaaggacttcctatgtacaaattatccaggataccgtatgattaaaaatacagaacaggtataatctaagaccaaaggattcttattgcaacatgagttaaaccttaaatttttagcrtcttcaaaacaaatgtcttgtgaagatcccagccttgaaaaaatcgctttctagtttagagtcttgccttcctgccacatgtaatggaaatgttgtttaagaaacagcagcattaccatcacctgggggcttatttatacaaattgtggagctccgtgtagatctactgaactagaaactgaactagaaatctggtataacaagcttgttaagtgattaaatttgaggcttaatcttcaatctcaatcttatctctccaaggttcttcatgtatagctgataattagaggctgttaagcctctggcagtcatctgcctccacggaaatgatgactggaaaagtgaaattagcagaaataagtaagagaacagagagccaatgatgttgatttgttaacaggtttattttctatgtctttttgctcagtttacactaatatgactagattgattgaaacagaaaacatatttccttgtgaaaaagttttacatgacagatgtattcataagaatttgtgccccccagattgaataccattaaatagaagttttatgagttttgtttaactctcatattggtggctttgagataaaaagttagtgggttcaggctttttgtttattccttttgttttggtggcagtgcagaagataataggaaaagaggcttctatgcatgaaacagcacaacaattttcaascaggtcatctattggctgaaagctcagagctgtgctcagatttaattctaaatgtgatctgaattgggtaatacaaaagtctaaaaaagatgaaaagttcaattaaaagaatggtggaaaacaagtaagtactcagctggagactggctctcctgagttctcaatagactgtcgttttcgtttggtttaggcggttcctcattgccagagaatgttttcttccttgagaaggtttagcgtctctgatcccaactcatgagatgctggttacatttcctcagttgaagtgatgaccagaaactccccatgtatttcaaatgctctgagagtcagccactagttgacagtcattcttagaggacagcactttactttcccatggaatgggatacataataccttcctcgttagagtgtcatgaaggtttatgagttatatgcagagtgctgagaacagggactagtgcacagtaaatgctcattaattatgaactgttatcattatttcaactccattggtcctttaatttattaggcactcactttataataatttagataattattattaactattatttttgggctattagctcaaggccaatcaccccaaaagggactgatgtggatactggtaggaatatagaaaaataacagttaagtctcatggtgcaagaaggtctgaaaaaggatattcatttagcaaaatgttagggtgagaaaaactttgctggataaaccctccatcagtctattgagaaagctgtgtcccttcaaatctttcttcaacccttaactgatgttgacagtttgcaaagatgtagaggggcgcaggtaggtccttatatcccaaagtttgctccagatttagttgtgaaaaccaggttcaacacaggaagggctttgcagcttccaatctcatactaacaacactaactgtaaatttttttttaggtagaatatccatttatcttcttgtaatcagcgtttttaaaaagcatgtcagcttttcctaagaatatattttattcaaacaagtatattcatgagaagtataccttctcatgaactatttttttgcaatacagttttttccttagccacacatctttttgggttaaatttatgtaaataaacacattacaaaaacattacaggatacattgcctagaatttattgtaattggctttgatgttaataaggattaaaaataatatggcaagtctgatcaatgagagtactgtgcacctgaagcatatatgtgtcagtaccattgttctggaaattatgaagaggaaccaatcaaatgtactttaagtatagctatctggaatgcttgggaccaggtgtgttttaaaaattcaggtttcagattgtagaaaggtaatatgcagcatataccacatagattgtgatatctccactgggatcagatgcagcatccggtgatcaaataatattaacatttctgcagtgaaacatgagtattcacactaagaataagatgaggaccattaaaggccttacaccagtcaggtgcagtttggctgccctgggagtttaggactgtctgaatactgccaagtgagttttatcataatcaagtgaattatgataaaacttgatttcgagctttttggattttgcagttgcaggcgttgtaggaatagcactgtcctgttgggcggctgtcagttttgcgcacctcagcttayagtgtcaacatacttggaacgtgacagtttgtattttcatttttttttattattattatactttaagttctagggtacatgtgcacaatgtgcaggtttgttacatatgtatacatgtgccatgttggtgtgctgcacccattaactcgttatttacattaggtatatctcctaatgctatccctgacagtttgtattttcatagttcctttatctcttaggatttctcctggcctggatccaaaacactgcatgggagaggccgccttgtgcctctaatccaacagctgtgcttagctaacagctcatgacagtgtagaggggcacaggcaaggctgtaackccctgaaccaggtgatatgcagcagttcaggttttcttccttctgatcaagtacccctttgatggagtaagttcaagagatctatagtacaacacagtgactgtagttaataacaatgtattgtattgaaaataaaagagtagattttaagtgttctcagtgttgtagaacccctaaatgtaggtccacgtgttggatgggcagtaagccaaatactgacacatcagtgcttagcagcagagaaaggtgtattcatttttccaaaaatgacattgtgggagaggcaatcggtcaaatcctacctgcctttgaacgtaactgggggtttttgtgagtaaggcagctgtgcaggagaatgaaatcccccaatgatcaaagttgtttgtgtcccgcagctcaatcagacttctggatgccatcaaggaggtctgcatgacctaaggatcattgttctttgaaaggaaaacaagttcattaatcttactggctgccagggttaggatgcaaagttaatcaattattagtgactaccgtctaccgaatgactacgtgcaagcagtcatgcatggaggaagaaaaggacaaagagaaaggaaaataagtaaaaaacaaacgtttaatgattttgataatataggctcagttacatcaccacaaacatgataagtatgtcaggtcatgcatgtcataattagctcaatttccactttgcctacatatttcaaaacatcatgttgtacatgataaatatgtacaatttttgtcagttaaaataaatacattaatttgtttttaaagaactcctttgaaaacagtatacctagtccatataccctttcggccttttcttctcctacaaggctcaatgtatgcccatgatttatgttttcccatccataggtatttatttaacctggttccaggaaaaaaaaatgcctctgtcgacgaagcaagtcaaactctgtaaaatattttaagagatttattctgagccaagtatgagtgaccatggcctgtgacatagccctcaggaggtcctgagaacatatgcccaaggtggtcggggtacagcttggttttatatattttagggaggcatgagacatcaattaaatacatttaagaaatacattgggccgggtgcggtggctcacgcctgtaatcccaacactttgggaggccaaggtgggtggatcatgaagtcaagagattgagaccatcctggccaacatggtgaaaccccatctctactaaaaaaaatacaaaaattagctgggcatggtgatgcatgcctgtagtcccagctacttgggaggctgaggcaggagaatcacttgaacccaggaggcggaggttgcagtgagccragatcgcgccactgcactccagcctgcgacagatcaagactctgtctcaaaaaaaagaaaaaagaaagaaatacattggtttggttcagaaaggtgggacagctcacagcgggggcttccaggctataggtaaatttaaacattttctggttgacaattggttgagtttgtctgaaggcgtgggatcaatggaaagaaaatgttcaggttaagataaaggattgtggagaccaagttttattgtgcagaggaagctctcagatagctgacttcagagagagcaggttgtaaaatgtttcttattgcacttagaagggtgcctggctcttagctgattatctcctggatctggaaaggaaggaaggaaaacaaagcggggaaaggggattytctacagaatgtggatttttcccacaagagactttgcagggcaatttcaaggtatggcaaggaaatatattttggttttctttctttgccagtatcagattggaaagtaactcttgatatacagggttaaataaaacgcatccgatgagaatttatggtttgtagggcatgaactccccagaccccttagataggaatttgggcaagataaaaaaaaatcagatcttagtcctcacctctgccttaattatcaggaatgttgagtgaattgttttgcttctctgaggctcattcaaaaggggaaggtaataaattagccccaccatttgtctctkycatgcctttgttggaactatggaaaaaacaaaacaaaacaaaacaaaaatcaggtctccttcttgaagccatcatactgccatctgctgggaaatggtaataacaagtataaacatttatagctactacaatttaaatagcacctcctggagttgtttgcatacaacctgcagacttctgcattgaagccctggtgataatgccatgcctcctctgtagaattgtgaggaccaaatgggatggtaaatatgaaactrtgtataagtcataacattttataaattattattgtcctggaaactgccatcaggtttcgagatgccaagaaggtccccactatccctgtgtataaacggtcaatacataaattataaaaagtatgggaaaggcaagtggtggtaagcctgtatctaaattagggagagctttttctcagaataaattagagtgaatattttactgaattgtatgccttcctaggttatggaataaaatacaggaatattttaaacttagctaatcatgctaagtttcacataatacagaaacatatacacaaaaaatacagtaagaaaacattttgattcacctcagtctctataaacttgacaatagtccttgatagtgaatagttcaatgagtgtcatcctttattcatgagagaagtttttcagagtattatcggataaattattttggttttttggtgccctcaagacctcattatttcaaataggttgtaattgacattttccagtggcagtcaaataccttaattagttttattagaatgaaaataagtagattctgtctggaaatactaactaaattacttaatcaatttaaaggtgtcctgtatgcttgtgctgaaatttctgtctttgataaatagcctctaactttacatctgcatagagtcaaactaagcaggggaaaactctttggatttttttttttcagtattatgctgggtatataatttcacatgtagtatgagaaaacagtaatgtttctgtaaaactaaaattaatatattctgttgcatcctcatggatgtggaagaaatatattcatattatgttttgatccactctattaaaggcaattttagttttttctataatgattgatgttaagtggtgatggtaatttgctatatgtcccataagagttcaaagcaatttttatatatttgcttaattggttgctgcttataacaactgtatggggtagagagtattattatcttcatattatagatagggaaactgaggcatgactgtgttatgtcattagttcaaggtcaaaaatctagtaagtggagttgctacacagagacagtcgaacaagtgaaatattatctctgcttaaasactcacagaatatttataggatgacattaatgaaaacaagattggttagttcttgggttctgaaacttaaagtgacaagtataattatttcctagtacaaagctgacaaatggctaaactattacagattttatagttagagattacaaactagctgggcgcagtggctcatacctgtaatcccagcacttcggaaggctgaggcaggaggatagcttgaggccaggggtttgagaccagcctgggccacatggcaaaaccccatctctaccaaaaatacccagaaaaaattagctgggcacggtggtgcgtgcctatagtcccagctactagggtcgctgaggtgggaggattgcttgagtctgggaggaggtcaaggctgcagtgagccatgaccatgccactgcactccagcctaggtgaaagagcgtgaccctatcaataaataaataaaataaaaataaatggaatcatacaatgtgtggtcttttgtgactggcttctttcacttagcataacattttaaaggttcgtccatgctgtaatatatcagcacttcattttcatttctttctgttgtcaaataatactccatggtatgcagataccacatttcatgtaaccattcatcagttgatggacactttagttgtttgtttttttagctattatcaataaagctgctatgaacatttgtgtacaagttttcgtgtgcacrtatgttttaattcccgggggagttaatactagaggtggaaatgctgggtcatatggtaattctatgttttaccttctgaggaactgctagttttgaaaacaaatcgagtgtaccattttttatccccaccagcagtgtatgagtgttccgatttctccacattctcactaacacttgttattatgtgccttttcaatcatagccatcctggtggatgtgaagtggtatttcattatcatcttgacttgtatttccttgatggctatgatgttgagcatcttttcatgtgcttatctgctcttttatatcttctgtggaaaaatgtgtattcagattattttttgactgggttgtctttttatttctgagttgaaagtgttctttactgatttggatacaaatccctcatcataaaagtgatttatgatttgcaaatattttctcccattctgtgggttgtcttttcactttcttgatggtgtcctttgatgtacaaaggagtttttttttttttaaaagagatgggtctcactatgttgcccaggctggagtgcagtggctattcataggcacaatcatagcacactgcagcctcaaacccctggactctcctggcctcaagcaatcctcccaccttagccttctgagtagctgggactacaggcgcatgccactatgcccagctaaaaaaactttttaatcttgatgtgtctagtktatttttttcttttgttgtttgtgcttttggtgtcatacaaaactgttgtctaatctaaggtcatgaacattcatggctaggttttcctctaagagttttatagtttatctcttacatttaggtctttgatccattttgacttaatttttgaatatgatatgaggaagagatcaacattactattttacacgtgggcatccagttgtcccagcaccatttgttgaaaagactattctattctttctttcccctattgaattatctttgtacccttgtccaaaatcaactggtcatagatgtatatatgggcttatttctagactttcaattctattccattaatttatatgtctgtttttatgccaatactatagtatcttgattatagtttttttgtagcaatttttgaaataggaaagtttgctagttctttttcaagaagtttcttcaggactgttttggctattctaggtcctttgcctttccatataaattttatgaccatcttgtcaatttctgcaaagaatccagctgaaattctgttggagtttgcattgaatatgtaaatmaatttgggtagtattgccatcttaacattcagttttttgacccagaaacaggggctgtttatccctttatttaggtcttctttcatttctttcaacaatgctttataattttcagagtacagatggtccttgacttgtgawkgttcgtctagacttttttatttaacaatggtgttaaagcaataccatttagtrgaaaccatactttgagtacctatacaactgttctgtttttcattttcagtacagtagtcaataaattacatgagatagtaaacattttattataaaataggctttgagtggggctgggcgtggtggctcatgcttgtaatcctagcactttgggaggctgagatgcgtggatcatctgaggtcgggagttcgagaccagcctgaccaacaaggtgaaaccccgtctctactaaaaatacaaaaattagccgagtgtggtggtgtgcgcctgtaatcccagctacttgggaggctgaggcaggagaattgcttgaacccaggagccagaggttgcagtgatctgagattgtgccactgcactccagcctgggcaacagagtragaccctgtctcaaaaaaaaaaaaaaaaaaggctttgagttagatgatttttgcccaactgtaggctaacgtaagtgttctggacacttttaaggtaggctagactaagctagaatgtttggtaggttatgtgtattaaatgcattttggacatgatattttcttttttttttcttttttgtttgagatggagtctcactctgttgctcaggctggagtacagtggcaygatcttggctccctgcaacctccacctcctgggttcaagcgattcttgtgcctcagcctcctgagtagctgggaatacaggcacgtgccaccacgcccagctaatttttttttattttttattttttagtagagacggagtttcaccatgtcggcctggctggtctcaaactcctgacctcaggcaatccacccgcctcagcctcccaaagtgctggaattacaggcatgagccaatgcgcctggccatacttaggatattttcaatttacaatggttttattgagatgtaaccccatcacaagttgaggagcgtctgtatacattttgcacttcttttttttttctttttttaaaattttattattatactttaagttttggggtacatatgcacaacgtgcaggtttgttacatatgtatacatgtgccatgttggtgtgctgcacccattaacttgtcatttagcattaggtatatctcctaatgctatccctccccactctccccaccccacaacagtccccggtgtgtgatgttccccttcctgtgtccatgtgttctcattgttcaattcccacctatgagtgagaacatgctgtgtttggtttttttgtccttgcggtagtttgctgagaatgatggtttccagtttcatccatgttcctacaaaggacatgaactcatcattttttatggctgcatagtattccatggtgtatatgtgccacattttcttaatccagtctatcattgttggacatttgggttggttccaagtctttgctgttgtgaatagtgccacaataaacatacgtgtgcatgtgtctttatagcagcatgatttataatcctttgggtatatacccagtaatgggatggctgggtcaaatggtatttctagttctagatccctgaggaatcgtcacactgacttccacaatggtcgaactagtttacagtcctaccaacagtgtaaaagtgttcctatttctccacatcctctccagcayctgttgtttcctgactttttaatgatcgccattctaactggtgtgagatggtatctcattgcggttttgatttgcatttctctgacggccagtgatgatgagcattttttcatgtgttttttggctgcataaatgtcttcttttgagaagtgtctgttcatatcctgcrcccactttttgayggggttgtttgtttttttcttgtaaatttgtatgagttcattgtagatyctggatattagatccagatttgtcagatgagtaggttgcaaaaattttctctcattctgtaggttgcctgttcactctgatagtagtttcttttgctgtgcagaagccctttagtttaattagatcccatttgtcaattttggcttttgttgccattgcttttggtgttttagacatgaagtccttgcccgtgcctatgtcctgaatggtattgcctaggttttcttctagggtttttatggttttaggtctaacatgtaagtctttaatccatcttgaattaatttttgtataaggtgtaaggaagggatccagtttcagctttctacttatggctagccagttttcccagcaccatttattaaatagggaatcctttccccattgcttgtttttctcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcctgatgcctccagctttgttcttttggcttaggattgacttggcgatgcaggctcttttttggttccatatgaactttaaagtagttttttccaattctgtgaagaaagtcattggtagcttgatggggatggcattgaatctataaattaccttgggcagtatggccattttaacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgctttggctctctgtttgtctgttattggtgtataagaatggttgcattttgcacttcttttgttaaatttattcctgccgggtgcggtggctcacacctgtaatcccagcactttgggaggcctaggcaggtggatcacctgaggtcgggagtttgagaccagcctgaccaacatggagaaaccccatctctgctaaaaatacaaaattaaccaggcgtagtggcgcatgcctgtaatcccagctacttgggaggctaaggcaggagaatcgcttgatcctgggaggcggaggttgcagtgagctgagatcgtrccatcgcactccagcctgggcaacaagagtgaaactccatctgaaaaaaaaattttattctgaagtatattattttttgatagtgctataaaagcaattgttttattaattttatttttcatttttcactgctagtatatagaaatacaactgatgttcgtatattgattttgtatcctgccaccttgctatacttgcttattagtcctaatagttgtttcttagtgaattccttaagaatttctattaatatwtacaagagcacgtcatctgcaaataaagatcattttacttttttctttccaatctcaataccttttatttgattttctcacctaagttccctggctagaactctagtacaatgatgaataaaaatggcaagagcagccatccttgttttgctctgggtgtttcatagatgccctttatccgggtgagggagttttcttctatgactagattgttgacttttttttattatcacaaatggatattaaattttgtcaaatgctttttcttcatatattgagatgatcatgtggtttttgtcatgtattctattagtatggtatattatatttattgactcttgaatgttaaatcaacattgtgtttctatgattgcatttggttatgttgctggattcagtttgctagtattttgttgaggattttgtgtctatattcataagaggtcttggtctttagttttcttttcttataatatgtttctctgggagggagaggtcgtttgttttttagtttcgtttttttttcttttttgaaacagtcttggtctgttgcccaggctggagtgcagtgacgtgatcttggatcgctgcaacctctgcttcccaggttcaagcaattctcctgcctcagccttccaagtagctaggattacaggtgcccactaccacatcaggctaatttttgtatttttagtagagatggggtttcaccatgttcaggctggtctcaaactcctgacctcaagtgatcctcccgccttggtctcccaaagtgctgtttctctagttttggtatcagagtaatactggtctcataagagttgggaagggcccctctccctccatcttttttagtcttcgtccagttgactgacttttgtgtgttagtgtgcatgaattttcttttcaccacacactctaaagtagacacttttaacaactgatgaattccctcatatagagtttctttgttctatcttgatcttttttcatagaattatcttttgttggggcacagatatgcattatcagagttgtttctcttcaagcagagaagaacaaattatttaggagttccgtttgtgcatatcgatgctatgtatactgttagaagaatcacatgatcatttaagtgtcaaactgagagtcaaaagacttggctgggcagggtggctctcacctgtaatcccagcacttgggaaagccaagttggcaggattgcatgaggccaggaactcaagatcagtctgggctgcatagagagaccccatctctatttataaaaaggttttgaggctgggcacggtggctcacacctgtaatcccaacactttgggaggccgaggcgggcagatcacatgaggtcaggagttcaagaccagcctggccaacatggtgaaaccccatctctactaaaaatacaaaaattagccaggtgtgttggcacgtgcctgtaatcccagctactcgggaggctgaggcaggagaattgcttgaactgggaggcagaggttgcagtgatccaagatcacgccactgcactccagtctgggcgacagagtgagactccgtctcaaaataagtaaataaataaaaaataaaaggtaaacactcagtgaaataaaaaaaaattctatgggatataggaacaacaatgacaatagtaaacatatgttgtatacttacactagactaaacagttcacaaatactgaagtcaggttttctggcaaaacaaccagctctgctgtgaaaaaataaaatctccagttccagacagaaactgaagattgtaggaagagaaataagacaactattctcagtcactacagaagatcataataaactcctcaactctctgttggataaattctttacaaatggaaattaaaatagtaacacttaaaatgtatagtaattttaagctttaaagtgctttgcatgttattcattcagagcactaaatctaaaacaatttaggccaggtacagtggctcacgcctgtaatcccagcactttgggaggccaaggtgggcagatcacctgaggtcaggggtttgagatgagcctggtcaacatggtgaaaccccgtctctgtgaaaaatacaaaaattagccgggcgtggtggmacgtccctgtaagcccaactactcgggaggctgaggcaggagaatcgcttgaaccccggaggcagaggttgcagtgatccaagatcacaccactgcactccagcctgggcgacagagtgagactctgtctcaaaataaataaaaaataaaaggtaaacactcagtgaagtaaaaaataatttctatgggatataggaacaacaataatcatagtaaacatatgttgtatacttacactaaacagtttacaaatactgaagtcaggttttctggcagaacaaccagctcttctgtgaaaaaataaaatctccagttccagacagaaaatgaagattgtaggaagagaaataagacaactattctcagtcactacagaagattataataaacccctcaactctctcttggataaattctttacaaatggaaattaaaatagtaacacttcaaatgtatagtaattttaagctttaaagtgctttgcattttattcattcagagcactaaatctaaaacaatttaggccaggcccggtggctcacgcctgtaatcccagcacttttggaggccaaggcgggtggatcacctgaggtcaagagttcgagaccagcctgaccaacatggtgaaactctgtctctgctaaaaatacaaaaattagccaggcgcagtggcagacgcctgtaatcccagctacttgggagactgaggcaggagaatcacttgaacctagraggcggaggttgcagtgagccgagatcacrccattgcactmcagcctgggcgacagagtgagactccgtctcaaaaaaataaaataaataaataaataaataaaacagtttaagcatctgctctttgaaatccaaataccatttaaggtactctaagccttaatagctgagtgaaaatacagtgttggagttttacaaaattacctgtattttagtaatttttttgtcaggccaaacttaattatctgggagaaatatatatagatagatagatatgatatatttatatgtgtataatatatatttacatatgtgtgtaatatatatgtaatttggatacaatttcctattcaattgatttcagcagaaacgtattaaatatagaaagtagtactgtatagcagcagtccccaactttttttggaccagtgatctgtttcatggaagacaatttttccacagatagggtgcgggtggtctggggccattagatctcataaggagcttgcaacctagatccctcgcatgcgcagttcacaatagggttcgcactcctatggcaatctgatgctgccactcatctgacaggaggcagagctcaggcggtaatgtttgctcgcctgccactcacctcctgctgtgtggcctggttcctaataggccacaaactggtactggtcagaggcctgggagttggggactcctgttgtgtagggaggaaacacacatgcaagagacagtgttctatttgatgttttctggagatgctatcgtgaagacactgtagacttacctttttaggcttagaaaatgtttatattaaatctcaactgtcagagtccagattgaaggctgttctaaaggcatgaccttattcatcataacacttttgctgctaaaacaagcttcagacacattcagtacattttgttttgatccaatatttatttgatccagaggcytttccttttgaagggcgttttggaaacagccttatctgtaatcatgtgtactaattgaataacgtttacactttccagtgcaaatttgcttaattttcaaaggaaaaarggaaaacaaaaacacttctgacataatcagttttcactgagattgtatagaatagagattttccatctcctttatgaaaaattcaaatgacatggctattcatgaaataccatattacataattaccaggtttttcactgaaaactattgcccaaatagtctgggtaagcaaattcatcatcacctctggagatacagtctgttataactaatgaaatccagctaagatttgtattcaaatatttcctgactctaaaatgaaagagttgcttttataaaattttcaaaattgtgagaacagatgtgtttgccatgtaaaaacattttggttgtgggaggtggaccacagctaaccaattgttcacaatagctaacattgtagaaccttcagtattaaattcactaactcacttcatcatcaaaattccctatgaggcgttactgtgctccttgcataggttaccaaactgaagctttctcagagtcacatagctaagtaaatgttggtcccgagatttgactccagtgttctctgatgccacaggcccagttctttacctgcagtactatcatttgggaataatttggtttctgcagccataatatataatttgtgggttgctttcctttcataggtatggacaaacactatgtcataaaatcagagctacaacttaaaagcctctaaataacaccttgagataacaaaactgtatcttaggttctaatatatgtgatcatactatacaggcagtccttggtttgcatagtagtctgggacagtaaaaaatggtcrtgcaaactgaaaccatgcaaaacaaacttaataattaatggggaaatttacaattgttttgtgatctttaaatatttttgtgaaacattaaaaagtctcttactgttggttataaatatatatagaaatgaaaatatagtaaaactacttagtacttcataatttaaaacattaggaayattgagagttaaccttttatttctttgtaaacagcttatcaagagtattttgatcttgccttcccataaagcttagggccgggcrcggtggctcacgcctgtaatcccagcactttgggaggccgaggtgggcagatcacgaggtcaggagttcgagaccagccgccaggctgaaaccccatttctactaaaaaccccatggtgaaaccccatttctactaaaaatacaaaaattagccaggtgtggtggcgtgtgcctgtagtcccagctgcttaggaggctgaggcaggagaatcgcttgaacccgggaggcggaggttgcagtgagcgtaaatcacaccactgcacttcagcctggtgacagagctagactccatctcaaaaaaaaaamaaaaaaaaaaacttaggacactgagcaagaatcttttctatgctttggcaaattgtcatcctcatttctaagtttggatcaccttccaacattttatcctctgcactttaaacatctggaaatatctttgtgagtacctttaatgtgccagcatcacttcctcttcgacattttcatcctttttgcaactactgtactgtacttttctttttctttttctttttcttttgagatgaagatggagtctcactctgtcgcccaggctggagtgcagtggcacaatctcggctcgttgcaacctccatcccccgggttcaggcaattctcctgcctcagcctccccagtagctgggattacaggtgcgtgccaccttgcccggctaattttttaaaatatttttagtagagacggggtttcaccatcttggccaggctggtcttgaactcctgacctcgtgatccacccacctcggcctcccaaagygctgggattacaggcatgagccaccacacccggccatactgtactttttcatttaatagattgaaaaatttgcctccactaaatttctttgggtgmacatctaaagtccctcaaacagcattagtgtcaacatttccatattcagttatttcttctataactccatttaggtagttttggggatttttttagaggcagggtttcactatgttgcctcagctcctgggcccaagcaatgcttctgcctcagcccctggagtagctaggactacaggcacaccccactgcacctggctccatttatgttttttttttcagatttcatttccaacattgtcactctttgttgctgtcctttctttcttgtaattcatttttgtaaaacatcacatggatttatcactaggagacaagacaaggcaactacatccttagctgtctatgagtgaactgaataacagatacstagtaaccaatcactggccgactttgaatgaagtggtgtcattggccgttggtcatgatgttatgtagtgmttttatagactgaagtgctggcagcaaagattgtgcgttatgcattgctcacaatcaatrtatttggtcattgaaatttggaccatggtttgaggagtagctggtgttttaactaaagcatagtaactgaaacttacccatatyagaacctcgccaagagaggactaccatgaaagttaaatgaggggcattaggttccataaaggatcataaaaatactactctactctattatacatttacatatacacatgtgtatcctaaagtaataagctagttttaaaatattaaccatacttaatgattaatatttattatatctaattataataattttacttgccacctagggatttagaagagttcagagggatttaatgtatgatccaggaagtttgaaagtttgaattgggccaggcgcggtggctcacgcctataatctttgggagtgtaatctttgggaggccgaggtgggcrgatcacgaggtcaggagatygagactatcctggctaacacggtgaaaccccagctctactaaaaatacaaaaaaattagctgggcgtggtcgtgggcgcctgtagtcccagctactggggaggctgaggtgggagaatggcgtgaacctgggaggcagagcttgcagtgagccgagatygcgccactgcactccagcctgggagacagagtgagactccatctcaaaaaaaaaaaaaaaaaaaaaagaaagtttgaatagatactttcctttagatatgaagacattcagcatcaattcattgctcttaaagcagatctcatgatggtttattttttaaaaagaagaagaaagaaaagaaaacacaagtgcagaaggatatgaacaccatgatacttcttatagaacrataatgtaaacaatattatttggttattgagaaacatttacattataaatgtaaaaactcataattcataatattyacccatatggaaggagagaaaatggtttaaaatttttccacattgcaatttcttatatacctatgtttaatgagacagtattttatatggacacctgagtgtttttcatcacacggtaatacttacatatcacattattcaaattaattactaatatttaaaattcctattttggactgaaggaattgaattgacttataagttgttcttttagccctaaaattctgtatgtattctttgacttttatattagaaaccatcaaagctgggcgtggtggctcctgcctataatcctagtactttgggaggcrgaggcagggggctgacatgcgcctaggcattcaacaccagcctggacaacatagcaagactctgtctctacacacacacaaaattagccaggtgtggtggtgcatacctgtagtcccagctactcaggacactgaggtggaaggatcacttgagcctgagaggcagagcctgcagtaagccctgattgtgccactgcactccagtgtgggtgacagagygagaccctgtcttaaaaaaagataaaarctatcaaatrtagtgcgtgtttattttggggactaaatgcttatttttaaggggatggttaaagtactcagcattatttagggagttaaagccttaggttttaaacctgatttggggttgagctctgggaaggaaaagatgattgattcataggcaccctgatacagtcacttatratctgaaaagcagatgtactctaaggcactcaaaataaaaataacaccrgtcctatgcttatctcttaaagtcatgttgttttctgcaaggtgttaaaaatcaaaataagattgttctaataacattgaagtttcktcagtatatgtgtatgatacaagcgaaattgatgggtaactacttgcagtataattcttttagaattatgtacttttagattgacttaccagaactgctgaaataaaaaacactccaatttaatttgaaatagtgggaacattggctctgctgcagtgattttaagtgtatacatgcccgactgtgaatggattaagttcatcattggtgctgccttgaggtgattcagaaactttcttttgccattgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagyacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtstcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcycccatgattgataaagacaaggaagccttaatggaagagatcctcaagctaaagtccctgctgagcaccaaacgggagcagatcgccacattgagggcggtgttgaaagccaacaagcaggtaatctcattctactggtgaaagcatgccagtcaaagctttcttaactaatttattccctaattttattgagtatcgagtatcgtcragatgagagttcagattcttggtaagtggataaataaaactgtcccagtgccagatcagaatgtcataataattattgtttttaaatgatgaaatacctgtgcccagttaggtggaggcagaggtgaggaacttaaagcaggaacacaggagaagatctagatgcctttctgcagatgtagaaaggcagctcaggcggtgctgggctgaagcctggcagtgagtggctgtggaaacaggagatggagggtggcagaataggctggcaaggcaggttacaccaaccagggcgatacagcaagaaagacaaacacccagcaggcagctagagcaaacagagggaaatctgggtacatatggtgaagaaggtctgatggccaataactggaccccagctttggagctggaggttcagattcaagactcaatttctaggagtatagcaaaattattattattwttwttttttatttttgttttgagacagagtctcgctctgttgtccaggctggagtgcastggcgccatctctgctcactgcaacctccgcctcctgggttcaagcgattctcatgcctcagcctccgaagcagctgagattacaggcatgtgccaccatgcctggctaactttttgtggagacagaatttcaccatattgtctaggstggtctcraactcctgacctcaagtgatccgcccacctcggcctcccaaagtgctgggattacaggcatgaaccaccgcgcccagccaagtatagcaagattaaaaggagtgttttgtccttcatcccaaacttagagaaacaagagcgctaaataaatgaataagtcagggatgaaaggcaagacaactgtgaggacctgagtgagtaacagaaacaaagccagacagattgttaccaacaaattaaatagtttggggccactttagcaaggaaataatagagagtgtgtgtgagagagtataagaatgagctctacctgtgctactgaccacgtatctgaaatttaggttcatttgggatgttaacccacctgggtcagaggttaagtaatagggagcttttcctagctattgatcttgtccttctggacaagtagtaatgttacaacatgaacctgtctaattcccagccctccttaatgactgaaattgttttcaccctgagttttaccttggtgggagtgctgcgaaatataggcaggaaaattattttcacctttatttagtttatctgaaaagatattcttgaaagacacatatttgagaaaggtgctgaataaatgttggtgttgataaagagaagcaacaaagcaccaaataccctcctgcaaacgcaagcagtgccagtgaatagtaggtcaagggagctcttggtctttggagaatgaggattaatttcagattcagagtgtcttctccatttgccatcatctggggaaaaccacgcccttattatctcatctacagtgcagctttcaagtcctcatctctagttcccataaatctatttatataattgacatctataccataagccataatattgtttgcactattaacatgttttatataaacctaagggcaaaatatgactttattttatgttgtcactttagagaaatagaaaagattagagtgaatgaaaccatcattctcagcaaactatcgcaaggacaaaaaaccgaacaccacaagttctcgctcataggtgggaatcgaacaatgagaacacatggacacaggaaggggaacatcacacaccggggcctgttgtggggtggggggaggggagagggatagcattaggagatttacctaatgtaaatgacgagttaatgggtgcagcacaccaacatggcacatgtatacatatgtaacaaacctgtacgttgtgcacatgtaccctagaacttaaagtaaattaaaatatatatatataaaataaataaaataaaaaaagaaaagattagagtgaatgaagaatttgtgagagatctgactctaattttaggtcggaataaaggaatttattattrtaactctgctataatttaaagacccaatgattcagagtggtcataaataaccaataccatattagataaggcttacacaaggacatgctatcctggggcattcttgatcaagccatccagataacttctctgacttcttcctaaaggttgaatattaacaatttaggtctgggcgcaatggctcacgcctgtaatgccagcactttgggaggccaaggccagtggatcacttgaggtcaggagtttgagaccagcctgaccaacatggagaaacaccgtccctactaaaaatacaaaattaaccaggcgtggtggcgggtgcctgtaatcccagctactcgggaggctgaggcaggagaatcacttgaaccccggggggcggaggttgcggtgagcctagattgcatgattgcactccagcctgggcaacaagagcgaaaatctgtcttwaaaaaaaaaaaatcaagatgcttaactgaaacagaggtatagataaggacacttggccaaccaacagagactaatttgtgaacaagcattcattgattacatattttctgggaggcagtaagtagggatgcaaaaataaatgacataatctagtaggaattccgcaattgcctgtagctgtttacaagacaggacttatcaagcactttagagtgatgtaaacagtaccacaggaaatcagaacagaacaaagcattcctagctgaagttttattttcactgtgctttgtggtacaggttgagtatcccttttccgaaatgttttgggggacragaaatgtttcagattttggattttggacatttgcatatatacataatgagttatcttggggatgggatccaggtccaaacatgaaatttacttatgtttcatgtattcctatatacatagcctgaaggtaattttatacaatttttttaatgattcygtggctgaaacaaagttttgactgccactcatgacatgaggtcaggtgtagaattttgtggctcatgtcagcactcaaaaggtttcagattttgaagcrttttggattttggattaaggatgctcaacctgtaccatttgcattacattagagttacagtctatatgggctcagtaaattaaatgaaaacacatttctagcaatgcatttggtctgcacgttcatgatgttggggctgttgctgtgatgcttattgccgtaaatagcttcaagtattaacagatgacattcactatatttatttagacattgtgaaatgtttgtttttaaggttaaggtgagaattctggggtacaggggaaaaaaggaaatctccctgttttaaaatasgcattctactatacagccataagaaagaaaagaatgagatcatgtcatttacagggacatggttggagctggagaccattatccttagcaaactaacacaggaacagaaaaccagataccgcatgttctcacttataagtgggagctaaatgatgagagcaaatagacacatagaggggaacaacacacactggttcctgttggaggctgaaggatgagaggaaggagatgatcaggaaaaataacaaatggatactaggcttacakacctggtgaagaaataattggtacaacaaacccccatgacacacatttacctatgtaacaaacctgcacatcctgcagctgtacccctgaacttaaaagttaaaaataaataaataggcattctgtagtctctatgaatcttctcatttacttaaggattttttcataggcacagtgccttctgatgaagtcagtaaatgcttatgaagcaccgtccatctagcactgtgctagatgctgaagattcaaagaagactaacacatggtccctgccttccagaagactcagcctcctggggatgtcaggatagaaacacaattacagttcaacgttacacatgctgtaatccaagttatgagaacaatgcagaggaagcaactaaggtttcctagaggagcggaaaagacttcacagaagcaattataccttagtttgttattaaaggataagaagttgttttccagaggaggaggaagtaattccagacagaacagtaggtagagaggctttggagtgacaaaatagaataatatattcagggaatgctcacaaaggcctatgtggctggaaataagactttttttatttagaaagtcaactttggaatgtgtggagaaagtggtgaaagcagaaatcagcaaatccagtgagttatggatacttaaaattacttaattctggaaaaactttgcacagtcaatggacaaacaaatctacaaacaaaactgaggctttggggtatttgtcacaaacaataaatgattttgtatttctgtttcagatctagctcttctgttatcccccaytttattccccttagatactgaccatgggattctatgtgcttacaaatttgttacatctacatttcacaacttaaacatacttttctgttttaaatgaatatgtgtctaagctttttaaacactaaacaactgccgtttttccccaggtcaatttctgccttgtggataattttctgaatctgtaatatttctgaagattcctccaagtatttacagaacatacagaagtattttatgagtaaagtctcattttaatctgaatttaaatccaatcaaaactcacaagaaactacttcggaatcaaaacagtaacaaagtaccctatcccaacattgatttaattaagaaagaatttatttctatagatgttggcactttgcatatgaaggtttgaagctgcccatttcaagcaacaaaaagaaatgttaaaaaccaaggtagtsttcctgggaaatcccgttagtaatggatttctctgctagtaatggggttgttcattagtatggggtatttgtatacactttgaaaagttatagtttccagtttgtaaaaatcatgtgttcccagtttggcttcaacatgcaaactgtgtgctatgcatcaaacaggcaatccctaagtatacactgattttatgcattgattcagtcagtgtgtttttttacttgtgtgtgtgccagggtagctcttgatttgaaacactattaattccaagaacttcggacatgcccaaatcccagattcaaacaaatgttttaactcattcaacattttataacccctacttttatggagattttgaaggaattatatttcactatatttcattgtttggacaaattgtatgcaaattagaaagtaattagttctttatcacttcttttccttaaatgtatgataacatggatttatagtttatcatatactcatattataaattacaatggtgtatgtcttttattctatgttttgggcccacagagcacaggtgacaaaatttgagttctaacatattccaatttgattattccwattgaagctgtgcttctttactaaataattggtaaaaaaattttttttghataaagtttcattttggctccctccttgtcctaaaatcgcatactttcagcaatctgcattaaatatttattaaactactgtcattctcttagctcctgatactgactctggctcgcagcgggcttctagggcaatttaaccacattatgaattcacaacacattttgacattaaagaaaaacttccctgtgtccaaagcgcatacctatgtttatataaaatgtaaccaaatcaatttcactttccttttataaaagaacataataggcacagcatgaagcaatctgtatgatggattttcctgatatgaaaattgtaagcagtgtgattttctgctttagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaaggtaacagtattttcttcctatgactgggtgtggtaggtggggwaaaggctttaaaattcacagccctgcctttgtgcatgttgagtgtattcggtgagtagtctaggatggctaagtgtgaagaaaatctgtggaagtccactctgacrtatctaaaagcaagccttctgtgctgttttccagagccccctactgaacactctggatccagaaattctattacataaaaatattttttaagtaagctaatattaataggttgtttctagaatttatgcaccccaaagagagtctccctccaaataaaaagctttcaataaggraaaaaaccccacttcctagaatagctaaatattatcacctctgaaatagagttctgtgaaggaagtacatgaaagtatataaaagtgccttacctttagtactgtgcgagaagatactgtcataatgaagattaataatcatcacatcagctaattacttataattttttttttttttgagacggagtcttactctgttgcccaggctagagggcagtggtgcgatctcagctcactgcaacctccgcctcccgggttctagcgattctcctgcctcaccctcccgagtagctgggaatacaggcacctgccaccacgcccggctaattttttgtacttttagcagagacggggtttcaccctgttagccaggatggtctcgatttcctgacctcatgatctgcccgcctcggcctcccaaagtgctgggattacaggcgtgagccaccgcgcccggctgtattttgtgtttaaacatgaagtgattgttaagaatgtatttgatttgaagttttcagaatcttgagattttcaatatactgttgaaatacattttttgctgtcacaatgcagtgtcaaaaaagacctacttttttttttttttttttgagatagggtctcactctgtcacccaggctgaagtgcagtggcgctatctcggttcactgcagcctggacatcctggactcaagcaatcctcccacgtcacctcagcctcccgagtacctaggactgcaggcttgcactaccacacccgctaatttttgtggtttttgtggaggcagggtctcgccatgttgcccaggctggtctcaaactcctgggctcaagagatccgcccacctcggcctccaaaagtcctgagatacgggtatgagccaccatgcccgaccaaatcctaccaattgtgtatcttgtatgatgcaaacttggtgcaaaattcacgaataattactatggctttacttgcagatttagtaaataatttacatttggctgatacatgtaaaagtgttaaaaacaaacaaaaaaagatctcttgagctttataggagtcccccagaaactgagatcacaccactgtactccagcctgggtgacagagcgagactccgtctcaaaaataataataattttttataaaaaggaattgttatccccaaattgtctattttcacagacttttttttggcatgaacagtatttgttattcatattttagcgggtaaataaactcagaaaaaaaacaaaacaaaattcagaatgagctttttctccacgccacctctaccttccaaatgtatatgtgccaggttttgcctttggtaaggaaaaaagatcactaagcttatctttcttcttcggcacaagtatgaaacctgaataaagatgtttcggacagcctgctgtatctgtatgaaaccttgtgaaatcttggtttttgcagggttttctgttttttgttttttgacaactcattgctctgtcatctggttgagaaatcattgaaaatactcagttttctaattcaggcaaatcagtcaaattgacaagaccaacagctgcaatctatactaaactaaaacgtataaatatagataaggaaatgttttctttataaacattattattttggatactataggcatagcctataataaacttgttacattcctccaaagaatacaatgtcatacagtaaaaagagctactgtaagacacttcaggtatagtggacattgtgtgagacttgactgttattcgtctgttacacagcagccccacgataactctgtccctggggtttaagacattgcctattaagactgtctccatatgggctgggtgcagtggctgatacctgtaatcgcagcactttgggagactgaggcaagaagatcacttgaggccaggagttcgagaccagtctgggcaacacagtgagaccctgtctctttaaaaaataataatgactgggcgtggtggctcatgccagtaatcccagcactttgagaggccaaggtgggaggatcacttgaggtctggagttcaagaccagcctggccaacatggtgaaaccccgtctctactaaaaaaaatacaaaaattagcttggcatggtggcacactcctgtaattccagcaactcggcaggctgaggcatgagaatcgcttgaacctgggaggcagaggttacagtgagccaagatcacgccactgcactccagcctgggcgatacagcgagactcagtctcaaaaaacaaataaacaaaacaacaacaacaaaataataataaatttttwaaaaatgtcccatatatctcattgtatggatgaacatatattccarttttctgctattgtgggttatctacattctattgctagacctttaaaccagtcttctaaatttctaaatttcrgtcaaatttattacttttcarcttaastcccaaattcagtttcaccaagattttcctctgaccacttctctgttttggttccagatgtgatgaatatgtcacccagttggatgagatgcagagacagttagcagctgcagaggatgagaaraagactctgaacactttgttacgaatggctatccagcaaaaactcgccctgacccagaggctggaggacttagagtttgaccatgagcagtcccgacgcagcaaaggcaaacttggaaagagcaagatcggcagccctaaagtaagtggggaggcatcagtcaccgtgcccaccatagacacttacctcctgcatagtcagggcccacagacacccaacattcgggtcagcagtggcactcagaggaaaaggtatgcatgcagcratcttcatagtacggtgcagtggccagattttagttaactgcaaaaataaatgtgctcttgttgtggaggatggaggaggggaavsaaaagaaaaaatgggagctggcatataaatggtcttgctaatgtgggtctttccagatcaaaacctttttgataattgtgtttatgtagtcctttctaaccccctgcccaatccctcctcttgattaatcgtaatataattttcaagtgtctgttaatatttttgctactctttgtatgtgtaaatatgcctctcccttacctccaacctgagaattggtagataaaggtggatattaagaatgaagctgtgttctacctgggttataattttaaaagtcattgtacctttggaaatggtgctgtttatcagcttctctttaacggggcaaggatatgaatatgttctcttagggaaacttttgtccatatgaccaaaactgatgacagactgaaaggggatgtctatatctagataaaatgggatggaatacgcacagtccttttcttgaaagcaggtttttgtgctttttcatttggcatgggaatattgcccagagaaaccacttgtaaggtttttaggggcttgattttgtgagtcctggctgttgagttacttaccctgtattttcggttaatggtaacatttttattttaggagctttcattaaagactcaaataatatattttctatttgcggttcaagctgactaactgtaataaatcttttttccagtatccagaacagtttccaaatagggttgtatcctgatgtggaaactaaaaaaaaaaaaagcaaaaagattgatttacatatttaaaaaattaaatgccartataaataatgttgtcactggtgaggcgttaaaaggtaattaaagtraaacttttttgtttcctatatgtatttttcttggatctcctgcaagacaattttcaccttccctttgtgatcagagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccaggtaaacattttttccttgggtgcatgtgatgcaaatgattagttgaatagactctycccttccttccggtcactcaggctcacccagctgcagagtatacctttgatgatgtgtaaattcctataagtcaagtaaaaacttccttacacttagcttcccatttcctccttcactcatattccttagaatgacagacttccatttaacagccaaagatggcaaatgagagttggaaggaatgggataggtaaagggaaattagcaacaagcacaacgcacacacacttggatcctatttgcagtttggtagctcatggcgattccatcttggtcagatttggccagttctctcttatcgtttttaatgtaatttccgtaaagggagagccatatgtataacaaggcttttgggctgatttccttttgtggtgactcagaacgtctcctcaatcattatattgagaataaaagtaaaaccttctaagattttgctcctcaagaacatttaggtcttagtataatgttcttgtagattgcaggccccccactggttaatgcttaccaacatgttcacacttagcttcactattttgcatttttctttcttccttccttcctttcattctttttacttgttctatgaagaggcctaacttgaaaatgtgacatatggcaaatagagaaaattattcttgcaaataaaaatcatccttttaaggaatccctgcatgtgagtatagggcagaagtggcaaacaaggagcccataaaccaaagtaagcttaaaggcagctgttatttgactattgccagaaaataaaaaataaaactatttaagttagttattgacagttaaaaattcaagagattttatatgaacatcagtatttctggcctcttttggaagattctgaatatctggcagccctaggtctgcgttcacgcatgtcaacacctgttggagctctgtagtggctgctgctgttagggcaagcttcgcactttgccacagtcaccactcctccttattacttatacccagcctgctatcctcatttctattctctcctggcccctcctgtagtctttgagtttgccaccgttgaaatagaattttttttttcattttaccttaattcctttttgcaaacctcagcctttggatctctaatactttccttatctgattcatgaagtcagcctactgattgggattaaaagatgtggtgtagaaactgatagtgcatttcacgttctaaaggtgtttgaggaaattggtagtgataatgagttggaatggtgtaatagccaaaatatacacctaagaagaaaaaaagtaaaaactgcttggtgtttttaatttcataactgatttcctattgttttagacctccttggaaggtaccttgaagtattctgtgaatcaccaaagtggtaatgatttatcaggatacctaactcggataaaacccacaagtcttctttttagtgttccaaatggatttagtagcactatctactggaacttagaaaagaaattggtatgattaataaataactcctattgctgtttaattaaaaagataacatctcaataaggttaaaaattaataatcaatgttaacaacaataactgttttcatttttgtatgactggtttttgtttacatgratatataytttatattgttatcattacattgtttaagccatgaacattatatcacaagcttttccatgttgctatctagtcttgtttttatttgttaaagttattgtatcatagattttgtttcagatgctgttatcacattaatcactacttctcttcttgtccactgaggtagtttttcattatttgttatattatagagcactgctgggaataccctcatgcattcagcttctcatctattacatttttctcaagagtgagatcactcagttaaaagttgaacatccttatgttttttgctccattctgatgttgctgtcaagaagggtatatcaatgtactaaaagcccataaaacactttccctttttcccacattgggaatctttctgctactttatccacactgtgcacatcttacaactctaaagtcagttagcatacatgaatgagagtaccatatattgtcttaaactctttagttttgaataaccagaaaataccattgaccttagaaatgattactatttatgagattcgaggccggctgcagtggttcacacctgtaatcccagcactttgggaggccaaggcaggtgaatcacttgggctcaggagttttagaccagccttggcaacatggtgaaaacccgtctctacaaaaattagccaggtgtggtagtgggcacctgtagtcccagctactcaggaggctaaagtgggatcccttgagacagggaggcggaagtttcagcgaaccgagatcgcaccactacactccagcctgggtgacagagtgagacactgtctcaaaaaaaaaaaaaaaattagagatataaggaatgtggaattcagaataatcaccagaccagaaggtcatgctaatgacagcttaacatattgataacctttataattctcaccatttatgtaaagttaaaataataaaagaggaaaggaagtaaagctgttattatagccttaggaatttttaattatgtatcgtggaatcaaccagattaacgcttagtaaattattatcaaatcaatcttagcaacattttctaaaaggtcctagttaaatgaattactacagaaagtgackgaccatccacaccaaataaattgtagcttctacaaatatctgcattattaccaatatatgttaytttccctcagctgaactatatagggtaagacatatcaaacattttttatgatgcttttactatataaaatcttttcaataagccaagaaagagaaaakatgacatataataccagtcttatgttctatataagaaatatcataagcccatgggaaatagtagattttatgagtatttttaaattcaggagtttaaccattataaaatttgctagctagtaacaatatctattaatcattttaaaaggaaaattctctattaatgtatcagaatgtttttgataagcattgttttacatatatatgtatatatatatgtgtgtatatatatgtgtgtatatatatgkrtatatatatgtgtgtrtatatatatrtgtgtgtgtgtrtatatatatatatatatatatatatatgtatagttttgggggtttgtttttttttctyttttttttgagacggagttttcctctgtcacccaggctggagtggagcggcgcaaccttggctcactgcaagctctgcctcccaggttcatgtcattctcctgcctcagcctcccgagtagctgggactacaggcgcccgtcaccacacctggctaattttttgtatttttagtagagatggggtttcacagtattagccaggatggtctcaatctcctgatcatgatccgccatctcggcctcccaaagtgctgggattacaggcgtgagccactgtgcccagcctaaaatatatttttagtacatctttttagatgatttttaattattctaataagcagatatgggctttatttttctattgaggaccattgaaacaattacctcaactaaaaatgaaatcagtttaatttgtttttaatccttcagttgaagaattgagagaggtatgtgtcgtttaaaaatttaagacacagaacataaaatgttatttattctgtacaagagttactttcaaatagattttatttctatgagatggtaaacagaaagcctcatctccttaaatgcacaatttctccattctggagaatcaactatagggtgrggcactgattttcaacattagtagaatattgtatagtaattgattaatgcattatactgatcggtttgctgcattagtacaaccttttaagggaaaattctggcgtttccctctggctggctcagcttctgcaacctcagcccttacaattgcagtgcttctggccatggcttgcttgttaactttcttgttcttgactttatccttatcctggcacacaaattccagtgtccttccacatgctcatcttagttttcacagtttcagttaccagctgatctgagaagtgcctatcagccttgatgaccttgactcaaaagggaccctgttgtcatcaaggagtttgtaattrgrcagcagattgtatgtcttcacaaaattgttgcctattttttagccagcattttatcttgactccttaactacctaggcctatatccttctcctcctcctccgtcccctcttcctcytcctcctccgtcccctcttcctcctcctcctcatcatcttaccatttaatcaataattgcaatcagcctgtcagaatacgtaaagggaatccatgtaattcacaggcgggagttgttatttctgtagtaaagacctgactgcagcatttacacatgataaataggaaatggcaaacctggggaagcaagtttgaactcaatctggaagtaatagcctaagcagcttgctcttcacactgtgtttcccatgtcacccttttcctcttaggtatcttgcttctccctctcatttcaatctcctccttccttctgttcctccatccttccatccctccctcctgtctttctctgacacaatgactcagctagtttaagagaatggtattattttgaagtctgaaaatgtttctgtgatattttgctttttactgatctttaaagcaactcacagaagtgtattagccttagatacgtaatcaccccttgagatatatagtcaacagtacacacygacatgttcatagtaaaaactgcctttatgtttcactgcattcaagcaagtagatatttgtttgtttcacgtattgcaaagcctatgttcttaagcatgtaccaaaatcacatttatttcattaatccatttactcattcaccagaatgtaacaaaatttagtgaatatctgctatgtgtcaggcacttttcttggctcttgatatacaatgatattcaaataaaactcatagtctggtaggggaggtaggagacaaatatgtactgatgttaatagatattcctgaaataaataaaggaattaggatggttaggaacgtccttccagaagaaatgcaaggctggccatgaaaggtgactatatcgtaataggcagaaggtggcagcgcaggtatgggtcgtaagaagaaccttataggaaaggaggtcaacttgccccagtgccatgagctcagcactacaacctggtgcaggacttcgaagtaatagaaagcgaggctgcaaaggtggacagggacctgaagacagagggccaggttagtgagagcagacttaccacgggcatagcttagcagttttaagaataggatcagattttcatttgataaaatcaccctgatgacaaggtggagagtggattagatgtgggtaacatcgaagataaagaagcaggtacagagactcataaaatatgcagatgagaggtagtggagaccagaatcaaaactgtgaggaataggaatgtttaaatatgtcccaagttacaattcagttacatatttcatcagccagcatgtcctgtgcacacacgacctgctcttactgctttccatgttctgtatgtggaaggagatcagtcaatcttgaactcatggcctcagtattttgtactttataatttatattttttcctatagaggcttttctatttatgtgtattccacttccccatatcactaaactgtctttttccacaggattcaattcttgaactagtaggagtgaagggcagtctgttgaaacctgtaatctcttaggcttgtattttctttgaacatagtttccacagaattcttccctgtaggggaaggcctgggcacttcttgatgtcagaacatgttgtctttagtttggaatctgccaaaacaaaagttaaatcaaaaatgttaattcctgtcaccccagcacttcgggaggccaaagcaggaggattgcttgagcccaggagtccgagactggcctgggtaacatagcgagacctcgtctctacattaaaatttaaaaattagctggatgtgctggcatgcactcatagtcccagctgctcaggaggctaaggcgggaggattgcttgagtctgggaggtcgaggctgcagtgagccactgcactccagcgagtgatggagtgagaccctgtctcagaaaaaaaaaaaaaaagaagaaaaaatatattaattcacaaaattgtcaaccacatgttgagaaatacatttttatacttgctgtatatttttcaataggtaatggttcaaaaattttaaagtacaaagggtatacagtagatggtagatttctgccacaactgtgcccacccaaccttttgtatttttccagaaacattctatacatatataaggaaatgcatataaatatatacatatataaaaacatatgcattttacatatgtgttaataccattggcacaaccacagacattatgcatgccggtttttttcacttgatgtatctgggttcttctttcctatacatttatctttttgtttcttttgagtcagaagaagttatgaaggggaaggaagacatgcttgagctctttaagaaagcttggaatgtttctatgtgtgcaatagaaatatttcttgccaaatgataaaatgacagctacaagaatgtttctattcagaactattcaatagaaatatgatataaaccatatatgtaaatttaaattctctagtagtctagtagtcatgttagaaaaagtaaaaagaagtcaggcaccatggctcacgcctataatcccagcactttgggaggccaaaatgaaggatcacttgagcccaggagttcaagaccagcctgggcaacatggcgaaaccatgtctctacaaaaaataaaaagattattcgggcatagtggcatgcgcctgtactctcagctactcaggaggctgagatgggaggattgcttgagcccaggagattgaggctgcagtgagccatgatcgtgcaactgcactccaggctgggtgacagagcaagaccctgtttcaaaaaataaataaaaagaaacaagtgaacttaattttagtagtagattttaattgacacactatatccataatgtgatcatttcaacatggaattcataggtggctaacacctataattccactttgggaggccgaggtgggtggatcccttgaggccaagagttcgagaccagcctgggcatcatggtgaaaccctgtctctacaaaaactacaaaaattagccaggcatggtggtgcatgcctgtagttccacctactcaggaggccaaggtgtggggatcgcttgagcccaggaagcagaggttgcagtgagccaggattgtgctagttctttccagcctgggtgacagagtgagaccctgtcaaaaaaaatatatatatacgtgtatatatatatatatatatatatatatatatatatatatatacacacacacacacgcacacacacacatacacatacatacacattctgtttttcttattcagtctttgaaattcagtattatgcacttacagcatatcttgatttgaactagccacatttcaaatgctcaacagcctaatttcgctaagggctactgtgttggacggtgcagttctagaacttcttagttttaactagatagaatttccacacagaaatctaaatttgaataactaatgactgattttaaaataaaatttaagatggcatgtatttcggttttatttcttttcttttctttttttttttttttaagacagaatcttgctcttgttgcccaggctggagtgcaatggcacaatattgcctcaccgcaacctccgcctcccaggttcaagcgattctcctgcctcagcctcccaactagctaggattacaggtatgtgccaccatgcctggctaattttgtatttttagtagagacagggtttctccatgttggtcaggctggtcttgaattcctgacctcagttgatcctcctgcctcagccttccaaagtgctgggattacaggcatgagccactgcgccctgccctcatttttcttttaaactgacatagaccaaagtgctattttgctgattctgctttgtctctgattggtggcagtgctttttaaaatagatacatattaaatgtttgagccaggcgtggtggctcatgcctgtaatcccagcactttgggaggctgaggcgggcagatcacaaggtcaagagatcgagaccatcctggccaacatggtgaaaccccgtctctactaaaaatacaaaaattagctgggcatggtggtgcgtgcctgtaatcccagctacttgggaggctgaggcaggagaatcgcttgaacccaggaggtggaggttgcagtgagctgagatcacgccattgcactccagcctgggcaacaagaacgaaacgccatctcaattaaaaaaaaaaaaaaagtttgtacctatatacccttttcatacatctcttatttgttactagatctccttgtcaatataaaaacttaattacttaggtatatcctaacaaaacatattccttaaacattcttaaaacagtataatgacttagttttttaattaccgtaatgaagttgtaaaagcccatgtttcttattttaagcagagagtgccttaaaaaggtttaaaatgcatcctgccagttttaaatagcagaatttattgataccatatatatagactgaaaacacatcaaagtctttcaaggttgattatttcttgtgccttccttcttcccacagtaagagagaagataaagataatactgagtaaaccattccatgctacaaattggacccattcgacaaaaatgcaatacttagtagaacatctgatgaccatggtcctattcgtgtttttattttgttttatttttgtttttgtttactgttctctcctctgtccagtattcctgtccagaaattacatttccttaaaagatttcatattcaaaacctgagcattgtatgcaaaataagctatgatgaaaggatgaaactttttaattactgaagagatcaacatgaaaaactctgtagcaagaatgtgtattttatattagatcatacttttcaatccatattgactattttagtaccattatgtaattttaaagtcttttagattttgttaaaattttattaaatccatggaaattgaaagttccttattttaatccttaggagaaaaactataatttttctctaatatatccataaagtgaaagaagaagtacttatttgatattcttaattgttacatatttaagagcaagagtaattagttcatacttatgttcacctaagtccacccatacattgctgaggatagcggccttcagaaggtggctgtttccggaggagtaacagggaggaacaggtgggctgagatatacatgaggcccaggacattccaggcaataactgtctgcctctcctgactctgcccaaacccgaaatgatgctttctagctcacacaaaaatrtatatatatatatcagcaggcagatactcaagctgaaagagacattactggggttcgtttctagatcacagatcctgcctcaggctcactgaagtgaccagcctccacccagtaacaacaaactagtctaaatccagaataaaacaattatacattttaatcttaccaccttctacctgtgtgtgctgtccaccctcaagacagagaatagcccgtattccaccaaccagcaatcactagcctacaacaccaaatccacagtttctttggtatcctttgtgccagggagttgggtgctgaacaatctacctgtaacattcccttgccttcatatcccaaagctctgcaagcaaagaagwgttctggtgggcagctagggccatttgttgtagtccagagraagagagccatccgtatcttctgtgctgtactcatacctatttaatccaatctgctggcaccagtctattatattcaactgtttgcccccactgtaactacataacaaccacctctattacaacagtgattataaggcattatctgagagggtatatccaaactgtaccttgcaaagggacttctatctgcaaagaatactaagaaaacatattatgagaaagtcacaataggtacccagagaagccaatctctaggttaaccaactacttccctgtccatttctccttataaatgtgaaaggagagcctacaatgaagaaatcctggaagggcatctcccagctctgagactctctgatgctatgaattcaagttattctgtccatgactgggtctggaggtcactgtgtaaaatctacgcttctaaataaatgttatgatatctcagcatactataccatacttataacatgtatgcttataacagcatactatwccatatagtatagttcccaagaaaagggaatgtttcttcccccctaaaaaaaggaaaattcccattatctaatatataaaacaaacttttttgatgatttaaagtgactgtgtgttgtgaactgagtagacaaggcaggaaggagtagtgatgttcctgagttcttgctgaattctgacaacgtgccaacactttgatttctctgtcaaaatgggtgggatttgatatctaaaaaagtataccattacatatctaaaagtatattgttacatggaatatggaagccactgatttaattctggaatgtccgtcaacatgacagccacctaaactcctctgaggcattgtaaacggttaggaaaattgacctttctacacactaaatctggcttcagtggctctcctgagctctaagggagttgggcaggggcagcctgagctccggctgtgagcatagctcaactgatgtgtagttagaatgttcatggaaggcccaggcttgctacttcccattcctttattttaaatgatgtagtgagccaggcgtggtggctcatgcctgtaatccccgcactttgggaggccgaggtgggtggatcacttgagcccaggagttcaagaccagcctgggcaacatggtgaaaccctgtctctacaaaaaawacaaaaattagccaggcatgatggtgtgtgcctgtagtttcaggggaggctgaggtgggagaattgcttgagcccaggaggtgggggctgcagtgagctgtgattgcaccactgcactctagcctgggtgacagtgcctacataaataaataaaaagaaagaaagaaatgatgtagtgaaaatatagttacatagcacttatacctagactacttaaagtgacctagtaattaaacttatatagctcatcaaccagcaaagattcctagtgcaccacactcgttatagagcagggaagcatcgctgccaccctcagggattcctcttgcatatctctgtgttctgtcctccacacacccatctctttagtcatctattgattttattcaattttcctggcagtttccccagtgtattttacctgaaaggtatgagaggaaaaaggaaaagcacaactcaaaatggttgactattccattctttgttttcttcaaaaagtgtaaagtcataaagatgccatagaaccactaaattcattgtcctttgtcacctctcagccaataatagtcattgatatactctccataccacaaatttaaagttttttgtgaactgtacatgcaatagccaagtttattttaactttagtcattactggatcccagagattttctttctcttttttggcatatagattatttatgtcacttcagtatgcccagtccacagatgagatcttctgagggactgcttctggagccggccctcttgtgtgattgaattagtcagtgatggttctcaggactagattagattgttactcttaaaataattacttaaaaaaaaaaaaaaaacttccataacttgaaaattttgtggccaggtgtggtggctcacgcctgtaatcccagcactttgggaagccgaggtgggcggatcgcttgaggtcaggagttcaagagcagcctggccaacatggtgaaaccctgtctctactaaaaatacaaaaattagccgggcatggtggcgcacgcctgtaatttcagctactcaggaggctgaggcaggagaattcgcttgaacctgggaggtggaggctgcagtgagccaagatggtacccactgcacttcagcctgggcaacagagcaagactctgtctcaaaaaaaaaaaaaaaaawaaaaaagaaaggagaaaaagaaaagaaaaatttgcatttaagacttatatgaaaatacataatttattttgyagaatgatctagagcaggactgtcattttaactaaagttatttttggccaggtgtggtggcttatgtctgtaatcccagcactttgggaggccgaggcaggtggatcacgaggtcaggagttcaagaccagcctggtcaatatggtaaaaccccatctctactaaaaatacaaaaattagctgggcatggtggtgcattcctgtaatcccagctactcaggaggctgaggcaggataattgcttgaaccaggacgcgggaggcagaggttgcagtgagccaagatggcgccactgcactccagcctggactacagagcgagactctgtctcgaaaaaaaaaaaagttggccaggcacagtggctcacacctgtaatcccagcactttgggaggccaaggcgggtggatcacaaggtcaggagtttgagaccagcctggccaagatggtgaaaccccatctctactaaaaatacaaaaattagctgggcacagtggcgggcgcctgtaatcccagctactcaggaggctgaggcaggacaatcacttgaacctgggaggtggaggttgcagtgagccgagatcgtgcctctgcactctagcctgggtgacagagcaagactctgtctcaaaaaaaaaaaagttattcttagtggatataaaaattggtgtttttggccgggcgtggtggctcatgtctgtaatcccagcactttgggaggccgaggcgggtggatcacgaggtcaagagatggagaccattctggccaacatggtgacacgcacctgtaatcccaggtactcgggaggctgaggcaggagaatcacttgaatctaggaagcggaggctgcagtgagatgagattgcgccactgcactctggcctggcgacagagtaagatgccgtctcaaaaaaaaaaaaaaattggtgttttcttggtttgttttgtgttttagtttaaggagacacatttcctcatcttaaggacttttttgctgctctgatgctggtcatctagtccattcttttgctctaaactgagccttgcctcccagttcttcattgcacttcagattgtgtcttactacaaagagaaaattagtctgtgatcagtttggatcagaagaactgaaawtgtacatttagaatagaagccagggatgtgatgcacacccgtgatcccagctactcaggaggctgagatgggaggatcacttgagcctgggagttagaggctgcagtgagccgagatcgtgccactgcattccggcctgggtgacagaacaagaccctgtctctaaaaaataaaaagaagaaaagaaagaaatttaaagtaggaagggctaccgtttgcttctggccaagcttcacctctaaccataggatcttttaaaagactagttctgaggtcctttactctgagtaggtatttatggaataagccattatgtattgacattagaatcagttaaacataaatttttttctctttttatgcactacttgacatcaaaagcaaaaagaggtaagttggctataaacctgtaggtgaacctaatttttcttagtagatttgttcctgagtagctttgcttcaattaaatttctgtgaatcaaatacttttacattaggaagattgtcattggaaattcttattcttttctttgaaaatgaataagcatcttctgtaaacttagattttcaagatatctagtatttaaacattttgcttttcctttaatcaagttatacttacggtttaatttgcttgtgaagacaaggcattttcaaacacttggtttagttttgagataactgaattgtttctcccaccagaaatgtggattacatgttataagtctttcctattttcttaaaaatgaaaaaaaaagccaagaaacaactgacattggtgaaagtctgtaattttcagatccattgatttacagaagaagatgccctgaacctctcagaatattttmtagtgtgattttttttaatgattaaaaaaaatgaagaaaatattaaacaagaagatcaaacacatttcattgagtggtgtctcatatgtttttcttgtttgggatctatttttataattgatctttttagtggattcttgattgtagtttaacttatttctcttttgtttctttttgatgatgcatcaattctgacatttcaaaggtacagctggtcttcattagatatgtgctgttattgactttgcttaacaagaacagaccatcatcgtaccaccttgagttaactctgtgccagctggccttgctcttgagaaggtcatttctaaacagaaggttattttttgaaagatttttaactggtrtaagaatctggcagcagaatgtacttttacctcttggtgccactgtatttaattaccctctccccatttatcctccatgtctttcctaccataagctattgataacacacatgctcatggtttaattgtaagttgttcagaaatagaaagctgactgtactgcagggcgtttttatatttctcttttgcaagatttgaaataaaaatagatttttgcatgaatattactttgttttatcagctagtcatctgatattcatcaggacagcaaatgggaagatgggtgaaaggttttgtcaaatctataaccactgaaaaatctaaaaatgctccctctctacttagcaaggcatgctctcattctacatcgctgaagacgactttcatgcttgtcactgaagtgtgatgaactatatgcagttgtcatttatgtgaaggaggaaccagatgctttttaagatttgtcaccaggtcttatttttgcattgtctatattgaaattttttgatgtgtttcaacaattccttctttttgttctctggaaatttttaacgaagaatgattgtttctatcaagagtatacgctataatggactttgctgtgttaaagactgatgtaaatatgtctgaagtgtttggtgatataaattagcagatttcacccgataagtcagaaattacactatcatctgtgggtacttttagaataactgatgttttaacaggggatgtaatacgtttggtgaaaagggatgagatagccaactctatgtgtttgattataaaatgctgacagtgcttcacagctctccatttttattcatatcagtgtaccattaaattcatcattagatttttgaaaatagttattttcctagctactgttaatatttatgtaaatgtttctatctcatgctcttcttttatatataatatttctttctcagtttttccttattatttctaaattctctactctatatgtgtgtttttcagtttatttgtttaggaattcataggactgtttaaatgttcaagttgttactacaaggagaatgtattttgatgcttctttccattaacctttctgttaattcactaacattattaatcattttgtagatttagtgaggaataatttactggttatgttatttggcacatcttaaatgatggcaatttaaaaattattttcaagacttatatattaaagtcctacagttaccaaagaagaataattgatcatctgataacactaaattaaccttaaaatctttatcagataatatttatccattcttattccttttgttagaaagatgttgttacaatgacagggatgtctaaattgtaaactctcctttcaagtgaattaattaaacagtgacattgatgatactaataaataaatccaaggattttttttaagggaggtggtttgcaccacataaattccctagcaaagtgttgtggggaattraagaattataaggcagggtcctgcctgctctcaaggagctgcatagtgtggctagagagaatagatatactgcaagggaagcaggggtctagaattctgtaagaaatgccaaaggaagctgggcgcagtggctcacacctgtaatctcagcactttgggaggctgaggcaggcggattgcttgaggtcaggagtatgagactagcctgggcaacacggtgaaactctgtctctactaaaaatacaaaaattagctgggcgtggtagcatgcacgtgtaatcccagctactcgggaggctgaggcataagaatcacttgaacctgggaggtgaagattgcagtgagccgagatggagatcacgccactgcactccagcctgggtgacggagcaagactctgtctcaaaaaaaaaaaagaaatgccgaargagatgagagaagtgctaaaggagtttgcaggaagcagacacctccttttgggatggccagaaataatgactgaaatttgactttgcatagtctgatagacaagagcatttccgatgaatataatgatagcttgttgaaatgaatttctcctatgatccattttgacctttcttatttccttgttgttaatagcatttactttgtttctcgaagctgaaaaccttaagggccttcgactcctccctttcctttgtccatcatgtctaattgatggactcagagctgcatgctttcacaaacattctctcacctgatcttcacgtgaaccctgcaagattggtatttaatgttctcacttaaacggatagaaaaactgaggctaagaacagttaagtcacttcttcagtgtccctagctactggttgttggaactggtatctaaaagagagacagagatctttctgatggactctaaatttcatgctgaaatggagaagagctgaagagcacagaggagagagaatagagaataaagagggccaggcgcggtggctcatgcctgtaatcccagcgctttgggaggctgaggcgagcggatcgtttgagtgcaggagttcaagagcagccttggcaacatggcaaaaccctgtctctacaaaagttttaaaaaattagctgggcgtagtggcactggggaggctgaggtgggaggatcgcctgaacccgggaagcagaggttgcaatgagccgagagcacactactgcactccagcctgggtgacagagtgagactccatctcaaaaaaaaaagaaagaagaaagctgagatgccataggaaatggctgcagaagcatcattggcaaatgcaaggaaattattgtgatgtaccctcacttaagactccagtgcatctaagtgtgttagtaactgattatggagagcacctttgtgctattatcagaattcctgggtgtgggaaacttytataactgtgcaacttttctatctccacgtcagtgcacagtatatggacatttatattttctactaacacaactgacattccactcccgtcagtttagtttcccccagtaccactgttttgaccactttcacacttctgtctatagtgcttttgctaagaaggaatctgctaaattcgaatgcagattctcctgcttttttttttttttttttgatggagtttcgctcttgttgcccaagctggagtgtgatggcgcgatctcggctcattgcaacctccaccccccgggttcaagcaattcttctgcctcagcctcctgagtagctgggattacaggcgcacgccaccacgcccggataattttttgtatttttagtagaaatggggtttcaccatgttggccaggctggtctcgaactcctgacctcaggtggtccacccaccttggcctcctaaagtgctgggattacaggcatgagcaaccacacccagccccagattatccttcttaatttgtgcttcttgcctttcgtatatatctttttcattttgagtttccttgaattaaaactttttaattcaactcttggattgcttarttttgaataatttgagagaatttgggctgttcttggtttatttagactgaagaagtactctcggcagagtaagaaggagcactaactgcttctactttggagcaagtatcaaaggctgtgttagtctgctggggcttccatcaygaatgaccacagactggatgccttaaacaacagaagttaattttctcacagttctggaggcccgaagttcaaaatcaaggtgtccgcaggtctgttttctcctgaggtctccgtccttggattgcagaaggccaccttctcactgtcctcgcatctctgtgcactgcatccctggtgtctctctgcatgtattaatcctctcttctttacaaggacaccaatcagattggattagggccaactctaacagtgtcactttaatttagtcacctcttgtaaaggtcctgtcttcaaatacagttgcattctaaggttctgagagttagggcttcaatatatgaatttaggggaacacaattcagtctataacatcatgggccattccactgaaagggcgtgggtggacagtcagaaacctgggcacaagttctcactctgccactctctccatgggccctaagaaaatcacttaacccttctgatcctcagtgttctaatctgtaaaatgggcattatgactaccaatctcagttgagtttggtttgtttgtttgtttttgagacagagtctcgctctgttgctcaggctggagtgcagtggtgtgatctcagctcactgcaacctccacctcccgggttcaagagttctcatggctcagcttcccaagtagctgggactacaggcacgccctaccatgcccagctaatttttgttaatttagtagagatgagttttcaccatgttggccaggctggtcttgaactcctgaactgaagctatctgccagcctcagtttcccaaagtgctgggattacaggcatgagccactgcgcctggactcacttgagttttctaggcactaaaaagcttttgttcattataaaagccatacagaggccaggcacagtggctcacgcctgtaatcccagcactttgggaggctgaggcaggcggatcacgaggtcaagagatggagaccatcctggccaacatggcgaaaccccgtctctactaaaaatacaaaagttaactgggcgtggtggtgcatgcctgtagtcccagctacttaggaggctgaggcaggagaatcacttgaacccgggaggcggaggttgcagtgagccgagattgcaccactgcactccagcctggcgacagagtgagactccacctcagaaaaaaaagtaatacagaaagtgaccttgcataaacttagtttctcatttctaaacaaaaataaaatgtatctcatagagtttttacaaggattcaagagcttttgcatgcaaattgtctgcaaatatatatatatagcactttttataagcattacatattaccattatttctcatccttctttcttctacatttcttctgcccgctcttccttttctgtcattgcctaaaatccctattaatgaatagtttgaaagaacatggccaggtttgcagaaagaagaaagagagatatccttttccctcccataaggactaaaagaggatgtctctgtgctttgatcattaaccatggcgtgttgattttaggacaatctataactctctgtcaatttcctacttaacagctttcaaaattaaatgttcttgcttttctactaactgttaatcatctgttcttattgaaaggtctttaatgaatattgactgtttactccaagtttataagatttttggtctaaagtggttgtcttagtccattttctgttccttataacagaatacttgaaactgggtgatttataaagaaaaggaatttgtcatttgcagttatggaggctgagaagtccaaggtcacggtgagagccttcttgctggtggggactctgcagagtcccaaagtggtgcagggcatcacatggcaagggggctgtacatgctaagtcaggtctgtcttcctcttatagagccaccaatttcactcccatcataacccatgaatccattaacccatgaatccattaatccatgaatggatttatccattcatgagagcagacctttatgatscaatcacctcttaaaaagttccacctttcaatactgccacattggagattaagtatcaacatgaattttggaggggatattcaaaccatagcagtggtatctatttaaatctatttactttcaaatagataatagcagcatgttctatgatagcaattgttcaaagaaatttattaaaccttttttatagacagtcttgggaagaatacagcaagttagcaaagataataactaagagtctcatcaagaggcgtgtgtgttccttatatcatcaacttccatttctcctgcctatttttaaggatatgagtatgtgggctgggcgcaatggctcacacctgtaatcccagcactttgggaggccgaggcaggcagatcacgaggtcaggggatcgagaccatcctggctaacacggtgaaaccccgtctctactaaaaatacaaaaaattagccaggcgtggtggtgggtgcctgtagtcccagctactcgggaggctgaggcaggagaatggtgtgaacccaggagggggagcttgccgagatcacaccactgcactccagcctgtgcgacagagtgagactccatctcaaaaaaaaaaaagaatatatgagttgcccattttcaaaacaggaaaggaaaagaagaaagcacacgtccctttttttctcacttgttgaaggaaagagactgaaaaatcatgaacttatgaaagatagaggaagaggtgcctaaggagaaagagaatatttaagtaagaggattaatacctatatatgtcagaagaagaaatgtagaaatatagtttttacacggtggaaaagaaaagtttctctaaactgtagaccaacaaactttgcctcatcctcggcaaatttctggaaatggatgaattacaaatgctctctatagaatggggattgttaaaagccagtgtgagttcatcaagaatgacttgaactggactacccacattctctatctcataagaccagggaaatggtaaaataatgtgtctgaacttgggcaagcaattaaccaggcatttttttttaatattcttgagacaaatagagaaatcaattctagaggataatataattgtgtagactcataactaattgaatgatatgtgcaaagggtccaaattcattgacttatatttatgaaatatggtcttcacttagcctgaccttattattaattgctaatcttacataaagctatcgaggtcatgattctcatattttctgatttaagagagaaataaatgctaaatgayggaataggatccaaaatattcatcagataggaagaggcgaaatatttcacatgtattttaaacataaagtttaaatggatatgaawtattgtgctggaattccaagcactgtaagatggaggaaaaatgactttatagcactacctgtaaacaaagctcaatggaaatagcagtgtgatgtggctgcccaaaaatgccatgaggtttctgctgttttaataggactgggatgtctcagataagacaagacagtgccactgtactcttcactgggcatatcttaccacacatgatttcctttcttatcacctcrtttttagaaggatgtgcacaaaccggaacaaggtcagagagcaaggagacgagtgagggaaattgacatcaygtcttaaaaggaagaaatggggttgggcctgatggctcacacctataattccagcactttcagaggccggggcgggtagatcatttgaggccaggagttcgagaccagcctggccatggtgaaaccccatctccacyaaacatacaaaaattagccaggcatggcagcacatgcctgtaatcccagctactctggaggctgtaacacaagagtcacttaaacctgggaagtggagtttgcaatgagccaagatcacgtcacttcactccagcctgggcaacagagcgagactccatctcaaaaaaaaaaaaaaaagaaagaaagataagaaaaaaaggaagaacttggatacttggcctgaggagaactcagaggacagagatagttttcatgggaacacgtggagcatccggaggttgtttatggtcatgagggaaagagatgtggtgtggaaaatacgatcttgtgaaaaagtagggatgcattagttctcaagtcaggaaaatgaggaggtggagtcaagcgatgctacaggagactgtttgccacaaagagttgctgctgtgcctgccccagagcacttgggcccaaagaagccacctctgcagcctcactactcatcgtggctgggtttggtctccacagatgggctttcactcacatggtgctcaccagtgcccactgctgccatctgggccaggtgtggagccaaaacatagaagtgttccttgtctcctacatgagctgttccttcccatcccaaacagccaccagtgggctcctggactccctaaggcattgacttttagaaaattgggtagtttggctgggcgcagtggctcacgcctataatcccagcactttgggaggccgaggcaggcagatcacctgaggtcaggagtttgagaccagcctggccaacatggcgataccccatctctactaaaattataaaaattggccgggcrtggtggtgcatgcctgtaatcccagctacttgggaggctgaggcaggagaattgcttgaacccgcgaggcggaggttgcagtgagctgagatcatgccattgcactccagcctgggcaacaagagcgaaactctgtctcaaagaaaaaaaaagaaaattggttagttttctaaattgcattgaaaattttataaataatagaagcccgagagaaagccacacagcaaaactttctctctctgccaatgaaatgtattattttcagccacctctttttaaaaacaatattatcttcattcctgtacccttcattttgctttgtatttttgagagcgctggttgccttaaaatcagtatctcaaatctctggcaaagttccttctgtttctttgactctatgaccctgatattttctagaggtagctggtgtcaatttgagaagcatccagaggagtgaatagaaaagaggccttagcattaaaaagactaaatttaaatccttgttccgccacttcctaactgtgtgaccttgggcaagttaatacacatgctgagcttggattaatcartggaggcttgtaggacacctactgtgatggcaaattctgtgtttgtttctagcaggagagattttaaaaagaagttaaagaaaaaaatatgtgagactatgatattctcccatattatcaaaaacacttattttcctcaatgtaggaatagtgcaagcctgtcgacccagctattttagaggctgaagtgggagcatcacatgagcccaggagttcaagaccaggctttaagagaccctgtctcttaaaacagataacaaatgtaaagtttataggaaagattacatcatgttgattcagcaaatattttcctctcttatttctccctttcttttctatcttcccttctacgtgaggcccttgtttatggaggaatgtcatacaagggtactcttcttgtgcatatcgagacagacctatagatgctttgagctataatattccatattcatccctgccctggaggcattagtaatctcttgagccaggcacagtgtacacacttgtagtcccatctactcaggagattgaggcaggaggattacttgaactcactgcattacagcctgagcgacatagcaagacctggcctctaaaaaaaatacataaataatctcttgagtatgctatgacatttcccaagcctgtggccttatcatataaacgtacagcattttctaattccattctgatcatttcaaataaacactttaattttatgataaaatgtcttattactgttactaaagaccataaaaagtttgtagttacaaagaagttatttgactaactcattatgttagatgtcagcctagatatcacaacctccaggaagcactccctaaccacttagatttagttgtgtttggttagttagatttagttatgtttgattagttagattcagtctaatttaatttaattaacttccgctgtgaggtcctgtaacaccctacactttccctatcataggaggcaatacagtgatacttctgcaagttcagctcagcccttggaccatacaatcctggattcaaattgcacctctacctcctagtggagtttgtcaagttacttaacctaagttcccctttccttatagatgaagtgagattaataaaacagggttatagaagagcatgtatattaagtgcctatacagtgcctgagacatcgtaaacaataaataagtactagatgctgtcatcatcaccatcaccatcaccaccatcatcaccatcaccatcacacttcaatgtagttgcttaytaaatatgcttatcttccttgataaaacagagaccacattttctctgttcacctttttccccctgctgcctaacacagtttctgacacaaaataggagtttagtaacttgactgttgaatggtttagacaaaccctggtggccaaacaacagcaatggctttgtgggttctacaatgcctgctccttcatgcacatagttgtcatcttttattccccccaaagcaacgagatgtggtctagttccttcaagggtgagcctagcagaatagatcctagacggagcaggggagatcactcagagcctgcagcatctcagagctacaagggacttcctcagcctcccaacctacctccttcattttacaaagtacatcctaagacacatccgtggctcagccaggctacaattgacacaactggagggctgtagacccgagaagagggatttagaagacaactgagtcagagcaatgtagctacattttagtttaattttttaagtccatcaccattttatctatgaaatttgttttttattctttaaggataacacgtagctaagtgcttataaataataaatgaaaaataatcatcattagcttggctaggagcagtggctcacacctacaatccccacatcttgggaggccgaggcaggaagactgcttgaggcccggagttcaagaccagcctaggcaaaatagctagaacctgtctctacaaaaatttaaaaaattagcagggtgtggtggtgtgtgcctgtggtcccagctactcaagaggctgargcaggaggatcacttgagcccaggcgttggatgctgaagtgagctatgatagscacctaggcaacagcatgacatcctgtctcaaaaactaaataaataggccgagtgcagtggctcacacctgtaatcccagcactctgagaggccaaggtgggtggatcacccraagtcaggagttagagaccagcctggttaacayggtgaaaccccgtctctactaaaaatacaaacaattagctgggcgtggtggcgcacgcttgtaatcccaactactcgggaggctgaggcaggagaattgcatgaacccaggaggcggagattgcagtgagccgagattgtgccattgcactccagcctgggcaacaagagcaaaactcttgtctcaaaaataaaataaaataaaaaataaatattagccagagatgatgttacttctaatgaaggaaaaagtgatattcactacaaataagaagaatgtctaccacctctctagcatttcattaagggagtacactgtggttctgatcacctgctgtctgaattttaccataaattatattttgaatgaataataatctgtgactgtattggcaaaacaaagtcaaatatatgagatatttttaaaagatgtaagccattttaatactctagttactctaattctaaggatcgctattccacagaggccactactctgctttagaagagtttcattatacctccctggcaatgtaagacataaggaatccagagtggtttttacatccattgcatttacccaaatacaccatcggagggcagcacacacctggttgacttaactgcctgtctggtggccttatcaaaatagttgtcaaattagtctaagacattcctaaattaccactcagataggcaggaaagctgttggagaagacaaaaggagcaaagatttttaaaagacaaaagaatgcattccttaagactctgagtttctacaaaagggaatctggagctaatcaatgctgcaaaatgggaaaacggagttaaaaaaggaatttcctcaatctgagaaaacagatttgttatatttgaaagatttttactgagtatgatcatccgaacaccagctactaaacaaaaatcagatctccttgttcctattaagatgcgctaattaataagatggcaacaaagaccaccatataaaagggttccttcagtaatgttttcttgagtgaacaaaaatcaagcctgccttatattgtattctactttgcatcacaaacagttttagtgtatttctggaaaagcatcagcagttttttcgaattttaaattctggagttatgtaactatataggcaggcttttttataacagaatataacagtgatacttaaatagaagacttcaaatgtaaatatcagtagagcctcgttaaggctataaatccagactttgtgataatgtggattaaatattatttacataacatataaggaggccgggtgcagtggctcacgcctgtaatcccagcactttgggaggccgaggcaggtggatcacctgaggtcaggagttcaagaccagcctgaccaatatggtgaaaccctgtctctactaaaaatacaaaattagccgggtgtggtggcacatgcctgtaatccctgctccttgggaggctgaggcaggagaatcacctcgggaggctgaggcaggagaatcgcctgaacccaggaggcggaggttgcagtgagctgagattgcaccattgcactccagcctgggcaacaagagcaaaactctgtctcaaataaacaaacaaacaaacacatataaggaaagggatttgctaagcaaatacagtctaagcagttggcaagaggaaatgcttcaattatttaagaataatttttaagtttaattccaattttaacttgtttgcaaaaatctttttggagaaatatgacgtatatgcatttctaaccagcttcttgcatgattctaatatagtcacctagtaccagtaaacagactgctctttgatttttttttagaacaccaggcactactttcttggagtagatgattaacccagctaaagcttgatttttactagctagcactttattaacctagtgtgttatattgtgactttaaaatggtaaaaacaattayaaagtggagttctcattcaggttagctttctagtccaagtcactaacaatttactatgtaatagacattctaagatttctgccaacaattctattgtcaatatataaaatcaattttcagaaaactgtaaagattatttccttgtttaattaagattctactaatcatagaaaagattatattgcacacttttctcaagttacctatgggactgacaatatgtccatgtgtcctgatagtaaagtcagttatctgaatgcgttccattttggaataagagatctaagtgctaagcaagtaaccaccaccacattcaggtttagaattggaagatctttcattatattaatagaccctttatttttagatataacaaaataccaaagacaaatggccacatatatcctaatgtacttgagaaatctcgctactaatgctgtgtcactaattttttaatactgtatttaagaaaaaaaaaaagcctgtcttttctattggcatcattcaagaagaaaaaaaaaaagctgaatcaggatatttctgtgtgaatgcacattcctcactaaatctctcaggcagctgctttagtcactgttactaacaccttgctctgtcatctctttgtacacatgtctaatttatcagtttcttgtagattgtcagcagcctgctgcctccgtaccgccacagtgctcacaactagccgggaggcaagactgcccaactgtcaggtaaattcagatgtcctttcccttccacccagctgcatgtcagatccatagaccccagctcccctttccgacacctgaactgcctacgcatcattgtattttgctgtattttatttcaagtgtgggctacatagacacacattggacacctgcagtccctgcgttcccagtaggaatacaagagagctggggtttattttgctggctgccagctggtagactctacaggctgccttcagcccctttgtctgtgtaaatacttggattagtccactgtttcattcctttccaaaaaataaaagctggaattgttatgatgtttgtcctactttttattttcttttgtctttaaaatatatttattttcctgsggaatctgagggataccaatatactaattgacctgatttgattcctgtactttatatgtattaaaacatcactatatactccatgaatatgtacaattattatttgtcaatttaaaaaaataaaatccccgctactcaggaggctgaggtaggaggatcaatcgcttgagcctgggagttcaaggctgcagcgagctatgataccactgcacacctgcctggtgagtaagaacctgttgctaaaaaacaaaacaaaacaaaaaacacagtaaaataaaacttaaagtgtttaaataggccaggcatgatggctcacacccgtaatcccagcactgtggaaggccgaggcagagggattacctgaggtcaggagtttgagaccagcctgggcaacatggtgaaaccccgtctctactaaaaatacaaaaattagctgggtgtggtggcacatgcctctaatcccacctactcaggaggctgaggcaggagaatcacttgaacccaggaggtggaggttgcagtgagctgagctggtgccactgcactccagcctaggtgacagagagagattccatctaaaaaaaaataaaaaattaaaaaatatatatctcaggccaacaaacaggaagaatataaagaattagatataaaggctgggtgcagtggctcatgctggtaatctcagcactttgggaggctgaggcaggaggattgcttgagtccatgaatttgtggttacagtgagtaaaatcacatcamtgcactccagcctgggtaacagagcaagaccctgtctctagataaatagatagatagacagacagatagaacagctgtataaaagtgtttctgtgtttctgttctctgtccactcagtagccttggtaaaactgaatttgaaaggtggagaaaaacattgtagttagcattcaaaagataatatttgctgtgacagtgacctttatgtgagattacttgaaaaattgttaaaacaggtttgcacagtcctgaacactgaactggagagtttgctgacaattccgattccaaaggaaagctttccaaatcagtcatgaattgccctccatcctggtgaacctccacacagcrtctcagcgttccatcaggacctcacctccatcctggaatgcttcatctccagccacctggcctctgatggtgccagacctcagtagtcyggttgtggttttcatcatctgctcagtgttctctccttatcacagctgttgcccttctaccaggggaaggcttcttttgagcaggggcaggcccaaacactttccatgtgtgtctgaggagtagatgtcagtagcaagctacatgtggtcaggggtcagagccaggggacctggggtgccacaagtgtggaaacacagtggcagctgaagcccaagtgtcacatggtctcagaggcggttgtgcagccagctgtatcagtggaacattgagttagcacagaaaggtacattattggccaggtgtggtggcttacgcctgtaatcccagcagtttgggaggctgaggcgggaggatggcttgaacccagaacttcaagaccagcctggggaacacagggagacctccacccccgacctctaccaaatttttttttttttaaattagccaggtataatggcacatggctgtagtcccagctatttgggaagctgaggttggagggtcacttgagctcgggaggtcaagactgyagcaagctgtgattgcatcactgcactccagcctgggtaacagagtgagaccctgtctcaaaaaacaaataaataaataaaaagaaaaatacattataaaataggttgctagccagcagtttccaattggtgtgtgttagttgattgttcccaccaccttcagcaacagggctttaagaaaggtttttcgctaatgccattttacaacagcactaatttcggttagaaataataatgataggtcaggcgtggtggcgcaggcctgtaatcccagcactttgggaggccaaggccggtggatcacraggtcaagagatcgagaccaccttggccaacatggtgaaaccccgtctctactaaaaatacaaaaattagctgggcatggtgatgtgcgcctgtaatctcaggttctcgggaggctgaggcaggagaatcacttgaacctgggaggcggaggttgcagtgagctgagatcacgccactgcattacmgcctggcgacagagcaaaaaagaaaaaaaaaaaagaaataatgtaattatagatttatctcaattatataagtaacaatataaatattcaaactcgtctcagtgggattctgaatttgtagcggttaagaacagggctcttcacctacagtccattctccaccaagcacccccagcccttaccscaaggcctgggtcagtgctgggcacatgacagctgtgcactaaatattgattatacctgagagagtgaatgagctctggaatcagattgcttgggttgaattcccacttctaatacccactggttgtttaactttgraaaatttcttttgctggctaagattccatttcttcacttgtaaagttcagatgacaatagatactgagggaattcagcgaggcacgctcctggcttggagtgtctgctcagtatctgttatcaatacttttttagtatcttaccattcctcaagacaaagatctgcaatctcttaacctctctaatttgctgaagaaagcgtggagcgggctgctgttttgtttgcttcagagattgggtctggctatgttgcccaaactggacttgaaccctgggctcgagcaaccttcctgcctcagaagactactgcttgaagtgtttccattaagtaggaaatggaaaggctggcaggagatttttttaacttttttttttccaccttgcttgttttttgagaaccagtttgactaaacaattatgtagtctagttccatctgttctgagattaataaatttaggttgcttactactaccacagggatgatttactttaaagaaaagcaatttaatgaattacaaacatttccagcttctcaaatgtttccagtttctacccacatgaatacagcctggtctagagcccaattctactactgttccccatcgtggtctacgtaaagaaatgattaaatgcatatagatctgaaaagactcttttccaaaattgctgggatgatgactgactcttttcccacccatacacactgccaaatgggtcaatgttaataccttcattgccctttttactccttcttggcagaaaagttaacacatagccaacattcgaattcttagtataaaccagacaagggttcatttctttacacatattaaacattacagccttccataagggataagcacagttattacacccatttttgttgttgtttttgtttgtttggtttagttttttggcgtttttttgtttgtttttgtttttgtttgagacagagtctccctctgttgcccaggctggagtgcagtggcgtgatcttggctcactggcacctccacctcctgggttcaagcaattcttctgcctcagccacccgagtagctgggattacaggtgtstgccaccacacccagctaatttttgtatttttagtagagacagggtttcaccatgttggccaggctgcccttgaactcctgacctccagtgatctgcctgcctcagcctcctaaagtactggggttacaagcatgagccaccacacctggtcttacacccatttttatgtgacgaaattgaggtttgggaaggtaaaatgacttgttcaaggtcacatatcctgaacacaactgagcctagtgactcctacctaccaccacaggtggctgcactgcagaggagaaatctatttcagttacactgtgaggagcaaagtcagagtatgtaaatcacccaccatgattccttttccctcaaactgaagaggaatgtttgtttaatgagaaacagaagatgtgctaagaatgttgagttatttcacatcaggtgttctgtttctcattttgaaaaatgattttgagtgctgggcccagtggctcatgcctgtaatcccagcactttgggaggccaaggtgggcagatcacctgaggtcaggagttcgagaccagcctggccaatatggtgaaacggcatctctactaaaaatacagaaattagccaggcatggtggcaggcacctgtaatcccagctcctcaggaggctgaggcaggagaatcacttggaacagggaggcggaggttgcagtgaaccaagatcacgcttggacaactccagcttgggcaacagagtgagactccatcttaaaaaaaaaattattttgtacttccctcggtttatacatatattcaaacagcttttaaggtgaatgattttttaataaaagagcattttctcacctttaacaatgtagaacttttcagccggacatggtgactcacctctgtagtcccagcactttggaaggctgaggtgggaagattgcttgagcccaggatttctagatcagcctaggcaacttggtgaaaccctgtcctttaaaacaaaatacaagaattaggcatggtggcctgcatctgtagtcccagctactcaggaggctgcggtgggaggatcgtttcagcctaggagttcaaggcagcagtgagccgagattgtgccactgcgctccggcctgggtggcagaagaggaccctgtctccaaaaacagaaaaaaagtagaacttttccatgtatactttttacaggctaattccattgtagagctaaattatcaaaattgtttatagataataggtattataatatgaaaggaatgcccaaggtatatagccttggatataatattgaaatatatagagttgtttggtatttagcacttcccttctatcaagtagttttctacttgggaaaaaaaaagaaacttcctgaagatgtatccaattttatatcttagtaacagcttcctaaacttgccatttacaacatgatctacctatgtaaagtaaaatcaatggtaaatgttgaataacaagtggactcttgaaaatatttagcaatcacaactgaaactgaattcattctatgccttaaatgattataatttatcaaatatttatatccaagaaatagtatcttaacctgtaagccaagaatgtgtgtcttacaggttaatttacacataatatacaccatgtgattgcagcattttatgcaaattaaaaatattaatactatagataataactttatgtaagaaatctatctaaaggaatgaaaaaaatttaaatcatcacgaatgatgtaatgtcaaggtgttaggcaaagtgagttgtaacccatatttaagctatagctacacacttcagctggtcaggaagaaatatttgtcttcctttwtcaaaaagagtattggggccaggtgcagcggctcacgcctgtaatcccaacactttgggaggcygaggcgggtggatcacaaggtcaggagwtcragactgtcatggctaacacagtgaaaccccgtctctactaaaaaaaaaaaaatacaaaaaattagccaggtgttgtggcatgtgcctgtagtcccagctactcgggaggctgagacaggagaatcacttgaacccggaaggtggaggtggcagtgagccaagatygcgccagtgcactccaggctgggcgacagtttgagactgtctcaaaaaaaaaaaaaagtaytggattacacaaggtcttcaaaaacatatctttcttgggtggacacagtggctcatgcctgtaatccttgcgctttgggaagcagaggcaggctgatcacttgaggtcaggagttcgagaccagcctgggcaacatggtgaaactctgtctctactaaaaatacaaaaattagccaggtgtggtggcgcaggcctgtaatcccagctactcaggaggctgaggcactagaattgcttgaacctgggaggcagaggttgcagtgagctgggatcgtgccactgcactccagcctgggygacaaagtgagattctgctcaaaaaaaaaaagaaaagaaaagaaaagaaaaaaaagccatatctttcttgtgtaatgtgacgattctgcattacttgccataaatcacattgcataatatgtttagttccctaaaaagaaattagttctggtgctgacttccacagcacgtatagtaaaattggagttttttttactatatgtgctgtggaagtcagcagtctaagtcatgcatatttgcagaaaaactgttaggtcgatgggaaagtctggcctataacctgctgtttaccaggccgtcaaactctgtttggagggtcaagtgtgaatcttgccatacattattttctgttttaaatattttcttttctttcttcttttttttttttttttgagacggagttttgctcttgttacccaggctggagtgcaatggcgtgatctcagctcaccgcaacgtctgcctcccgggttcaagcgattctcctgcctcagcctcctgagtagctgggattacaggcatgtgccaccacgcccggctaatttttttttttttttttttttttgtatttttagtagagacagggtttctccatgttggtcaggatggtcttgaactcccaaccacaggtgatccgcctgcctcggcctcccaaagtgctgggattgcaggcgtgagccactatgcttggcctaagattttcttcatttattttcctttttttttttttttttttttttttgagacggagtctcgctctgtcgtccaggctggagtgcaatggcgcgatctcggctcactgcaagctccgcctcccgggttcacgccattctcctacctcagcctccggagtagctgggactacaggcgcccgccaccacgcccagctaatttttttttttaattatttttagtagagacggggtttcaccatgttggccaggatggtctctatctcctgagctcatgatccgcccgccttggcctcctgaagtgctgggattacaggcgtgcgccaccgcgcccaggcttattttccaatttataaatgaggccgggcacggtggctcgtgtgtgtaatctcagcactttgagaggccgaggygggcagatcacttgaagtcaggagttcgagaccagcctggccaaaatggtgaaagtccgtctctactaaaaatacaaaaaattagccggacgcggtggtgggcccttgtaatcccagctactcgggaggctgaagcaggagaattgcttgaacccaggaggcagaggttgcagtgagccgagatcgtgccactgcactcctgcctgggcgacagtgagattccatatcaaaaaaatttacaaatgaaactatgcactattttcttaggctttttgttgaaggtccagttctcccatgtttacataccacattttaaaaataggtaggaaaaacaatttttatcactgcttgtcttaaccagtacagaacagcaaagcttcttttaaactatatttacagcacttcaaagagtttgggaagaaagaataacctcaagccagtcagatattttccataattatgattttgtattaaaatgcaagagatataggtagaggataatttcagtaccaaagataaaaattatttaatactaattttaatgactccattacattttaaactccattaaatttaaagctaattttaattagctttaaaaagctatgcttaaattaatagtaataatgagccttgaattgttctctcaaacatcacttctggtagaaatgaattatatagtactgactttcatagtttaagggaatataacagagttttagaaaaatactcttttctaattaaaaaaacaaatctccatgttgtgattcccccattgctagtcacattttttttttttttttgagacggagtctcgccctgttgccaaactggagtacagtggcgccatcttggctcgctgcaacctctgcctcccatgttcaagtgattctcctgcctcagcctcccgaatagctgggactacaggcacacgccaccatacccagctaattttttttttgtatttttagtagagacagggtttcaccatgttggccaggatggtctcaatctcttgacctcataatcctcctgccttggcctcccaaagtgctgggattacaggtgtgagccaccgcgcccggccgctagtcaaattttaaaaggcccaaacccaaatgtgttttgtcattttaccctaggaaactcaatgattttgcttctttattcttcaagattattcatccagaccctgataggcctgagcacaggttcatttaaactagaggctatcacaggcgtcgtttggaaagttacattatacacttaacaaatgggaaatgttaggctgggctcggtggctcacgcctgtaatcccaacacttggggaggccgaggcaggtggatcaccagaggtcaggagttcgagaccagcctggccaacatagcaaaaccccatcactactgaaaatacaaaaattggcagggcatggtagtgcatgcatgtaatcccagctgctcgggaggctgaggcaggagaatcgcttgaactcgggaggcggaggctgcagtgagctgagatggagccactgcacaccagcctgggcaaaacaacgagactccatctaaaaaaaaaaggggggggggtgaaatataaaactcttccttatacctccaagcccaagcaggtagggggaattcttagagcaaattagacttccacaggcaaattctttatcctagtgaatctggatctaccagataactatagaatcctctaaactccaaagccttggtcaacctgtcagtaccatcagcatcactgggagctcattaaaaatgtagaatctcagatctcaccccacacctaatgaatccgaatctgccctttatactgagctccccaggtaatttgcatgcatattaaagtttgaaaagaactgatctcatgaaatcttacagctaacacagagacctaggagaacaagaccgtgcaaaaattgagaagaacttctgtaaaatgctgggggcaagaaaatagggaaaacaagaaaagagaagagtgactttgagggaagagtkcatatatcatttccttaatacatttcatttttcttttttatgccttgttttgaaaagctaccattatcttggcatgctttagatggaaaccatttactgtgcagatttctgttcttgttctcaaaatstatgcaaaaatatctcgtctaacccctaccattgtgcctggccctttgaaatgtgtttcttgctgacgtgcttgtttctcctttccagtcctgacacagctctccctgaggagcagccacattccagctcccagtgcgcccctctccactgtctctccaagcctcctcacccctagtcttcatctcctgtggacraacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaaraaaaaagaaacagaaaacgtgtctcagatggctggctttacctcgatagcataagagagacctaagacatgtaaaatacgtatattgcagtatcatctttcctcacactccaaattcagctagggaagttgattccaatatgtttgtcattgatatttattttgtactttatttgctacatgatttatgtctatacaaataatttctctgaggtgaatttaattcatttattttcaaataagcataatttgctcaattaagtatgagtttgaatttagtttgaaatctggaattggccagactgtggtcatttttcttgcacaaaatgataaatgaggtgcatcagaatgttaacaataactgtattttgctgctacgctggtattgtttakgcacttactttctaatcagtagctcattaactgctgggttttgtttttgtatttttaactagagttcttcactggacattactaagtaaatctaagaaagagactaagttatgatttattgacttattcaagttttgatggcatctttacttttattttttcattgcagttgagtagatgtactggtgctgctcctttgtatgtgtgtatgtgtgtgataacgttaaagaaggctcartaacttgaagggaaaaaaatggtgtgtttatttaatgaccagaattttttttacttctcccaaaatcagggtcctactgagtctttcctgataaaaggtatcaagtacaaatgggaaaatatatacatatatagatgtaagatagcctttaattaattaatttacccagagagtgttcaaagtttgattaaaattgtatgttttgttgttgttagtttttttcataacgaatcttccttgccaaaaaaacaatagataataaaccttagctcattgtctacttttgacaaacactcaggtgcctacaaacattctattatcttgagataatacatgttcctggttaatttacagattctgctgggtaacttttatgacttgatttaaggcagtggattttcatagcaaaatttattttgcacataatctgacaaacaaggaaaacagctaactgagctgaaaggtctaacactctcgggctccttaaccatcaagtgctgcccacacaattgctcctagccctgattccttgtctttgtcaggtagccttaacttatttaaaaccataagggtttgaccttttcatataaagacatctgtaacttctcttcaaaacaaaaatgaccctcactgttaacacaaaggacagttaccagtgtagggcactgagaaaggagatccaggagccactcagcttattgagcggacatgggtggcacagaaatggagtggtccatcagagaccaaatggtaagtcgtaaagcacattgcaggagctttcgttagtcatacgcctattaagtagtggtcgctattaccaaagcaaccaggacgttttgtgttctttatatgagtgctattttccacagtgtcatttattatgcaacgtggagtaaagagttgaaatcttcaccaaaataagggttcaggttaaagtacagaaacagaaacaaaacgattcgacatgaagttcccaaccatagcagcctaaccttctgctcttttctacctgcatggccttgctgttcctaaacattgtcttcatttcactggcgttgtatctgcctagtaccagtattagtgagactgtggattttatcagagttcaatgaaagaaagcttacccctgccctcactttgtgttttttatttttccccctttctcaagcaccacgtatttggacctgagaagtggcatagctgctaagttgacttttaataaaaaactgtttgtgcctgagggaaatatatgcctttttaaaaagtacctcagaacatgttcstagatcgtctcatcggttttgtttggtgggactgggagttcagcaggaagtattgtctgtgtgtgatgacggggcagtattgccagtcggcaatgttgtatttgcattctttatccctaactctgaatctaggactccatgaaaagccgggtcacccacaaaacatttcttccaatacaaagtgtattattacgtctattataaactagtttcatttcagttatttatcttcatagagtgggaaagtctttttctgaaatactaattctatgaaaataataattttagtgaatctttgccaagaagttatagaaacttggaaataaatttctcattttcagcacaaaattaagtgatagtccctaagcagtaagagagaataccatgtatttacactgtggcatcatttagtatagtttacactgagccatatttatttataggcatttaaagtgaatcagtatgtgtagtgttgataaaaatcagtatctgtaaagataacatcaggaattcaaaaggaaattgaaaaggggcagaactagtgagaaccaaaaagaatgaactccagtaagactaattgaagacatacttggagaggaaaaataaacagcagaaatgcactaaaaaatactggctaattattgcaaacagagtgagcaaagattaatgctaactagtaaaagtagttagcaaagtaaacaggtagttttttaaaagtaagcacaattacaatattgaatagtatggagaaatgcttttctcctgaggattttccttaatcaaaaaataagaagaagcaataaattgtctttggcctgagtgctgagtggcataaataaaggagcttggcttaatctttctggtccacacataatccattagatcccattcatatatccaactctggattctaataaaataatttggagaactttgagaaaaaggaaaactgttaaataagaaaagacctatttagaaattatactttagtctaacraagaggaggtacaatagtagtcttcaagaaaagaatatttaacaaatgatagatatcagctatagatattgttactaagtctagaataaaaaaggcttcagtgtgaaggatgtatagtaactctaggaaagagatttttaacactgggaaattaacgtggaaattgataatcataaagaatatttgttttgtaaaaattgaatatcattggtggtctagtaagtattaagtggcaagataggagaatgcatttcagttctgggagctcataatcctgtgattcttttattttaagttttaaaatacattaaaattttactggttaatcataaaatattttatatttgaaaataggatggcaatctttatttttccaagatatttgttggaaaaaaatgatygttggtattattttttctttcagctatattccatggtatctttaaaattgttcagaatataggacttttactaaaaaaattcaattgtcagagtctaaaaaaacaatgtcctcaggaatacttcagaaatagaaggtatgcaatcccttagtggggggcaaacacatttcagatttcgtctttatttaaaaggatcttcagwctacaacatttgcttttttcgtgctttggaaaatatccttgtgcagataagttcttctgtttgaaacaagcatgaaacattggtccaataacctaagaatgtggagatttcttgatattctgtattaattaaagttctctacatgtctcaaatggagatcacaaaacatgaaaaggaagaaatgaaatatcttttcttctgggatgagtgtcaattttaatgtataattgtcataatcaatcagccaaaagttacaatctgtccctcagagacattgggggaagctgatggatttccagtaaggaactgtggtgggttcaaactcaggctgccacaaatacattgatatggtaggtaggaagtaggactaaatttgaaagaaacttatgggataaagttcacaattttaaaaaggttgccctccagtttttttgtttgtttataaactagagtgatttttaagtaacccttatatttaaggctgcaaaaaatgtacaagagtatgttttcaagtaaagggaacataattcttcaaaaagctgttgaactggagttatgataggttatgacagagagcatgatcagtgctgatactgacaagtacttttttaccttaaaatcaacttctatggaactacaagatcaatctagctcccgagtgacattttccattgtctgtaataatgccctcggatgagttgtgtctaaaattaagttcatctttatttatatgcgaacttaactgccatagtccctaatgtattgcrtttgtaacctgatcgtattatgtttacagctgaaagatttcatctagacatgtctttcgtccttattattcaaagtgtaattgaaagagatatttagtattaagacatgttccccaattgagaattttccagaatattctacttaagaagaagaagagcaattaactgcctttagtgtaagggcgagagtgcatagaaatatgcaatgtaaaatgtttgcatgaattatttcacatcatgtaagctttcccatattcataagatgaacactatagaagtctcatttctctgtgatcttctgtccattaggaaagtaaggagattgttatctatatctagtctcctttccatattgaactgcatggctctaatcctcagtgtatttttatcccttctcgagttatttaaaatttgccctatttaagctgaagcctggataaactgctgagccagattattcctgtgattggagtttaattgctgtagaacacttgttgagaacacattttttactttttttctttcagaattattcctcaatcattgttctctaatgaaaacaccgagaagtaaatctggtgcttcttagtgtaaatatgtttttctttttaaaaagtcattttaaaacaaagatgagagaactataaagtaaggggaaatatcattttatttaaaaataattattcaatgatagataatggagatacagaatgamtcattgggttcataggtatgatttgtgcagccagtcttagaggaaatacatcattttaacattattcccacaaaatgttaaagctcaatggtttgactatgagagtcaaacaattactatttgaaaatctcttatgacatttttataatctactctgtttttatttgcatgattatgcttatgtgatgaaccatccatgattctgatattgtatttctttccagtattaacatgtgtattgtgtggccaactctgatttgtacaccgtattattgttgtaatgattcaactgttcctacatttaattgcagtttaattattatgccttttggggttaaatgatgtgaagtgtttccacctactgataaatascatatgaaaacaygactaaaagactgatttaagaaacttgttatttttaaaaatatgaatttcaaaagaaatgttctcaaagacacatgcatttattttaaattcaaaaaattcttatgaatttattattgcttgtactttaactttttttattgtagacaatcctaagtgaataatgtctcatgggagaacacatgatatgtgcttgtatttgtgtaatctgatcatgcactcaatggttggaaaaggcactccagtgctaagaaaataaccagaagccaatatatcgattcttatatctcggtttatgttaccaactgaatatggtgtaatgcataactttttccagtaaataaactggttattttttgttcatttcattaatgctgcctttttatcaatttgagcagtttttctgtatgtcattttgatgtatacttacaaaaaggaaaagactatatgaattcagatgtgatctatatgtttattcaaagtaagaacttatttgaactaaaaactaaatgctttgctttaacaacaattctatacattcctggtaagtaatgtgtatcaactctgctcatttcctccagttatcacctcttctacttgtaatcttttctagaaagctattttggcaggaggatatacttggctgaatttgattagaaatgtaccaacatgaagaaaatgcttgccctaaaacaggaaacattattttgatgaaagaagaatgaagtttctatgcattattttgggagacaattcctctttgttctttttggaacagcagagttccaaaactttgagggaggttaattttctagctcctcctacaaatacatattgtagtaaatcagctgctttgggaaccatccactttgattcgattttatttaaagggtggaggagggggagaggcagatagaacatggtgttctagtgagttaaaacgtctaatgcaatcctcattatagctaatcaaattcgtgcaacacgggcagccaacatcctggcaaaagctgtctgctcacctgttgcataaatacaacactagaaataataatgtaaacttttctacaaatttctcctttttctcttccaaaagcttttgtttttcttggaggttggatctataagtctatttgatacttgactttctcttacatgataaagctgatagtctgccacattcaaaagtgaaaacagctggacgcatcaagaaagtctcttctcatctatacattttgcaggcaacttggacagcctatattgcaacccacaagggatgagaaagagagcagaatcgatgggaacttgtggaagggatttccgtcttcttcttcttcttcttcttcttcttcttcttcttcttcttcttcttcttcttcttcttcttcttttcttcttctttcttcttctccttctccttctcttctcctcttcttcctcttcctcttcttccttcttccttctttcttcttcttcttcttttttaaagagggagtcttgctctgtctcccaggctggagtgcagtggcatgatcttggctcactgcaacctccgacttcctggttcaagctattttcgtgcctcagcctcctgagtagctgggattacaggcacgtaccaccatgcccagctaatttttgtatttttagtagagacggggtttcaccatgttggmcaggatggtcttcatctcctgacctcatgatccacccgcctcggcctcccaaagtgctgggattacaggcgtgagccaccgcacccagccggattttttttttcttttgaaacatggcctcactctgccacccaggcaggagtgcagtgggatgatcttggctcactgcagcctcgaccccctgggctcaaatgattctgccacctcggcctcccaagtagttgggatcacaggcatataccaccatgcctggctaattgtttaatttttttgtacagatgaggtcccactatgttgcctaggctggtcttgagctcctagactcaagtaattctctcatctcagacactgaaagtgttgtgattacagacatgagccacctcgcccagccaggaaaggattttcttggtttttggtcgtacacatgctgactagcacattgtaggaactcagtcaattttgaattagagtagttgttcctgagaagtgagtttcttggcttcttgacatctagctttctcataagacatccagaattgagtttacagaacctaatgtcacctacttatataattacagcaggcactaaatatcaactaattgggggaaatggcctttaaattaagtgaatgcttattcctgtcattctgtcttagtgaatctaaaaactagatctcttaacactgtaataggaggctaagtatgtatgatgaaataatctaagaattcttttttttgtgtgtgtgacaagatcttgctctgttgcccaggctggaatgcactggcaagatcacagttcactgcagccctgacctcataggctcaactgatcctcccactgcagcctcccaagtagctaggaccacaggtgcacaccatcatgcccagctaattttttattttttgtaaagatgaggtctccctatgttgcccagtctggtctgaaagccctagactcaagcaatcctsctgccacagactcccaaagtgctgggattacacaggcatgagccaccatgcccagttgagtttcttaatttatgaatcaagtacacttaaatgctttagaagaccctcagaataattaatccacaaaataactgtcaaggaagataaatctctgggaaaaatatttcaagtgtcaaaagtaaacaatttataatataatttgaatgtaggaagcaacataaagataaataaatcataaatatagtggcttcttgttaaatagtaaagaaatgttacagaataccttgttgccttcttttcttttttccttttttttttttgagatggagtctcgctctgtcgcccagcctggagtgcagtggcgcgatctcggctcactgcaagctctgcctcgtggattcatgccattctcctgcctcagcctcctgagtagctgggactacaggcacctgccaccacgcccagctaatttttttgtatttttagtagagatggggtttcaccatgttaaccagcatggtctcaatctcctgacctcgtgatccacccgacttggcctctcaaagtgctgggattacagacgtgagctactgcgcctggccccccctttttttttttaaagattaatttatttatttagtttttagttttcagtttcactcgttgctcaggctggagtacaatggggcgatctcagctcactgcaacctccacctcccaggttcaagcgattctcctacctcagcctctggagtagctgggactacaggcgcctgccaccacgcccagctaatttttgtatttttagtagagatggggtttcaccatgttggccagcctggtcccaaactcctgatgtcaggtgatccacctgccttggcctcccaaagtgcttggaatacaggtgtaagccaccgcccccggcccctcattttccttattatctatatcagtaggggataaaagaaagataattcagtaagttagcttctgttactactaaagtcaggtgaaagactataaatagtaggatagatgtatgtttcatatcccaagatgggctttatctaatttgctagtcccagtgcaaaatgaaaatgcggggctccttgatcaaaaaataagaagaatttcaagacagtgatagcaatgcattaggccaaacatgaggtccttctaagcacagggctttgtttgactgcagggatccacaggccatgaagccagccatgccccagaatatgctgaaataatgattcaggatctcaacactgaatgtagctattcagaaactgggctttggtgaccaggcgctgtggctcacgcctgtaatcccaccactttgggaggctgaagcaggtggatcacgaggtcaggagtttgagaccagcctgaccaacatggtgaaaccccgtctctactaaaaatacaaaaattagccagacttggtggtgtgcacctgtaatcccagctactcaggaggttgaggcaagagaatggcttgaaaccaggaagcagaagttgcagagagctgagattgtgccactgtgctccagcctgggtgacagagtgagacactgtctccaaaaaaaaaaaaaaaagttataaaaaaaaagaaactgggctttgtttttaacaaaatatacttctaagtttctgtgcttggaaggaaaaatactaatgtgtttacgtcctggggaaaaatatttaatgctaatatatcaatgagttctaaagttgaatcttgcaatacttccttattccaatgtagccataacatgtcaactcaaaatttctaaacaactctgatatgtgtatcaggtcatactaagattataaaaatctttaaatctttaaaaaagcaacagtagacattttaattagtgtatattaaagtaaaactaatttaagaaccctactgatacttttatagtttgatgtcctttgaagttgtaaaatattaataatgtcagtcaaatgtcacaggaagatttgcctaactgaaaagagctattagtccaagattaatcagtgattcatatcaacctttattccaaataaataaaaaaagaaattatttacctaattgaaatccatttattttgaatatacgggtgctcatgtgtagtaaaccaccctatatgtaaaaaaaggataatataaaaatatatagtaagtgtttcttgttttggataaagtaacagtggaaaccaatagaaatggttatctgtaaaagagcagagggtatgataaaagggtggaagccagactctttcagtgcacgaatgcctttcttacatattgttttcagccatgtaaataaatgatttatccaaaggaaaaaaattaagataacgtgggctctcaaaaatttcacaatgaagccataaataaaagcacaaaatcggccgagtgcggtggctcacgcctgtaatcccagcacgttgggaggccgaggcgggcagatgacgaggtcaggagatcgagaccatcctggctaatgcggtgaaaccccttctctactaaaaataaatacaaaaaaattagccgggcatggtggtgggtgcctgtagccccagctactccggaggctgaggcaggagaatggcgtgaacccgagagctggagcttgcagttagccgagatcgtgccacggcactccagcctgggcgacagagcgagactccatctcaaaacaaacaaacaaaaagtgcacaaaatctagatgagtatttgttccatagcagactatgtcagcagaactatttttaaaaacacaaaattttattcaaattctaaccctggcacgcacttactagctctgtcactttagaaaggttcttaccctctccaagcttaagtggtcttgtttttcaaacaaggattaaaaattgcctacttgggctgggcacagtggctcatgcctgtaatcccagcactttgggacgccacggcggctggatcacccgacatcgggggaaaaaaagccggctgggtggatcacttgaggtcaggagtttgagaccagcctggccaacatggtgaaaccccggctctaaatcagccaggtgtggtggccgtggttgtaatccccagctatttgggagactgagagagggagaattgcttgaacctgggaggtggaggttgcagtgagccaagatagtgccactgcactccagtctgggcaacagagcaaaacccagcaaaacaaacaaacaaacaaacaaaaacagcctacttggcaaggttattgcaaagattaaatgaaataacatatataacaactttcaaccagtgtttagtctttagtagctattattattattaagagtttcgctcttgttgcccaggctgcagtgtaatgggcgatctcggctcacagcaacctccacctctcgtgttcaagcaattctcctgcctcagcctcccaagtagctgggattacaggcatgcaccactacacctagccaattttttgtatttttagtagagacggggttttaccatgttagccaggctggtctcttaactcctgacctcaagtgatccacccacctcggcctcccaaagtgttgggattacaggtgtgagccaccggtgcccagccgatactactgttttttgtgtctctttccatccatggtacatatatgatagtaacttccaaaaggtatgaamcttcgttttcttccctaatgcatcttaaacgcctagagtagaatctggcacaaaataagttctcaatagttggtgaattgccaggcgcggtggctcacgcctgtaatcctagcactttgggagaccgcggcgggcagatcatgaggccaggcgattgagaccatcctggctaacacggtgaaaccccgtctctactaaaagtacaaaaaattagccgtgcatggtggccggcgcctgtagtccccgctactcgggaggctgaggcagaatggcgtgaacccgggaggcggagcttgcagtgagccgagatcgtgccactgcactcccgcctgggtgacagagactctccatctcaaaaaaaaaaacttgctgaattaaggaatgtataagtgaatgaatgaatttcacacatgtcaatatataggactccaattatctaggtactgttattaaaaataatattagtggctgggtgcagtggctcacaactgtaatcccagcactttgggagcctgaggtgggcagatcacctgaggtcctgaaaaaaaaagcagctgggcgtggtggcgtgcacccctaatcccagctactcggggaggctgaaacaagtgaatcccttgaaccgggggggcggggggttgcagtgagccgggatcgcaccactgcactccagccttggcaacagacggagactctgtctcaaataaacgaacagaaaagagttgcatgataattatataactatcatagtattgtatccggaattgttgggttcttggtcttgaggccctggaccctcacagtgaatattacagttcttacacactgtgtgtccggagtcttttctttcctatgttcagatgtgtctggagtttattctttctggtgggtttgtagcccccctggctcccggagtgaagctacagaccttcccagtgaatgttacagcttaaacacagcagcagacccaaagactgaacagcagtaagatttattgcgaagagcaaaagaacaaaacctctactacctaaaagtggaccgagccgattgctgctactagcggtggcctgcttttattcctttatttggccccacccacatcctgttgattggtccattttacagagagctgattggtccgctttacagagcgctgattggtccgttttgacagagtgctgattggtgcgtttacaaacctttaggcagacacagagtgctgattggtgcatttacaatcctttagctagacagaaaagttctcaagtccccaccccacccagaagcccagccagcttcacctctcaatggcactcaccgctgcgggactttgcggcacgtagcccgggcactctggcagcccagagggaactcgtccccccgatcaaacccagcaggcgccagccggtcgcgccgagtgcggggcttgccgagcccgcgctcacctggaactcgcgccgacccgcgagcgccgcgcgcacccctggctcttgcagcgcctctctcttcacacttccgcgagagcagagggagccggctcaggcctcggccagccccagagaggggccctcatagcgcagtggcgggctgaagggcctcctcgagtgcggccagagcggacgccgaggcggaggaggcgctgagagcgagcaagggctgctagcacgttgtcatctctcagtatgttagattatgaaactgtaaggtaaaaataaaaagaacagggaaaaaagattgtgtcagattgggatagggagaaagtaaaacagattattaaatggggtgatcaggtcgggcctcatcacaaagatgaaataagaaaaaaaatatttcttttcacatcatggttgcttcagttttaaaaaatattaagtcatctatatacaattttttttcaatttttgtagaactaattgtccatctaaaaatatcagaccaggtgcagtggctcacgcttataatcccagcactttgggaggccaaggcaggaggatcaatttgaggtcaggagtttgagaccaccataggcaatataatgagtcctcatctctattaaaaaattagccaagcatggtggtacgtgctggtagtcccagctacagaatctgaggtgtgaggactgcttgaccccaggagtttaatgccacagttagctttgatcacaccactgtactccagcctgggtgacagagggagactgtctcaaaaaaataaaaataaatatcaaacaacaattaacattaagtaatagcattttcaaaaactattattttaaaattgtgtaataggcataaccattacgaaatatgcatatatatatatatatattttttttttttaagagacagggttggctgggcatggtggctcaagcctgtaatctcagcactttgggaggctgaggcgggcggatcacgaggtcaggagatcaagagcatcctggccaacatggtgaaaccccgtctctactaaaaatacaaaaatagctgggcgtggtggcgtgcccctgtagtcccagctactcaggagactgaggcaggagaatcgtttgaattcgggaggtggaagttgcattgagcggggatcacgtcactgcactccagcctgggcgccagagcaagactcctctgtcacaaaaaaaaaaaaaaaaaaaagacagggtcttgctgtgttgcccaagctggacttgaacgcctgggctcaaggagtcctcctgcctcagcctcccaagtagctaagactgcaggtgtgcaccgtcgtgcccagctaatatgcatatattttatttcatgacagtgtttctttaaaatcccaatatttattttacaagtagatatcatkccttcttgaagctttggtatttgtccacttaggtttctcctttaaatatttgtatcaaataatttaactcaactgccttattgataactgtaactcctttttttttttttgagatagagtctcgctctgtcrctcaggctggagtgcaatggcgagatctcagctcactgcaacccccacttcccgggttcaagccgttgacctgcttcagcctccctagtacctgggattacaggcatgcatgaccacgcccggctaattttttttgtttttagtagagacagggtttctgcatgttggtcaggctggtctcaaactcacgacctcaggtgacccacctgccttggcctcccacagtgctgagattacaggcatgagccactgtgcctggccctttttttttttttcctttttttgagacagagtctcattctgtcacccaggctgcatgcagtgcagtggcgtgatctcggctcactgcaatctccacctccctggttcaagcaattaccctccctcagcctcccaagtagcttggattacaggcgcacgccatcacgtctggctaatttttttgtgtttttagtaggtacggggtttcaccattgttggccagactggtctcgaactcctaacttcaggcgatccacccaccttggcctcccaaagtgttgggattacaggcattagccacctcacccagccaactgtcaattctaatgaccttgtaattgactgtataaataatccttgagataagtcataatgttatttttcaacatatagtcagaaactaggctattttttcttctggtccttaattccaactcttctccttgaatgaccctttcgtccagattttctataaaattaagggcaacttttaaatattttctcataaacttcctaatacaaaactaagaactattattacattgatggttgggtgcagtggctcatgcctgtgatcccagcactttgggaggccgaggcaggaggattgcttgaggccaaaagttcaagaccaaccaggccaacatagcaaaaacctttctctaaaaattaaaaataaaaagaagtattatttccctgggcgcagtggctcatgtctgtaatcctggcaccttgggaggctgaggtgggcggatcacctgaggtcaggagttcgagaccagcctggccaacatggtgaaaccccgtctccactaaaaatacaaaaaaattagctgggcgtggtggtgagtacctgtaatcccagctacttgggaggctgaggcaggagacttgcttgaacccgggaagtggaggtttcagtgagctgagatcacactattgcactccagccagcctgggcaacaagactgagactccgtctcaaaaaaaaaaaaaaaaaaaaggagtattattacattgctaagctttgcattagttttttggttttttttttgtcaatgttaccatttttcttaggtttatatagattcaaacttcaaagttggctatttcagtagaattaacagcaattagtatatatttaaaagtcagccttttctttattcacatgaatagttgtcctaattctcggttactttattagaaaataaaggccatggtactaaatatgtttatgtaatatggaaagggcatcatcacattctatacctaggtaagtactaggagtacttaacaaatatcaaacagctgggtgtggtggctcacacctgtaatcccagcactttgggaggcygaggctggcggatcacttgaggtcaagagttcaagaccagcctggccaatattgtgaaaccccgcctctattaaaaatacaaaaattagccaggcatggtggcgggtgcctgtaatcccagctacttgggaggctgaggcagggagaactgcttgaacctgggaggcagaagttgcagtcagctgagatcctaccactggactccagacagagtaagatgccgtctcaaaaaacaaaaataggccgggcgcagtggctcacgcctgtaatcccaacactttgggaggctaaggcaggcggatcacgaggtcaggagattgagaccatcctggctaacatggtgaaaccccatctctactaaaaatacaaaaaattatccgggcgtggtggtgggagcctgtagtcccagctactcgggaagctgaggcaggagaatggcatgaacccgggaggtggagcttgcagtgagctgagatcgcaccactgcactccagcctgggcgacagagcaagactccgtctcaaaaaawaataataaataaaataaaataaaaacaaaatcaaagatgagaataaaacctaattggtgaaaatcttacctattaaaagtctattcaattatttgttgtgaagagttcttttttctttttgcatcagtggaatctaaaaaatttctttatgatcaactgagcaaaattataccaactaccaaacataaaacactggaatatgagctgaagtaatggcattctcctggtacttgcaaccctatgctgaaataaacccatgcttctaaagcagttccattaatttaggatgtaaaattcaatataatatagttaaaatatgttctagaatgcatctgataaagtttgaaaacagacttagagagcctgtgacagtgtgtattttcagatggaaaaactgtgcctaaggtgttggacaaattattcaagaactgattgtgttcttaaagatcccctagatcagcaaatacccagggtgataattggctaagtgataatcacaccaattaggctgcagaggcagtgtcagatttttagttcaagatcctattaacagctgagcctactcattatacttctcactggcagaggttctctgtgtccttggacaggatttgcatctctgcctcacagacaggaagtttgggagacatctgctcagttgaggataaaaactttaatttcacctggaataaattagcttatttttcttcagattggccaaagatacaggtctgccaatcccattcatttatttatttctcaaatgtttgcttctttttttctagtaataaagcaatatatatttattgtagccagtttgaaagatatggaaaagtagaaaggaagcaatacaattcacccataatctctctcaatgaaaactgctgttaacattttggtgactttacttgaatcatactgaatatacaattttaaatcctgtttttcaccttttaacatttatggtgaatatttttgtaggttattaaaagtttgcaaatacaatatttttaaggttgacataatattctataggatgaataaattatactttttaaaaaacaaaatactttcctatattggctatttaagttgcttcaagatttttactgttgtaaataatgatgagccacttcctccctytcacccaggacaaaaaaagaaaaaatatatataatgatgccgttaaaatctttctttctttctttttttcccctgtagagaggaggattcatgttyttgcccgggatagtctcgaactcctggactcaaraaatcctcccmcctgagcctcctaaagcattgggattacagtcattagccmccgtgcccaggtttttttttttttttttttttaaggctagttattgaaagcagtgggagtggagaagaaacaaatcggtaactggttgtgatcagtctgttgtaaacatcactgcattcagaccagcctcatgaacaacgtttttgatttgcaatttggagacttaaaaatgaggagactgttttctctcaacaaattgaaaactattaccatgaaaatgtttataccttgcattttaaaaaatatttttgattgccaatattctcactaaaatgtttatcatgtatctatttgtgtctactttgaaaacaaactatttgaaatactgcataaataatatcacttcaggtttatctcttttatcagtttgtctctttttcgtggaaaatttcagagtattctgttaattcttttttttttttttcaatttatttatttgagacaaggtctcacttttttgcccaggctggagtgcagtggcacaatcatggctctctgcattctcaacttctggggctcaactgtttctcctacctcagcctcccaagtagctgggactacaagtgcatgccatcatgcccggctaataaaaaaaaaacaaaattggcctggcgcagtggctcacgcctgtaatcccagcactttgggaggcggaggcgggtggatcacgaggtcaagagttcaagaccagcctgaccaacatggtgaaaccccgcctctactaaaaatacaaaaattagccaggcatggtggcacacgcctgtaatcccagctactcgggaggctgaggcaggagaattgcttgaacccgggaggcagaggttgcagtgagccaaggtcatgccattgcattatcttttttttttttttttttttttttttgtagagacaggatttcactatgttgcccaggctggtctcaaactcctgggctcaagcgatcctagtgcctcagctacccaaagtgctgggattacaggcatgagccactgtgcccagcctctgctgaattctaatcatgcagagctgtgtgggctactgcaaatgcctagtagatgtgtgagccttgtataaagcaatagtgtcattagagaaagatgtaaatttagaattatagattggcacaatagtcttatagcctcagtgtgtcaccttctgttgatcttaccatggtatgtacaaaagtataatatggccgggcgtgatggctcacacctgkaatcccagcactttgggaggccgaggcgggcgggtcacctgaggtcaggagttcgagatcagcctggccaacatggtgaaaaccccatctctactaaaaatacaaaaattagctgggtgtggtggcaggttcctgtaatccagctactcgggaggctgaggcaggagaatcccttgaatccgggaggaggaggttgcagtgagccgagatcgcgccattgcactccagcctgggcaacgagcaaawctctgtctcaaaaaaaaaagaaaaaggttgctctaagccaacgtgctactatagtattgttgatttcaacaccatctttttattgaggcaaataaactaagttagaaatttgcatttatagttaatttatgtatatggaggcaaaactttctgctttaatttatatttgaaactacttgtttaaattacttttgatactatatggcacagtagataacagtgccgctgtcagaaagagaataaatcctaagagagcaaaagctccttttaataaaggtctgaatggctgcataaatcattagagggctagttccttctctttgggagtacgtttatttgggtagcagccagggagactgaaacagttgaactgcccttcacaaaggctgagaaagatcgaattaccattacacttcrgggggctggagatggtacctgggtgaatgaccatgtgaagaaaggcggggtggcttccaagatggaagtgatggctggggaacttggcttgagctgggatacttgtaatggtggctttttgcctcctatctgtgtgatttttgggacacagcctctttgttattagaatagtgaattttcaaatgcagataagcaagtcaatttaaaatgtatttttttggtcaggcactgtggctcacggctgtaatcccagctctttgggaggccarggtgggaggaatgcttgagcccagggattggagaccagtctggtcgacmtaggaaaacctcatctccactaagaataaataamyaaataaatamtactactaattagctgagtgtggtggcatgggcctgtagttccagctagtggtggggctgaggcagtaagatcccttgagcccaggaggtcgaggctgcagtgagttgatagggccactgcactccagcttggatcagggtgtgacccggtatctaaaaaacaaacaaaaaagcatttcttcaggttagtatttagctggtgttaaaaacgaaaacatgataatttaaaaggactctaggctgggcacagtgactcaagcctgtaacccagagctttgggaggccaaggcagtaggattgcttgagcccaagagttagagaccagcctgggcaacatagcgaggcctcatctctacaaaaactacaaaaattagccagcagtagtggcgcgcccctgttgtctcagctactcaggaggctgaggcaggagaatcgcttgagaccagaaggtcgaggctgcactgagctatgatcacaccactgcactgcagccttggtgacagagcgagaccctgtctcaaaacaaccaaaaggactgtaaagtgcattcctaatgaagtcctgaatggagggtctgctgctcttctggaaacctttggattgttaacctctacccctcttttatttccacacctcttatttcattttctgtcccgatactcctggcaagatgtttagttcagtggagtaaggacagacttcggtgcggagactccagctctgcagtgctatgtgaccccactgtaggttcagcaccttggtttccttatctgaaatacttattcggtagttttaggacataagatcaagggttcagcacaacggcttgagacacatacgcgaccctcagagtgcgggtctgcgagaatgcaagcaccctggacatggtccagagtagctggacttcttcccgagggcactgcgtggccagcaggtgagcgcggcccccgcctcgcagcaccccaggtgtgcggccgcaggtgcgcgcccgcgcggctcccctcggccaaagggcgaggcagtggcgcggcagggcggggccggccagagcgaaccggctccggctccggggccgcgcccagggcgctccgctgggcacagcaagttcttggctgcttccccggccggaggaggcggcggcggcggcggcggcggcgctaacaggctgaaccctctgcgctctcctcccgcccttggggacctgctggcgattggctccagagaggaaggggtggaggcagccccggcctggcagctgcggtagcggctttgagtgagtgcgggagctgcagataccgagrcgctgcgactgccgcaggagtcgccgcagccaaactcgccgcgacgccgggagggagcgtaccgggaaggagagggagaggaggcactcgctgaggagacgccgcagtagagggcgcccccggagtcgcgccgaacctgggcatgcaggcgacgccccccaggggccgctcgcggctggacgggagcgggaggagtcggggagcggcggtcgagcccggcaggatgagcgacgagggcggctccaacttcaggcgggtggcgatscggcggaagtccaacccctcctacctgccgcccggggtgccccggccctggagcaggcccgcgtcgcacctgggacgtgtagggaccgctgccttcaagggccaggtgccctcaggagccacaggtaagcgcctcggggcgcgggggaagggtggccccggcgcgtaggtgcgggtgaggggcgctcccagcgccctgcaggtgcgccctctcgtcccccgctgcggaggtaactggttcgggaggttcattgtggaaggctgcgctcggccacccactcccttagctatgctgtcccttcccccagaggaccttgggcaggaacccgcctaccgccgagcttgtcctggaggtcacttctcagaaaattcagaaagtamaggtagaattctctttttctctctaacttttgttaggatttgaaaagaccagttttctagctactgaagcttaagcggcttcgctaaattcctgctttgggcagccgtggtggaggcctaatacggtgaaggggaggctggtgtccgcccaagtctgacaacctaggtgtggtgagcaaccttcttagtgcctggattttcttaaagggacgcttgactcccaggctgactgtgaaaagcggcaaggaaagctgttcctaacatcagaaaacggaatcattattgctgttttcatgttaataggttcagatgtcagtaatgcggtgttttgatttctgaattctcattgaatcttaaagaagtcctcaaggtgatctattcaaggcgatctattcaaggccacgtaatctcccctgtcttgtaaatgtgttctcttctccccaggcgagtttgaaactagggatttcttttttctttgatttgcaaaacttctttaaaatcccctcccctcctttatgcggtaaccagaggtgtctggtatgtagaccagcttacgaggcaaaacctcatttgagcagcagaaatacaaataattctaattactttcacgcatttcattctgattaagcaaatatgacgatttaaatatgataaatattagagcttttaaattcccttttagtcctggttctgaacttgtagtaggcatagagcagaaaaacatgatgaattaaaaagatataactacagtagataagggcagaaattgtgaggtgagaaaatatgtaaacaagtaactgaattacagtgccttcggtcttcatttccttgtcttcaaaatgaggacactagtgtgaaacagtttctgaactctcttccagtcttaggtgtgattcactcaaattaatgggagggtgttttcttccttatcaaatgaaaatgatttactttggatcgaaggtatttatttaatgggttttcaagttatttaatgtacagaatttgttaatcatcaactgttttcagttggagaatagtgggcaccaaattccttatttttgtgagacggagtctcactctgtcgcccaagctggagtgcagtggcatgaactcagatcactgcaacctctgcctcccgggttcaagcgattctcctgcctcagcctcccaagtagctgggattgcaagcatgcgccaccacgcccaactaatttttctgtttttagtagatacgggggtttcaccatgttgcccaggctggtctcgarctcctgatctcaagtgatccgcccgcctcagcctcccaaagtgctgggattacagatgtgagccaccacatccggcctcaaattctttattctatcattttacttaaaatcacctggctaaattacaaacccattgagtaggggaaaagaggaagtgcccttttagcagtaagggtaaaagggagttgtggcagtctacaaatcatttctgtaaggtrgctctgcttttyctcttttccattctttttttttttttttttttgagacgcagttttgckcttgtcccgcaggctggagtgcagtggcgcaatctcggctcactgcaacctctgcctcctggcttcaagattctcctgtctcagcctcccgagtagctggggttacaggtgcctgccaccatgcacagctaatttttgtacatttttttttttttttttgagacggagtctggctctgtcgcccaggctggagtgcagtgacgcaatcttggctcactgcaagctccgcctcccgggttcacgccattctcctgcctcagcctcccgagtagctgggactacaggcgcccgccaccacgcccggctaattttttgtacttttagtagagacggagtttcaccatgttggccaggcatttttttttttttttttttttaaagagacgggattgcttggcacgggggctcacscctgtaatcccagcactttgggagaccgagggggaggatcgcttgascccaggagtttgagaccggcctgggaacatttcaaaaccccgtctctgcaaaaaatgaccccttgtggrctgaagtgggaggatcgcttgcgctcaggaggtggaggctgtagtgagccatgatcgtttcactgtattccagcctgggcaacagagtgagaccctgtctcaaaaagagagggagagggagagagagagagagaggggaggggagtcagagagagatggggtctcactgtgttgcccaggataaggctagagtgctgtgcctattcataggtacaatcgtagctcactatagcttcgaactcatgggctcaaagctatccttctgcctcagtctcttaagtagatgggactacaggcacacaccatttttttttttttaattcaaagaaaacccagagcagttttttttaaaatggagaacctagcactaccttttctaggtgtgttacattgtctcgatattgtaaaccggctgaaactcaaaattcttgttgctattttcagggtcgaaaagtaattatcttaataggtacagcccccttaccatgataaaatctgtaatatctgtaggagaatgatctagtgttttgagaagtagtctcaaactactggatgaccacaccctgttcaatttgggaagggtaaaaaatattttagaaagtgctttcttctttgactcaaatctgcctccctattagttcaatagtatcattagataagtctgttcttccccctcatcaaaaagtaaaccagatttaagttactgaaaagtgccagttcattctatagcacctaggaaaatatttatatatgaaaaccacaaaatttaaacgcattacaaagtaggcattactcaattgaaatgtcactttccctcttaaagaagaaggaacaaaaactgaaaactcaagaacttggcagaaaattccatttagcattgttatgtcatgttctgtggttataaaccctgctgtttttagagttctrtgctttttggcaaaaataataaagtgtaccaactgcatcctttgtgtattcctgaatgtgaagctccccatttaagtgaaacagaaaggtgaagcaattaagacataggctttggggttatatagcactcacgttctagtccctcttccatagctagctgtgtgaattggactgtctcttaatttctacgtttcttcatctggacaacagagataacaatccttataatcggtgcactcctatagtctcagctacttgggaggctgaggcaggagaatcactacaagccatgagtttgaggatgaagtatgctgtgtttgcacctgtgaatagctactgcactccagcctgagcaacgcagcaaaactccatcttttttttttttttgagactgagtcttaccctgtcgccaggctggagtgcagtggtgcaatcttggctcactgcaacctccgccatctgggctgaagtgattctcctgcctcagcctccctagtagctgggactacaggcacacaccaccatgcccagctaatttttgtatttttagtagagacggggtttcaccttgttggctaggatggtctcaatatcatgacctcgtgatccgcccgcctcggcctcccaaagtgctgggattacaggtgtgagccaycgtgcccggcccaatgctcccttttatggaaccttagttccaggcctcaggttcagctttttcctattgtgaaaacccaaggccaaaacttccgtcccctgmaaggctcttagtcccctaggctttcgggttcctggcaatgactttgcctcttgggcagcatggtcttacragttagttacttgtgtttaagttttgggttcttttttttttttgcttgcctttgggcacctcctttattttgttatgagctcagccatgcatttgttgtatctgagtatttgaatatctgttgtaatttattcagcatctcggtgctttgtggtgagggacttttcacattatttacttggtaaactttctatgtaagtacagtttttttttttctggtactcaccatggctggaatgctcacattttcaacatataccccagtatcctragaacttctagagtactaatttcatctctggggaagagggatagaaattttggtgaaagcaatacaaaaaagtactattgattgaattctggcactgaaccaggactatgtgtatgttacctctagttcttataacaaccctgaaaaaataggtggtattattacaattttagggaaggaaaaaaagtttcagaaagtcctattgcagtaccctgcacctagtaaatttcagaggcaggattcagacttatgtcactggcttcagtgcttgcatgcctgttaacacctgttcttaaggttttccagggctttgagtggcccaacgtaaagcaataaccataggtcatttgcattcatatgttagagctaatgttatttgtaacattaaaaaatctatattatatttttaaataaaagtatctttagtattattagaatcatacaatgttctaaacaagtaaagatttacactaaaatgatggatggtgtgcatgtgcatgaatatcattaatgcttcttagaagctccttaaagatgggctctgaaattggaaccaggaaaagtttcttataagaatttccttccaagaacagcttatttatttttattttttatttttattttttgagayggagtctggctctgttgcccaggctggagagcagtggcgcaatctcggctcacttcaagctccrcctcccgggttcacgccattctcctgcctcagcctccagagtagctgggactacaatcgcctgccaccayrcccggctaattttttgtatttttagtagagacggggtttcaccgtgttagccaggatggtctcgatctcctgaccttgtgatccacccgcctcagcctcccgaagtgctgggattacaggcgtgagccaccgygcctggctccaagaacagtttaaagagcagtcagtggtttttttttttttttttttttagaaggagtttcactcttgtccaggctggagtgcaatggagtgaactcggctcaccacaacctccgcctcccgggttcaagcaattctcttgcctcagcctcccgagtagctgggattacaggcaagcgtcaacatgcctggctaattttgtatttttagtagagatggggtttctccaagttggtcaggctggtctcgaactcccgacctcaggtgatccacccgcctcggcctcccaaagtgctgggattacaggcgtgagccactgcgcccagcctagtcagtggtcttttaatgaatagccatgtaaacttgtggacctaagagcattgagagactcttactccacagtcacctgcttgcttgcattccttttctctgctgaaggaaatctaggttcatggttttaactggtaacagagaagaggaactggaatttgttgagggaacgggaacttgattgggggtctgcctgaggtcacctgctgttggagtcagtccttttacagggagataacatacatatagttctggttcagaaccagaattcaatcaatagtacttacttgtattgctcttactcaaatctcttttttttttcaaatacgcatttgctggaaaattgattgaaaaaggattagaacatgatgcatttattttttattttattttattttttgagatggagttttgctcttgttgcccaggctggagtgcaatggcgcgatcttgactcactgcaacctccgcctcctgggttcaagtgattctcctgccttatcctcccgagtagctgggattactggcatgtgccaccacgcctggctaattttgtatttttagtaaagacaggttatctccttgttggtaggctggtctcgaactcccgacctcaggtgatcckcccgcctcagcctcccaaagtgttgggattacaggcgtgagccactgtgcccagcctacatgatgcatttaaatatatggatgtggggctgggcgcagtggctcatgtgtgtaattccagcactttgggaggcagaagcaggcggatcacttgaggtcaggagtttgagaccagcctggccaacatggtgaaaccctgtctctactaaaaatacaaaaattagccaggcgtggtggtgggcgcctgtaatcccagctacttggaaggctgaggcaggaaaatcgcttgaaccgagggagcagagtttgcagtgagctgagattgtgtcactgcactccagcctgggtgacagagctagactccatctcaaaaaaatttaaaaaaaaagaaaaaatttatgcatgtgaaatgtggtgagagattcagtaggtttggacaggagcttatggatctgcatttttaaaaagtatattagataattctgatgatctgcttggcttccaaatgccattctaccagctgtttcagaattacttgggattgctaattaaaaatctctagccacacccttgayatagtgactcagaatctgaggggtagggttagagaagctgtttttttttgtttgtttgctttttgtttttttgagacagagtcttgctctgtcacccaggctggagtgcagtggtgtgatctcagctcactgcaacctccgcctcccaggttcaagcaattctctgcctcagcctcccaagtagctggtattataggcacctgccaccatgcccagctaatttttgtatttttagtagagatggggtttcaccatcttggccaggctggtcttgaactcctgacctcgtgatccacccgcctccgcctcccaaagtgctgggattacaggcrtgagccaccacgcccggccaagaagctgtatttttttttttttttttttttgagacagagtctcactcttgttccccaggctggagtgcaatggcacgatctcggctcactgcaacctccccctcccgggttcaaatgattctcctgcctcagccttccgagtagctgggattacaggcacctaccactatgcccagctaatttttgtacttttagtagagacggggtttcaccatgttggctrggctggtcttgaactcctgacctcaggtgatccacctgccttagcctcccaaagtgctgggattacaggcgtgagccactacgcctggccaagaagctgtatttttaacaagtgcccagacgatcctgatgtacaaccaggtttataagcttctgtgcattyccaaacatgggtaaaccccactttggtcctgaggacaggttgccragatttgcaggaataagacaaggaatgctatagattgtccctcaatacataatctgggccctctgcactttctggcatactttttgctcatttctgtttgactcctcattgcactttttctatctgttacaggtctttcctactttgttcttttgtctcaactccaccctctccctcttgaagtagacctgaatttgtgccgatacacaatttttatcagactggggtatctgaggtgagctcaamcgacctgtcacttcagacttggtttatagactcctttattgcagccctctcctttttactaatctggcagataaacccagtcctcagagacatttctcctctgttaccttccatggtttgcccctttactctcatttataggctattttttcccctcctcacccccaatgaggtaatcctagactttatttatttatttatttatttatttatttatttatttagttttgataaagagccttgctttgtcgcccaggctggagtgcgatggtgccatcttggctcactgcaaatttcacctcccaggttcaaacgattcccctgcctcagcctcctcartagctgggattacaggccacaccatcatgtccagccaattttttttttttttttttttgagacagartttcgctctcgttgcccaagctgtagtgcaatggtgcaatctcggctcactgcaatctctgcctcccgggttcaagcaattctcctgcctcagcctcccgagtagctgggattacaggcatgtgccaccatacctggctaattctgtatttttagtagasacggggtttccccatgttggtcaggcttgtcttaactctcaacctcaggtgatccgcccaccacggcctcacatagtgctgggttgacaggtgtgagccaccgcgcctagcctaatttttgtatttttaatagagatggggtttcgccttgttggccagactagttttgaattcctagcttcaagtgatccacctgcctcgacctcaccatcctagaytttaaaccttgaaattttctagagctgcctcccagtgactttaacttactgtgtggayctgccttgctgccctcacttcttcatcttctcaccccgtcctcaccacttccttgtcttcttttggactggcttgtgtttacaacattggattagcagttgtaaggtcagcaatgaattcccaaatagcattcagcacctattttcagcccttcttaatttttctgtgacatttgtacctttttaaagctcttttcttggttctgatgacctgagatatcttgattttcytacctcattggttcttcaactttcttcctctggctttgccattttctcctttctcctcgtcttcattgggggtcccatctgccctctgggaaggttcagcagagggtatctatacctactccgcgttttcaagggcctgcttaatgaatataaatgctccaagggcaccaaatcacaatttctttttacattgcaatccagccccttctcctgactttccttggcaattttactaacctagctcttgtttggcttcaaattctgttttaaaatggaatctacctgctacccaatgagctaccagttcttatcagttttccttcatttcacattgaatgtttttgccttatttttggcctatttctcaacaatagtgttgctattcattctatataactctttcctccccccagtaatttttcttttttttcttttttttttttttgagttgaagtctyactcttgtcccccaagctggagtgcaatggtgcgatctccgctcsctgcaamctccgcctcccaggttcaagtgattctcctgcctcagcctcccaagtaggtaggactacaggcgcctgccaccacacctggttaatttttmtatttttagtagagacggggtttcactgttggccaggctggtctcaaactcctgacctcaggtgatccgcctgcctcggctttccaaagtgctgggattacaggtgtaagccactgtgcccagcctccccccagtaatttttcttaaatctgagtatggatcatatctttgccatagtcaaaaaccttccatgtctccccagctgcctgttactgatgtctgtgatgggatccagaaataattgccttagtgattgattgttggttaaaccttaccagtaacccctggaataggtatatcttttaaaatccacacaaatatttagtcttatttgaactatgaaagctagactagtcatgcattgatcacactttagaagttgtgtgtatgtttgttttcaggaatatatttggcatcatttggtccagtcgcagtagctcacatctgtaaaaccagcagtttgggtggccacattgggaggattgcttgagtttaggagttcaaaatcagcctgggtaacgtagtgaaaccttgtcttgtctctcaaaaaaaaaaaaaaaaaagtcaagaaatttgccagtatggacctggtgcggtggctcacgcctataatcccagcactttgggaggccgaagcaggtggatcatgaggtcaggagattgagaccatcctggttaacagggtgaaaccccatctctactaaaaatacaaaaaattagccgggtstggtggcgggcgcctgcagtcccagctactcgggaggctgaggcaggagaatggcgtgaacctgggaggtggagcttgcagtgasccgagattgtgccactgcactccagcctgggcgacacagcgagattccgtctcaaaaaaaaaaaaattgccagtatggcccgtagtcttagctactcaggagggtgaggtgggaggattgctgaagtcccaaagggcgaggctgaggctgcagtgacctgtgatcacaccactgtattccagcctgggcaatggaatgagactgtgtctcaaaaagaaaaaaaaaaagaaattggcatcatttgcagggcattgtcttgaatttgtcatckgttcttgaattgcagttgacagtgtaggcattagcaccagcaagtgttctgggagcccacagtcaactttgtattattgcctcacttaagcgagaatagagtgaaaacaaacccagttgctgtgcccgtygcacatgcacatccgttcattggaattaaactgtcagccttcatcaactgcagtgtctgtggaaaccagggagctaccacagttctgggaaccgcactgagcctcagtgcaactttgaacaaaatgccaaatgtccaccctgctctgcaaggctggggttgtcccctggagcctctgacagggttttgttttaggccacatgttaataatagtcttaaaaagcacaatgactttacaatgaactcttttttttttctttttttttttttttttgagatagagtctcactctgtcgcccaggctggagtgcagtggtgagatatcggatcactgcagcctccgcctcccaggttccagcgattctcttgcctcagcctcctgtgtagctggggttgcaggggcgccaccacgcccggctaatttttgtatttttagtagagactgttttttaccagattggccagactggtctcgaactcctgacctcagtcaatccacccggctcagcctcccaaagtgctaggattacaggtgtgagccactgcgcccggccgctcatttgtatttttaaaacatgtgggtgggacgcggtggctcaagcctgtaatccctgcactttgggaggccgaggcggacggatcacgacgtcaggagttgagaccagcctgaccaacatggtgaaaccccctctctactaaaaatacaaaagttagccgggcgtggtggcacacgcctgtaatcccagctacacaggaggctgaggcaggagaattgcttgaacccgagaggcagaggttgcggtgaggcgagatcgcgccgccacactccagcctgggcgacagagcaagactccgtctcacaacagcaacaacaacaacaaacacatgctaggaggtgaaaagtcagcatgtggaaccatataaattataagataccccaaattgaagaatactgaggggtcattgcttaccatttcaagtacaatgcggtataaaaatcaactcaaaaaggcatactggttgagtgcagtggcttacgcctgtaatcccagcactttgggaggcgaaggtgggcaaattatctgaggtcaggagttctagaccagcctgaccaacatggtgaaatcctgtctttactaaaagtacaaaaattcacagggtgtggtggcgggcgcctgcagtcccggctgctcgggaggctgaggcaggagaatctcttgaacccaggaggtggaggttgcagtgaaccgagattgcgccactgaactccagactgggcgacagagcgagactccatctcaaaagaaaaaaaaaggcrcatakagaaaaagcatacasatttattaacgtgcacacgtgagaatcacagaatgattgcccagtatcccaatggggcccaaatacttacatawtcttatttcagaggggaagaggagatagggaatattggtattctgctgagtaataattgattactgtggagaatgaatggatgagggaacagagactgatgtgtaaatgattctctttggaaatggagtgatcccgagaggcagacgttattttgtagaaagatctgattaggtctggttacattcttggtcatcttttctgcagtagattgtgagataatggagagaaggaaaaagtattgtttttgttgggtctatctggtgtttatgtagacagaggaaaaatctattcctaatacctgttgatttttaagggcttttaattcaaaatactcattatctcaggaggctgtgttttggggtggaaattccttgcgctccttcaattggaagttatgaaattgttataggctgggtatggtggcccacacctgtgttccagcactttgggagacctaggtggaaggattgcttgaacccagaagttcaggacccggctgggcaatagggagtcccctttttgttttgttgttgttgttttgagatggagtctcgcgccatcgccaggctggagtgcattggcgcgatgtcagctcactgcaacctccgcctcctgggttcaagcgatcctcctgcctcagtctccaccacacccatctaattttttgtattttttgtagagacgaggtttcaccatgttggccaggatggtctcaatctctagacctcgtgatctgcctgcctcagcctcctaaagttctgggattacaggcatgagccaccgcgcctgtccagagaccccttttctagaaatttttttttttttttttttttttttaattagccagccatggtggtgcatgcctgtggtcccarctactcaggggactgaagtgggaggattgcttgagtttgggaaatcaaggctgcagtggagccataattgcgccactgcactccagcctgggtgacagagtaagactctgtctccaaaaaaaaatttttttwaaattatagccaatttgattaaaaataattaccaacagggtgggggctaggggagggatagctttaggagaaatacctaatgtagatgatggtttgataagtgcagcaaaccaccatagcacatgtatacctttgtarcaaacctgcacgttctgcacgtgtatcccagaacttaaagtatatataaaaaaaattaccaaaaacctatttatagaaaaaaaaacttttaacaaaatgatcttcgtttactctgcagaaagttggctaacatgtaacatttacgtgctgtgtaaattatgccgtcatattaatgtgctgtgtaaattatgctgtcatattaatgacttaccagtatgttagcagtattggtaattttcatcctagaaaggggaatataatgcataattttaataccactgttgtgtctaagagaagcgttcagaggaaggcacactttggactgtgctgcatgcatctttggggaaaactgaacatgtaatttgtgccctcaaggtcatctgggagcttgtgtgtactggcttatgcatctggtgggagcagcagcctgctgacacaatctggaagtctccctaaaatgtataaaaccaagttataatccaaccaccttgggcgtgctttctctggacctctggagactgtacttcggaccatggtcacttatgtttggctcagaataaaccttaaatattttacagaatttgcttttttttgtcaacaggattgaaggcaattgtattctttgggggtccagtttctasgtagatgaaggaactacagagaacagcctcatcttgtacttttggacagaaagataactgagagataggggagcgaaggtcagagagaccttgaggatacttttttttttttttttttgagacggagtcttgttctgtcaccaggctggagtgcaatggcatgatcttggctcaccgcaacctccrcttcctgggttcaagggattctcctgcctcagcctcctgagtagctgggattacaggcgcccaccagcacacccagctaatttttatatttttagtagagacagtgtttcaccatgttaaccaagctggtctcaaattcctgacctcaggtgatccacctgcctcgacctcccaaagtgttgggattataggcgtgtgccaccgcacccagcctacttctttttttttwaaaaaattatttatttatttttgtgggtatagagttggtgtatatatttatggggtatatgaggtactttgatacaggcatgcaacgggtaataatcacatcgtggaaaatggggtaaccatcctgtgaagcattcatccttgtgttacaatccaattacactcttttagttataaaatgtccaattaaattattgactatagtcaccctgttgtgctatcaagtactaagtcttacttattctttctatttttttttgtactcattaatcatccccatttcccctcctccccagctgcacttcccagcctctggtaatcattcttctactatctccatgagttcagttttgatttttttagcacccacaaataagtgagaacatgcaaagtttgtctttctgtgactgacctatttcacttagcataatgacttctggttccatccatgctgttgcaaatgatatttattgatattttgtattttattcatttyaaatgtatttatttctgctctgatctttattgtttgttctaattttgsgttcggtttgctcttgctcttctagttctttaagatgaatgttaggttatttatttgaagtttttcttctttttgatgtaggccctcataggtrtaaatttccttcttagtactgctttcactgtatctcatagattttggtagttgtgtttccattattattgtttcaataaatttttcaatttccttcataatgttttcattgacccactgttcattcaggagcatattatttaacttccatgcgtttgtatatgttccaaaattcctcttgttatttatttgtagctttatttcattgtggtcagagaagatgcttgctattatttcagttttttttgaatgttttaagacttgttttgtgacctaacatgtcatctgtccttgaggatgatccatatgctcaggaggatgttctgtagccattggatgaaatgtttcataaatacttattaggttcatttgttctattctgcagattaagtctgatatttccttgtttattttctgtctagaagatctgtccaatgctgaaagtaggatttagatgtctccagctattactgtattgggatctgtctctctttttttttttttttttttttttgagacagagtctccctgtgtcacccaggctggagtgctgtggcacagtctcggctcactgcaagctccgtctcctgggttcacgccattctcctgcctcagcctcctgagtagctgggactacaggcacctgccaccacgcctggctaatttattgtatttttagtagagacgggtttcaccgtattagccaggattgtcttgatctcctgacctcgtgatctgcccgcattggcctcccaaatgcggagccaccaggcgtgagccaccgcgcccagcctctttctttagctcttaataatatttcctttatatctgggtgttacatcctcttgctgaatggacccctttatcattatatagtgacgttatatgtgttttcttacagtttttctcttgaaacctatttcatctgatataagtatagctactcctgctctttttttgttttcattggcatgaaatatctttttccattcatttattttcagtctatttgtatctttataaatraagtgtgtttcttttaggcaacagctcattgggccttgcatttttatccattcagcctctccatgtctttgtgttgtgtgtcacccaggccgaagtgcagtggttcaatctcagctcactgcaacttctgcctcctgggctcaagtgatccttttcttcagccttccaagtaaagtagctgggactacaggtgtatgccaccatgcccagctaatttttgtattttttgtaaagacagggtttccctgtgttgcccaggctggtcttgaactcccgtgctcaagcaatctgctcaccttggcttcccaaagtgctgggattacaggtgtgagcgactgtacctggccaactgtatgtcttttgattagagagtttagttgatttacaatcagtgttattattggtaggtaagcactactcctaccattttatttgtcttctggttgttttttggtcttctcttcyttctttccttctttcctgtcttccttttagtgaagatgattttctccaatgttacgctttaatttctttttattttttgggtgtccattgtacgttggacatgcacacaatggacacacataaaacacaacaattagtattcggyttgcaaatactatctcgtaacccattattttaaatggatgacaacactgattgcagaaataaacaagcaaaaaagaaaatgaataaaactatatactttaactttctcctccccttttaacttttgtttctttttatgtcttattgcactgtctatatcttgaaaagttgtagttattatttctgatkggttcatggtttagtctttctacttaagagtatttcacacaccaaaaattgccatgttatattcctgtttttctgtgtgccattaccagtgagttttgtaccttcagatgatttcttattgctcattaacgtccttttctttttctttttctttttttttttttgagatggagtcttgctctgtcacccaggttggagtgcaatggcacratctcggctcactgcaacctccgcctcctgggttcaagcaattctcctgcgtcagcctcctgagtagctgggactacaggcgcatgccaccacgtctgctaatttttgtatttttagtagagatgaggtttcatcatgttggtcaggctggtctcaaacgcctgacctcgtgatccacccacctcgtcctcccaaagtgttggaattacgggcatgagccaccgcgcctggcctaacgtccttttctttctgattgaagtaccatttagcattttttgtaggacaggtctggtgttgayaaaatctctcagcttttgtttgtctgggaaagtctttatttctccttcaagcttaaaggatatttttgctggatacactattctagggtaaattttttttttcttccgcattttaaatatgtcatgcctgtaaggtctcctggcctgtaaggtttccactgaaaagtgctagatgtattggagctccattatatgttatttatttatttattttctgagacagagtctcactctgtcacccaggctggagtacaatggtgcgatcttggctcactgcaacctctgcctcccaggttaaagtgattctcatgcctcagcctcctgagtatctgggattacaggtacatgtcaccatgtctggctaatttttgtatttttagtagagataggatttcctcatgttgaccaggctggtctccaacgccaggcttacyaattctttcttctgcttgatctgttctgctaataagagactctgatgcattcttcagtatgccaattccatttttagtttctgcataattctttttagttatttcagtctctttgttacatttatctgatagaattatcaattccttctctgtgttatcttcaatttctttgagtttccttaccacagctcttttgaattctttgtctgaaaggtcacatatctctgttttttccaggaatggtccctggtgtcttagttcttttttttttttttttttgagacagagtctcrctctgtcgcccaggctggagtgcagtggcacaatctcggctcattgcaagctccacctcctgggttcacgccattctcctgcctcagcctcccgagtagctgggactacaggcgcccgccaccacgcccrgctaattttttgtatttttagtagagacggggtttcgctgtgttagccrggatggtcttgatctcctgacctcgtgatccgcccgcctctgcctcccaaagtgctgggattacaggcgtgagccaccgcrcctggccctggtgccttagttctttgggcgaggtcatgttttcctggatggtcttcatccttgtagatatttgtctatgtctgggcattgaagagttaggtatttattgtagtcttcactgtctgggtttgtgcccatccttcttggaaaggcttttcaggtatttgaggggatgtgggcccaaactgaataactctgtggttcttgccgacttatagaggtaccaccttgatgatcttagataagatctggaagaattctctggattaccaagcagagactcttgttctcttcctttattttctcccaaacaaatggagtctctctctgtgctaaaccacctggaccttggggggtggggtgtcaccagcacaccgtggccaccacaactgggactgtaccggttcagaccygaagccaggatagcactcgatcttgcccaaggcccggtgtaaccactacctggctaccacctaagtttactccaggccctaggactctgcagtcagcaggtggcaaagccagccaggtttgtgcccttccctccagggtggtgagttcccctaggccccagattggttcatagatgctgtctgagaacaccagggattgaagtcaaaaccttagatatttacctggtgttttgttctactgtggttaaggtggcacgtgacccacaagacaagttgcttcccactcttccctcccctttccacgggcagaagatcctctccctgtggctgccatcaccactggcttatgkgggggttctgccaggccatcactgatacttaaagcctaagggctcttcmgtcagcttgtgaccaatgctgccagctctgggactcaccttttggctcagggcaggtccagaaatgctgaccaagagcctaggcctggactcagtgacctcagaagtctgcttgttgctctaccctctgtagctgagctaatacctgaggtgcaagacagagagtctcctttattttccccctgcttttctcaaacaggagtctttcactgtagccctcacagctgggaatgtgctgggtcacacctgaagccagcatgtctcagagcccagtgcctatggtatactacctggatagtgctgttgataattcagggccttggcgctctttagtcagcagggggtaaatcctgccaggtttcctctgtgacagggcagcactgagttaagttaaagtgccccagtcactgcattctccctctactaaatgcacagatttctccccaccacgcagccactgctggggrtgggggaggcatggcagaagcactcccttagtcaccctggctggtgtcttagtaggytgtgtgcctcctactctagtccactggctctgggcccagcttagcactagggcttgcctaggaattgcagtccttgtggcctaacctgcccctcaagaccacttagggccccagagcactctggcctgtggttgtgaggcttgtgggaactcaagctctgactgctatggtgggtgatttccctctggctaaggccagtccaaatgctccttccgtggttagatgtcatctgagtgcagcctggttctgcttatcactgacagggcagcactgagttcaaagcaaagcctcccaactgctgtgctgtccatctcccaaaagcacaaaatctgcacgtgtggccactgctgggagaagggggagggctggcattggcacttcaagactgtctttcctattctcttcaatgtctctttcagtgatatgaaattaaaaccagctactgtgaatgctcacctgatttttggttatttgagatggctgccttttgtatgtagttagttgttaaaatttgatgttcctcctgggggtgaggggggtgacaaacagtgtaggcttcttctattccatcatcttgctctgcccctgtggctgctgccttagttcagcatgccaaagtgccgtattttggggtattgttttcatgccctaacagttccttgtggcagcttttgtgtatctctaatctaatgcttgtctcattggatcatgtttgtttacaaggatctagcacctactacaagttactgccctaggtgcaagctcttccgggcatgtctttccgttccctttcaatccctctggcttagcccttgcctccctagccccttccaaaactgccttttattgctgaccactttcctcagtctttccttctgtgctgtcttgagcaaccccagttttatgtttagaaaattccctaaaacctgaatttcaacacagacccacacagttttctgcatgaagcctggctttctcccacattactgattccctggtgacactcaagtgacggttgttcatcttttatgacccacatatctcctggttgggacctgaggtcagccctcttctagctttccctgactagaaaaaattcctcctgctttcactgttgtcagtcacctcaatttcttcaccaaacttcttgtttttgctctgtgtctgccctatagcccctaattctgtagtcatccattgctcctcaagggcctctcaaagtccattcaggggctcaatagatattgaataaacagaagaaccccaaactagttggtacattttggttcaatgtaataattattttttactttttatttttttaaagagacagggtctccactctttcacctggactggagtatggtggcatgatcatagctcactgcaacctcgaactcctgggctcaagtgatccttctgccttggcctctcaaagtactgggatttaccagcattagccaccatgcccaaccaaacataagaattttctaccaacactgtcagaaagtggaattagggttctgcagtgatcatgagtttcttaataatgagggatattcaaggagaggctagatgacttagtggctttgctatagaggagatggaatgccagatgtaactctttctgacctgtaatcccagcttgcaaactaaataacatcagtggtactcagctttccttgtgtgtctacaccatycatatactcgcatcagcaatgtgtagcaattttgtgctggggtgtattagagaatagtatactttttgttctctttgagtattcatggactggactttctttatgtcccttttagtttaacagttccaattttcttggcatcctttctgatgttgtcgtagggccttatttcaagagcatgctggtctgtaggatctggctgctcctccactgaaagcccccagaatgctttgttacattgtcaggaatttctgtatttcttttatcttgtagctttctctatcatatcccatttccactgtcctctcttctttcacagccattttcttcctctttctttgctcattgttttttcattattaggacttggctttttaggtcaagactcctrataaaaggactcctttcttctgctgttgccttaccagtcacatatgtggtgctgtctctagtgggctttgctttaaaagcaaaaaacaaaaaaccaacaacaacaaaagcaaaacaaaagcagctatgcatgtttagaaactggattttagttcacagcttgtatagaaaaagatgagactataggccgggcgcagtggctcacgtctataatcccagcactttgggaggctgaggcaggcggatcatgaggtcaggagatcgagaccatcctggccaacgcggtgaaaccctgtctctactaaaaaaaaatacaaaatattagccgggygtggtggcgggcacctgtagtcccagctactcgggaggctgaggcaggagaatggcgtgaacccgggaggctgagcttgcagtgagccgaaatcatgccactacactccagtgtgggcgacagaatgagactctgtctcaaaaaaaaaaaaagaaaaagatgagactataaaacatctgatgcttggaatattgctgttactgttttccatctcttaatctatttcattcaatctaaaatgtgcatttttttttcacattgaagcatctctgaaattgggagctgcttttttttttttttttttttttgagacagagtctcgctttgtcacccaggctggagtgcagtggtgggatctcggttcactacaagctccgcttcccgagttcacgccattctcctgcctcagcctcccaagtagctgggactacaggcgcccgccaccatgcctggctaattttttgtatttttagtagagatggggtttcaccatgttagccaggatggtctcgatctcctgacgttgtgatccacccgcctcagcctcccaaattgggagcttcttaaattggcagtattttaaaaattatgtgacattgaaatgtagattggcctaaattttaaaatgtagttgcacagtatttactgcctctagataatagtttattaaatactctcccagactatataactgagaaaatacactaacaaattcccctcccmcttttctaaattaaaaacatagtatatatgaatatcattttcatatatcttgctacttccttagccttcttaattataaacttgagtcagctattatttactgagtrcttayattttagatgctgttctaagtgctccacatgtataaacttgcttagtcatcacgagtgggaactattaccctcatcgtacagaagaggaagcagaagcccataaagtttaaatactttctccaagttcacatggctagtaggtgggggagtgacgatttaaacccctgctcttaatctctgtacttttctgtctgatgtaaatttcttattgccctttttttaatatcactgaacttgaggatattgtttatctttagcaatggaaaaatcatttcctcctgatattctttatccagtttgtctaaagtctaaaaaacaaaacaactctttggtttattactgggtgaaccccaaaattgggattcggccagagaggccayatgggttctcggcttcctccaggaaagaattcaagaacaagctgacagtaaagtgaaatcatgtttattaagaaagttaaggaataggccagcacggtgactcacacctgtaatcccagcactttgggaggccgaggcgggcagatcactaggtgaggagatcgagaccatcctggccaacatggttaaaccccatctctattaaaaaatacaaaaaattagccgggcgtggtggcaggcgcctgtaatcccagctacttgggaggccgaggcaggagaattgcttgaacccgggaggcgaagcttgcagtgagccgagatcacgccactgcattccagcctgggcaacagagtgagacttcatctcaaaaaaaaaaaaaaaaaaagaaagaaagtgaaggaataaataaaaggctggctactccataggcagagcagccccatgggctgctggttgactatttttatggttatctttgatcacatgctaagcaagggatgcattattcatgagttttccaggaaagaagctggtagttcctggaaccaagagttcttcccatttttagacaatatagagtaatttccaggagttgccagcatctgtaaatttactgtcatggcactggtgggagtgtttttttttttttctttttctttttgtccaccttttccctacttctaccattctattctctacttccatgaatttgacttttctaaattccacacataagctgagatcatactgtatttgtctttctgtgcctagctcatttgacttaacataatgttctctaggttcatccatgctgttgcaaatgacagaatttcctgctatttatttatttattttttgttatactttaagttctgggatacatgtgcagaacatgcaggtttgttccataggtatacacgtgccatggtggtttgctgcatccatcaacccgtcatctacattagrtatttcttctaatgctatccctcccctagcccccaaccccctaacaggccccggtrtgtgatgttcccctccctgtgtccatgtgttctcattgtacaactcccatatatgagtgagaacatgcggtgtttggttttccgttcctgtgttagtttgctgaagacgattgtttctagcttcatccatgtccctgcaaaggacatgaactcattctttttttatggctgcatagtattccatggtgtatatgtgtcacattttctttatccagtctatcattgatggacatttgggttggttccaagtctttgctattgtgaatagtgctgcagtcaacatatgtgtgcatgtgtctttatagtggaatgatttataatcctttgggtatatgcccgataatgggattgctgggtcaaacagtatttctggtcctagatttttgagaaatagccatactgtcttccacaatggttgaactaatttacactcccaccaacagtgtaaaagcattcctatttctccacatcctctccagcatctgttgtttcctgactttttaatgaatgcyattctaactggtgtgagatggtatctcactgtggttttgatttccatttctctaatgaccagtgatgatgagctttttttcatatgtttgttgcctgcataaatgtcttctttagagaagtgtctgttcatatcctttgcccactttttgatggggttgtttgtttttttcttgtaaatttgtttaagttctttgtagattctggatattagccctgtgtcagatggagagattgcagaaattttctcccattctgtaggttgcctgttcactctgatgatagtttcttttgctgtgcagaagctctttagtttaattagatcttatttgtcaattttggcttttgttgccattgcttttggtattttagtcataaagtctttgcccatgcctatgtcctgaatggtattgcttaggttttcttctagggcttttaaggttttaggtcttacatttaagtttttaatccatcttgagtcattttttgtataaggtgtaaggaagcagtccagtttcagttttctgcatatggctagccagttttcccaacacccatttattaaatagggaatcctttccccattgcttgtttttgtcaggtttatcaaagatcagatggttgtaggtgtgtggcgttatttctgaggtctctgttctgttctattagtctatatatctgtttcagtaccagtaccatgctgttttggttactgtagccttgcagtacagtttgaagtcaggtagcacgatgcctccagctttgttcttttgcttaggattgtcttggctatatgagttcttttttggttccatatgaaatttaaagtagttttttctaattctgtgaagaaagtcagtggtagtttgatggggatagcattgaatgtgtaaattacttcgggcagtatggccattttcacgatagtgattcttcctatccatgagaatggaatgtttttccatttgtttgtgtcctctcttatttccttgagcagtggtttgtagttctccttgaaggggagaacttcacatttcttgtaagatgtattcctaggtattttattctctttagcagttgtgaatgggaattcactcatgatttggctctctgttattggtgtataggaatgcttgtgatttttgcacattgattttgtatcctgagactctgctgaagttgcttatcagcttaaggagatttggagctgagatgctgggttttctaaatatacaatcatgtcatgtgcaaacagagacaatttgacttcctctcttcctatttgaataccctttatttccttctcttgcctgattgccctggccagaacttccaatactatgttgaataggagtggtaagagagggcatccttgtgttgtgccagttttcaaagggaatgcttccagcttttgcccattcagtataatattagttgtggatttgtcataaacagctcttattattttgagacacattccatcaatacctagtttattgagagtttttagcataaaggggtgttgaattttatcgaaggccttttctgcatatattgagataatcatgtggtttttgtcgttggttctgtttatgtgatggattacgtttattgatttaagtatgttgaaccaggcttgcatcccagggatgaagccgatttgattgtagtggataagctttttgatgtgctgctggattcggtttactagtattttattgaggattttcgcatcgatgttcatcagggatattggcctgaaattttctttttttgttgtgtctctgccaggttttggtgtcaggatgatgctggcctcataaaatgagttaggggggattccctctttttctgttgtttggaatagtttcggaaggaatggtaccagctcctctttgtacctctggtagagttcagctgtgactctgtctggtcctgggctttttttggttggtagtctattaattactgcctcaatttcagaacttattattggtctattcaggaattygacttattcctggtgtagtcttgggagggtgtatgtgtccaggaatttatcartttcttctagattttatagtttatttgcatagaggtgtttatagtattctctgatggtagtttgtatttctgtgggatcagtggtgatatcccctttatcattttttattctgtctatctgattcttctttcttttcttctttcttagtctggctagtggtctattttgttaatcttttaaaaaaaaccagctcctggatttattgattttttttttcatggttttttgtttctctgtctccttcagttctgctctgatcttagttatttcttgtcttctgctagcttttgaatttatttgctcttgcttctctagttcttttaattgtgattttagggtgtcgattttagatctttcccactttctcctgtaggcatttaatgctatgaatttccctctaaacactgctttagctgcatcgcagagattctggtacrttgtttctttgttctcatgggtttcaaagaacttatttatttctgccttaatttcgttatttacccagtagtcattcaggagtaggttgttcggtttccatgtagttgtgcagttttgagtgagtttcttaatcctgagttctaatttgattgcgctgtagtctgaaagactatttgttatgatttccattcttttgcatttgctgaggagtattttatttccaaatatgtggtcaattttagaataagtgagatgtggtgctgagaagaatgtatattctgttgatttggggtagagagttctgtagatgtctattaggtctgcttggtccagagctgagttcaagtcctgaatatccttgttaattttctgtcttgatctgtctaatattgacagtggggtgttaaagtctcccactattattgtgtaggagtctaagtctctttgtaggtcgctaagaacttgctttatgaatctgggtgctcctgtattgggtgcatatatatttaagatagttagctcttcttgttgaattgatccctttaccattatgtaatggccttctttgtctctcttgatctttgttggtttaaagtctgttttatcagagactaggattgcaactcctgcttttttttgctttccatttccttgataaatattcctgcatccctttattttgagcctatgcgtgtctttgcatgtgagatggatctcctgaatacagcacaccaatgggtcttgactctttatctaatttgccagtctgtgtcttttaattggggcatttagcctgtttacatttaaggttagtattgttatgtgtgaatttgatcctgtcattatgatgctggctggttattttgcccattagttgatgcagtttcttcatagtatcaatggtctttacaatttggtatgtttttgcagtggctggtaccagttgttgctttccagatttagtgcttccttcaggagctcttgtaaggcaggcctggtggtgacaaaatctctcagcatttgcttgtctgtaaaggattttatttctcctttgcttatgaagcttagtttggctggatatgaaattctgagttgaaaattctttactttaagaatgttgaatgttggtccccactcttcttctggcttgtagggtttctgcagagagatctgctattagtctgatgggctttcctttgtgggtaacccaacctttctttctgtctgcccttaacattttttccctcagttcaaccttggagaatctgataattatgtgtcttggggtcgctcttctcgaggagtatctttatggtgttctctgtgtttcctgaatttgaatgttggcctgccttgctaggttggggaagttctcctggataatatcctgaagagtgtttttcaacttggttcagttctccccatcactttcaggtacatcaatcaaacgtagctttggtctttttaatagtcccatatttctttaatcttgtcttgtgctttatttcattaagttgtcttcaatctctgatgtcctttcttccgtgtgattgattcagctatggatacttgttatgcttcacraagttctcatgctgtrtttttcacctccatcaggtcatttatgttcttctctaaactagttattctagttagcaattcctctaaccttttttcaaggttcttagcttccttgcwttgggttagaacatgttcctttagctcagaggagttttttatcacccaccttctgaagcctacttctgtcaattcatcacacttattttccatccagttttattcccttgctggtgaggagttgtgatccttcagagaagaggtgttctggtttttggaattttcagtctttttgctctggtttttcctcatcttcatgaatttatctacctttggtctttgatgttggtgaccttcggatggggtttctatgtgaacatcttttttgttgatgttgatgctattcatttctgtttgttagttttccttctaacagtcagggtcctctgctgcaggtctgctggagtttgctggaggtccattccagaccctgtttgcctgggtatcaccagtggaggctkcagaacagcaaagattgctccctcttccttcctctggaagcttcgtcccagaggggcaccctccacatgccagacagagctctcctgtacaaggtgtctgttgacccctgctgggaggtatctcccaatcaggaggcacgggggtaagggacccatttgaggaggcagtctgtcccttagcagggctcaagcgctttgctgggagatctgctgctctcttcagagctggcaggcaggaacttttaagtttgctgaagctttgcccacagctgccctttcccccaggtgctctgtcccagggagatgggagtttaaacccctgactggggctgctgcctttctttcagagatgctttgtmcagataggagaaatctagagaggcagtctggctgctgggagtgtcttttagcatgctaattagcatacataattataattagctataattagcagtgaggacaaccagaggtctcttttgttgccatcttggttttggtgggttttggcctgcttcttaccatgttttatcagcaaggtctttgtgacctgcatcttgttgaaacragtcctgccaaattcctatcaggtttactgtagttaatgaggccaaaaaaaaaaaaggacattttcaaggagaaacagaaacattattagaaaagattctgggctgggcgcgctggctyatgcctgtaatcccagcactttgggaggctgaggcaggcagatcacctgaggtcaggagtttgggactagcctggccaacatggtgaaatcccgtttctactaaaaatacaaaaattagccgggtgtggtagcaggcatctgtaattccagctacttgggagactgaggcaggagaattgcttgaacctgggaggggcaggttgcagtgagctgagattgyrccactgtgctccagccttggtgataaagtgagactctgtctcaaaaaagaaaaaaaaaaggaaagaagagattctggaggtagaaacaagaaatagtttcctgatctttgctgggcaaccgtacttttggtaatacttgattaactcaaatcctctattgctttctaggaacttgtttgactagattatatcgtatatcattagcagggtgacagttacctactaaattttgaagttatatgaataatctttattttcaagaatcttatgaattttatatgttctgcaaaaacaggtaaaacttcattcctcytttactctatttaaaaaaactgtaatggatggatatatataattgcgtgtgtgtaaaagtaatattaatatatcaatatcatgatcttactggtatatgtttttctaagagaatttttctaagagaattaggtaagcctttccccactcttttaacatcttagtataataaaaaattgagtgagagtattcacacccagagatactgtccaaagtagaagaactagcttcaagactgggaactgactagggtgctaattagagcccctctgtagtccttttatagaaaatggtaaactcaggccattgcctatgaaaacattgaaaagaagggaaggaggagaagggttctggaggaagcaaggaggaaactgccaatgatggtagtcattgttctgaagtcagtttggtgcccaatctaagctgattttcattgagagctaatgtccatttccaggttttggaactgaatgaacaactggtatgttttcgttaacctgggagattctctgtagccacaaaatgagcattggagaggtcgaaaaaaggaatagaaaattaaaaatcatataactcccacttgtagagagcagctgtcatcatataatgtcatgaatcctctctgattagctggcagcagatgtgttaggtgcttctctgcctcttgattatagcccctttctgtaaacttccgggaaaattatattggcggcaattgcgtgtatcactgatacatgcaaaagcccttatttcaggatatccactttttcagatcttttgtcaattgtccatttctggcataggtcctgagtcccagtgtaatttatactttttttcgtttggaaaagggttttttattctcactccttgttttgagtctcaaagctagttgcttacactcagttcgtgcaaatgctgtagtggcatatttagamgataggctttgtgtggacttttggaaaagtttaatagtttatgtctgcatgtttttctttatctaatctcccctcaacctgtccccaacaaatacattaagaaaataatttctgggccgggcgcagtggctcacacctgtaatcctggcacttgggaggctgaggcgggtagatcacttgagcctgggaggtggaggttgcagtgagccaagattgtgccactgcactccagcctgcgtgacagagcaagattctgtcttaaaaaaaaaaaaagaaaataattcccctttttttcttctaatattttctccttgctcatgagttaattgatacaattacacaaatagaattttatggtaaacctgaaaggtgtgactaatatgaagtttcagatatttgaaaccttttaagttttaaaaagtattgagctcatctcctttgagcctttacttaaacggatcttctggccgtctctgggcaccttatttaaaattgggagccctggttgggcacagtggctcatgcctgtaatcctagcattttttttttttttttagacagagtctcgctctgttgcccaggctggagtgtagtggcctgatcttggctcactgcaagctctgcctcctgggttcacaccattctcctgcctcagtctccccagcagctgggactacaggcgcccaccaccatgcccagctaattttttgtattttttagtaaagatggggtttcaccatgttagccaggatggtcttgatctcctgacctcgtgatccgcctgcctcggcctcccaaagggctgggattacaggcgtgagccaccgcgcccgaccaatcctagcattttgggacgccgaggcgggtggatcacttgaggtcaggatttcgagaccagcctggccaacatggtgaaaccccatttctactgaaaatacaaaagttagctgggcatgatggcacactcctgtaatcccagctactcaggaggctgagattgaacccaggaggcggaggttgcagtgagccaagatcgcgccactgcactccagcctgggtgacagagcaagactccatctcaaaaaaaaaaaaaaggtagtaataggggttggcccttcattttataaagttgagagcattatatacagagaagggttcttcatcacttttttagtcatttggtgaatccctttaacatgaacgtgaaccttcatgttaacattgtaagagcagtgactatacctgtcttgttctttgctgtctctccaacacctagaagagttcctggctcatattatttgttaaattaattgaatgagtgagtgactgaaatcctgttgagtgctaattttcaaaatacatattttaatgccagctcaatatataaaaacctagtttacatagaaactttatcaccttcttgcccctttaatattttctttgcctggtttccatatttttctggaataagatttttttttttttattttgagacaaggtctcactctgtcgcccaggctggagtacagtggcacaatcttacctcactgcaacctccacctccctggttcaagcaattctcatgcctcagcctccgaaaaagctgrgactacaggtgtgcaccaccacacctcgctaatttttgtatttttagtagagattgggtttccccatgttggccaagctggaatcgaactcctggcctcaagttactcacctgcctcggcttcctaaagtgctgggattgagccaccatgcccagcctggaataagatactttaacataaatttccttgtcagctgattcactttaaaaatacatttttctttttttttctttttgagtcggagtcttgctctttcacccaggctggagttcagtggctcagtttcggctcactgcaacctctgcctcccaggttcaagcgattctcctgcctcagcctcccgagtagctgggattacaggcacctgccatcatttttgtatttttgtagagacggggtttcaccatgttggccaggctggtcttgaactcctgacctcaggtgatccgcccacctcggcctcccaaagtgctgggattataagcatgagccaccgcacctggcctaaaagtgcatttttttaatgtagctttcaaaagtacatgttttatgtaacgaagcatcctctaattctagctattgaagttagccatatcacygttaattgttgctttgagacaaagttacatctttaaaattttgtatcatgggatgcaatgaaacatccttctgtaaagcaaagggattgactacctgataatatatttacttatttatttatttatttattattattwttttttgagacggagtcttgctctgtcgccaggctggagtgcagtggcgtgatcttggctcactgcgacctccgccttctgggttcaagcgattcttctgcctcagcctccsgagtagctaggactacaggcatgcaccaccacgcccagctaatttttgtatttttagtagagatggggtttcaccatgwtagccaggatggtcttgatctcctgacctcgtgatccgcccgcctcagcctcccaaagtgctgggattacaggcatgaaccactgtgcccggcctgataatatatttaaacctgaattgcacaacaagctgggccttccccttgattttctaagttcctcacagaccctgtctgttcctagctcttttatgatgttctaaaactttgtcgctgcttataaaatggaggagagacttactggtaatttgttctgtgtgagtttgcattagatgcttctaattcatagaaaagttgattatcctgtgattggagaacgaagactcaggtgagcagtaatagttttaaatacagttttttacagctagaatattgaaaatagtttctttctcccttcaagttggataaattttgtacacacgaaaaataagtttgaatttgtaggctaaattcatttcttagctccttagaaatrttaggccttttcaaagaggaaagccttaattacactgtattcctcaggaaggttatttccttcatgtaaattatgacttttgtgmttccagtagctctgtgatttcttcatgaatgtcattaacttaattgccttctcattgctttatgctagaaaaatgggaatgtgctttaaacttttgtagatattgacatttagaacatggttaacttgttaacaaggtacacatttattctgatgcaaaaatctacacaatgtgttgaggcaccatatgatgttttgaccagattttgtcagtgtgctatatatgagtcagaggattgaataagatgaaaaaaatcaaatatagtggtgaatgatacaaatttcttttctgagaggagcascttcgcttcatttcttttctttccttcttttcttttttttttcttttcttttctttcttttttttgcccaggctggagtgcagtggcacagtcttggctcaccgcwacctctgcctcccgggttcaagtgattctcctgtctcagcctcccgagtagctgggattacaggcatgcgccaccacgcctggctaattttgtatttttaatagagatggagtttctccatgtttgtcaggctggtctcgaactcccgacttcaggtgatccgcccacctyggcctcccaaagtgctgggattgattacaggtgtgagccaccgtgcctggccacttcatttctttaaagtgaaatgaaactagttgagagatctagctcaggagttagacaggcctgggttcaaatgctgcctctgctaattcacagatttgggtgagtcagtttctctcaggctgtttatttataaaatcaggataatcaaaggtctcatttcagaagttatgaaggattaaatagagtaatgctcataaaatgatatatttacatattcagtactcaataaatkctagctacaattaaaaaagtgtgtgtgtgtgtgtgtgtgtgtgtgtgttttaaatgactaagttggaattggccttttttttgkggtttccatcattcraacttattttattgatactcattagcgaatataattttgttgatttttttggtgcattatgacactttttgttagtgattacacaatgttgatcatttatttatttattgtactaartactgcaacctctgaattgccaatttttacatggtatttctggcagtgatgggtggccccgctttctgattacataaaatggtccatctagtccatggttttcatattcctttgtaattctacttactgctttaaaattcattcaaataaaaagatctaagttacttgcagtgagtgagtgcccaaatgcaacagcaaggagagctgagaacataactaaccaatactttcgtgttcaaagaataaatactctgaaacagtgggacagaagcttgctccttagggactttctcaaagtayccttggtggacataaggttatcctcactcaacggaaggacatatctgctgtcgggggaggacacagaatgacgatttcatttacctaggatattttccttctgtaaatgtctggaacaagttgtcactggacaccgtgatgtacagtgtagccctcctattagaataaataaattatgtggttggactggaatgctacaggcacactatgactggaagtggaaggagagagaatgtttatttaaaatacagcacacataaataataaataaaagtttaaaacttaatcagcaacagcaacaggaccagcctcccctgttccatttatggttcttttcaggaacacctgtatcttttcctaaggataaaaagtggcacaaggagacaaaaggctttggaaggaaagaaaatactttgttgtgactttgtgcttttctgaaacaagaaggcaaaacatgtgggcattgaatggctgcaataaaagactrcacagtgtccacacattggcaagcctcaggtttcagaggaagcactggagccagcagaatgccaaagccttgtttctcccttgaaccagtttggtgttacgcctggttgtgcttctcccgctttacttttactgttgataaatttcttaataagctttttccctatcccttttccctttaatcctatcgttaaaggtgtcttgggtctggtcttaaatcaatttggttatgacactaggtcccagaaaaaaagctgctatctcattagcagcttggtgtgttggaaattcatgtttgaaccacacagwgaacctacactaccagtaccattacttccctgcatataaaaaacaaaaaatgggggccaggcatggtggctcatgcctgtaatcccagcaatttgggaggccaaggcaggtggatagcttgagatcaggagttcgagaccagcctggccaacatggtgaaaccctgtctctactaaaattagccaggcatggtggcgggygcctgtagtcccagctatgtgggaggctaaggcaggagaattgcttgaacctgggaggtgaagtttgcagtgagccgagattgcaccactgcaccccagtctgggtgacagagtgggactccatgtcaaaaaaaaaaaaaaagggaaaaagaaaacaaatcacacagaacatgaaggggctgctgaacaatgcagcaggaatgtaaatacattctctttcgggtcagacgtttggccagacggctgattacaaaacataggatgacttcaagctgaaggtatgaaaacaaaaggttacacctcaaaacagaaatgactgttcattgaggcagagtagtgaaggtcttgaagaagctgggacacccataaaagaaagaaaagccctctgctcaggaaatccatgtcagctacacgtggctgagcacggaggctctttatgctccctatacgatgagcgaggcgaggtgtccaaccgcacccagatgtgttactgggcagcctggcccaggcctttttaaagatgtttgataaagctcatgtagcaactaccagagcttcactacacggatatccgtggtattcattgagtaaaaccagcagatttcacataagcagatgtttttatttgttcctaaagtcttagaaagtaatgttatattaacatgtaatatgaattccctgttactctttggatggtttgcatttgaccagtgtcttttcatttttagtaaaagyaaaattttttctagacataatcctgctattgatgttgaatactatttcatcttaccctgcataccacacaataccactgatacattgtatataccactgataacattcttggccactgggaaaattatttttttacattgttattggtctcctgtgttgtaggtaggactatgcaggaatggatcttttctttgagacagagtcttgctctgtcacccaggctggagtgcagtggcgcaatctcagctcactgcaggctctactctcgggttcaagcgattcttctgcctcagcctcctgagtagctggggctacaggcatacgccatcatgtccgggtaatttctatagttttagtagagactgggtttcgctgtgttggccagtctggtctcaaactcttgacttcaagtgatccatctgcctgggcctcccaaagtgctgggattataggcgtgagccaccgcgtctggccaggaatggttcttgaaccatttcttcccatcttagaaaatactgacttctcacttgccttattgaaatggtttggagaggtatagcatctaacaatactgcacttccatagagcggacttgggataacagttaactcctaagacatcagctgaagatgacaaaggtaaaaatatctrccgttaagataaagttgaaaactctgtacttactgtactttattcaaaatgttagccttctcttagcagattcttcaataagcttgcttttaggtttcaactgccttgagcagttgaaattaggagaggtatgtgaatgtatctgtaagtaagtggacacaggaggatgcttttagttgtttttttaattgtcaaattttatatactagtcacctaaaacatgttttttgtttgtttgtttgtgtgtgkttttttttttgagatggagtctcgctctgtcacccaggctggagtgcagtggcgcgatctcaactgcaacctccrcctcccgggttcacgccaatatcctgcctcagcctcctgaggagctgggactataggagcccgccaccacgcccagctaattttctgtgttttttttagtagagacggggtttcaccatgttagccaggatggtctcgatctcctgacctcgtgatccgcctgccttggcctcccaaagtgctgggattacaggcgtgagccactrcgcccggccctacaacatgttttaaaatatgaatacgttgtggaatgattcgatcgatttgaccagtgtcttcattttttgatcgagctaattaacatatgtattacctcacttataatttactaataattattatagatatcatgttgtacaatagatctattgaacttattcttcctatccaactgaaattttgtatcctttgaccaaacatttccccaaaactgcacccccaactcccagtgcctggtaactactattctactctsaacttctatgagtttaacttttayagattccacatatagttgagatcatgcagtatttgtcattttgtgtctggcttataacataatgctgtccagattcatccatcttgttacaaatgacataatttctttatttttaaaggccgaatagtattcccttgtgtatctatgccacattttctattcagctgttgctgaacacttaggttgattccatatcttggctattgtgaatagtgctgcagtgaacatggggatgcagataactctgacatactgatttcatttcctttggatacatacccagttacccagtagtgagattgctggattatatggccattctatttataattttttgaagaaccttcatactgtttcccataatggctatactaatttacattactagcagcaatgtacaagatttcctttttctctttgtccttgacccttgggagtttattacatgccttgaggtagtcttctttgggttaaatctgcttggtgttctgtaaccttttacttggatattgatatctttctccatgtttgagacattctttgttattatcccactgaataaactttctgctcctatcgctctctctgcctcctctttaaggccaataacttttagatttgcccttttgaggctagtttctagatcctgtaggtgtgcttcattttttttttctttagtctcttgtgtgtgttttcaaatagcytatcttcaggctcactaattcttctgcttaatctattttgctaataaaagaccctgatgccaattacattttttagcyccagaacttctgcatgattctttttaattatttcaatctccgttaaatttatcagatagaattatcaattccttctctatgttattttgaatttctttgagtttcctcaacacggctattgtgaattcactgtctgaaaggtcacatatytctgtttttccaggattggtccctggagctttatttagttcatttggtgaggtcatgtttccctggatgccgctgatgctcgtagatgttcttcagtatctgggcattgaagagttaggtatttattgtagtcttccttgtctgggcttgtttgtgcccatccttcttgggaaggcttttcaggtatttgaaaggatgtggctgttgtgatctaagctgtttctgctttagggggcaccccaagctcagtaatgctgtggttcttgcagactcatagaggtataatgccaccttgacgatcttggacaagattcggcaaaattatctggatcaccgggcagagactcctgttgtcttcccttactttctcccaaacatacagagtccctgtctctgttctgagccacataaagctgggggtagagtgacccctgtgaccaccactataactgaacccctgtggccactaccactatgactacacggcgtcagacttgaagccaggagagcactggatcttgcccaaggtttgctataactacttcctggctgctgcctatgttcgctcaaggccctgggtctctgcagttggcaagtggctaaaccagccaggcctgtgccattcccttcagggcggcaaggtcccccacagccagaagtcaggaactagaatcaaaaaccttagaagtctacctggtaatctagtgtattgcagctgagctggcactcaaaccaccagatgcagtccttcctactcttccctcccttttccaaaggcagaagagcctcatcccatagccactgccaccccttgccacaaagagtactgccagactactactgatgttcctttaaggcccaaggtctcttaagtcagcctgtggtgaatgctgcctggcctgggactcacccttcagggaagtgggctcccctctggcctgggcaggtccagaaatgccatccaagagtcagggtctggaaccagggaccccaagagctcgcttgatgctctaccctcctgtggcagtgttggtacctaaggtgcaagatgaagtcccctttacttttccctctgcttttctcaagcagcagttttgccctgtagctgtcacatctggtaatgtgctgagccttgcctgaagtcagcaagtctcagtggctacccaaagccctcagtgtagtacctgggtatctctgctggttattcagcgtctaaagtctcttcactttgctggtgatgaatgctgccaggactgggtcctttccttcaaggcagcgggttcccttgtgacccaggatgtgtctagaagtgtaatctgggaactagggcctggaacaggggcctcttgactctggactggtgactctgactacggtgccctttcctgctatggctaagctggtgtccaaaatgcaagataacgtcctccccgctttttcctcctcaagcagaagaaaggtgtctcttttggagctgcaagctgcgcaacctggaattaggggaggggtaatgccagcactcccttggctgcactagtttgtatcttagtatgttgcttgtccccctagtccactgtctctgggcctagttcagccctaggactcacctagaagttgcagtccttgtgacctagactgcctttcaagtttacttagagaccaaaagcactttggccctaggtttgtgggcactgggattggcgattcccctctggctagggctggtttaaacgctccctctgtgggcaggggtctgctgagtttggtctggttttcttttctgctctaacaggacagcactgagttcaatgcctcaaaattgttgtcttctcctccagtgtccagagatgctcttcacgccatgctgctgctctcagggtgggggaagggtggtgctggcaattcaggagtgttgttgtgttttttttttttttggttttttttttggagacggagtctcrctgtgtcacccaggctggagtgcagtggtgcaatctcggctcactgcaacctccgcctcctgggttcaagtgattctcctgcctcagcctcccaagtagctgggacaacaggcatgtgccaccacacctggctaattttttgtatttttagtagagacggggtttcaccgtgttagccatgatggtcttgatctcctgaccttgtgatccacccacctcagccccccaaagtgctgggattacagatgtgagccactgcgcccggccaggactgttttttctgtctcttcagtgcatgtttcactgtgatatgaagttaaaaccaggtactgtgagtgcttacctgacttttggttcttatgaaggtgtttttttctgtgtagattgttgttaacttggtgtccttgtggtggggtggggtgatagatggagctttctattctgccatcttgctctgcctctcccatctttcatccttttttttttttttttttttggagatggagtttcactctgtctccaaggctggggcgcagtggtgcgatctcactgcaacctctgcctcccgggttcaagcaattctcctgtctcagcctcccgagtagctgggattacaggcayaccaccacacccagctaattttttgtattttttgtagggacagagtttcaccatgttgcccatgctggtctcgaactcctgagcccaggtgatccacctgcctaggccttccaaagtgttgggattacaggcatgagccactgtgtccaggcttccatcttttatagtagccattctaacaggtgtgagatgatagctcattgtggtcttaatttgtgtttctctgattaatgatgttgagcatttttcatatatctgttggccatttgttgtcttgacagatgtctattcaggtattttgcccatgttttaatttggttgttttcttgctattagagttgaattctttatgcattttggatttaacctcttaccagatgtatggttagcagatatttcccccattccataggttgtctctttgctcttattgtttccttggctgtgcagaagctttttagtttgatataagtccatagtagggtgcttttagacataggcmcagtaacaggagttatgtctgacaatctgacatcaagaatagaaaaattggctaggcctgtagttccagctacttgagaagattacttcagcccaggagtttgagtctagcctgggcaacagaacaagacccctggtttttttggtttattgttgtttttagagatgggatctcattctgtcacctgggctagagtgcagtggtgcaatcatagctcactgtagccttgacctcctgggctcaagcagtcctcctgcgtcagcctcctgagcagctgggactacaggcatgccactaccatgcctggctgagatcttgtgttttaggttttttttttttttttttttttgaggcagggtcttactctgtcacccaggctggagtgcagtggtgcgatcacagctcactgtagcctcgaactcccaggctcaggtgatcctctggagtatctgggactacaggaatgcagcgccacacctagtggtggcgaaacatggagaagccctaatttttttgtatrttttatagagatgggatatcactatgttgcccaggttgtctttctctttaaaaaaaaaaagccagaatgaaagtgaatggtgcagccttcaagttcagtgttttgtattttattatgacaattttgaagaaggaaaaatatttatttcaaagagcctaaaaccaaactcaagcaataagttgtgatttttaaaaaatcgacagatttacttattttgaaaaacaattctatggagatgtagttcacatattatacaattcacccatgtaaagtggacaggctgactttgttttcttttytttttttttttttttgagacagggtctcactctgttgcccaagctggagtacagtggtgccatcatggctcactgcagtctcgacctcccaggctcacgcaatgctccacctcagcctcccaagaagctggaactacaggcatgagccaccacacctggcacattttaaaattttttatagagacagggtcttactatgttgcccaggctagtcttgaactcctgggttcaagtgatctcccaccttggcttcccaaagtgctggggttacaggcgtgacccactgcacccagccaacaggctgattttcaagatagaaaactttgacttgttttaatgcagttccatggaactctgaattaagcaatttttttttgttttgttttttgtttttgagatggatttttgctcttgttgctcaggctggagtgcagtggtgcaatctcggctcaccacaatctccgtctcccgggttcaagtgattctcctgcctcagcctcccgagtaactgggattacaggcgcccatcaccacacccagctaatttttgtatttttagtagagacggtgtttcaccatgttggccaggctagtctcgaactcctgacctcaggtgacccacccgccccggcttcctaaagtgctgagattataggtgtgagccactgcgcatggcctaagcaatgatttttgacaagaattttctcctttcaaaaagtgcttaattgtggcaaggtgagacctgaggtgaagataaaggatgggtgggtatttcttcagaattcagcagaaagatttgccaacctttaagtagacacgccgttccaaatttgtaataatgtaaatgctttctaccaaattgtgtaatgaatatatttgaaatggtgattgatattattaatagatatgtttgacttattagaatatcatttaccaacatttagcaaaatcgagatagaatagcaagggtcattgatgagtaagttccatgcagatatgtaccttcctgtaacatttaccagatggagacttttgggtgtgtgccaaaagtgatgaattaaccgtgaaagaatgtgagacaaatgaagtgtgaaggtagttcaaaggtccttaaagagacagaacagcccactcttgccttcataagatttgctagagaaagaagtaggtgcctagtaaagtatttagggaaatctcagtctggctagtccttacaagaaagaaatcctttgaaaggaatacaatattcataatgtgactgttttaaaataaatttttatatgtttaatatttgtaaaaagtcctcattgagattttcctctcttcatcttattttgccatttctgtggtataaaataggtttttaggaaatttgactttgatttactcgtggaccattgcttaggaatgattaggttgcaaattggggattgtctgtaagacaatggctttttatttgggtgaggactgaagaacacatctcatgataggattattgaataaaatctgttgtttctgtgaatgctgaaaatggcagttggaaaacatatttattgcatttcatcaatgggcctctgtgcattggctattttgaaattgaatttacacatttcaaatggtcatataagcagtcattttgtggaatgaagcataattcaagactgggagttgggctatactgcaagttatgaataagatacacactatttccaagggcctaaaatttctttgttaaacacagattcaaaataactgtaaggaccttctacctatggaacaaatttgcaagaaaagtccaaagactggaattttatttaaaattccttcatttgtagctaatttaaaaatgttactttggactgggtgctgtgactcacacctgtaatcccagcactttgtgaggccaaggtgggcagattgtttaagtccaggacttcgagaccagccttggcaactggagaaaccccgtctctactaaaaatacaaaaagttagcccggtgtgtagtcccagctactcaggagactgaggtgggagaatcacctgaccctagaaggtcagggctgtagtgagccagagatcaggcgactgcactccagcctgggcaactgcggtgagaccttgtctcaaaaaataaaaataaaatgttactttgttttgtggaccaagggaaacatgcctgtgggctagttcgaatggcctagacaaggtagggtagaaaaagtaatgtcttttttttaaccccactcattacaaggttcatggctggtgcactgctagggtctgagtgtttgtgtcgcccagcccccaccctcaccccctcaacatttatatgttgaaacctgaagcccaatgtaacagtaactaagaggcggaggcttcagtatgatgaatacgggggttatgtctaatggcagtacacacggtcgaggggtacttagcaaggcctgtttgttcagattcttttctgtgtccctgtgtctacagagataaagacattcctttcctccgggtataggaacagttcctgaaatgaggctgttaagacctacatcagggaaaggtcagttaggttttatggtctgcttcagggaagaagaggcatggaaacaggaaacaaacttcctgcttttgctgtttcctcaagtgccagcgtgccatattttggagtagcatgtcctgagccctatcaacagcatgcgcgtgattctgaggagaaacaggacacaataccttgttctacaagcttaaaagtgataatgcctagagcgcgtagagataccaaagacctgcagtggggacactgaggaacagcgcgtacaggaagtgatgttgatctggttcctggagcacaggtaggatttagcagtggtgcaatgaggggcatgcatcctgcccagagccggaagcacagtccagttattgtgagcagcagacagttcagtgtgttagcagccttgggctgtggaaatgttccaggtaacaaaaggataaggcaaagctgtccctttattttgtttgagtccctatatacacacaaaaccccccaaaataaatcatataggttaaaggaaactatgaaaatacaaagctgtgagaaagcttctttaaggcatgtctcctagctcatccagaccgatgactcctttgagaaaatttttctgtgtagtggagctgccactattttataggtagtcacccattttatctggggagtcattrggctgaaaataaaacccttgcttgtaccccttaccttaaaaaggatattggcttaggattggacaaatttaaatctttgrtcccttaaattttgttattccttcactggactttcatgttttagaaccatttttacatttctcagtgagtagtttatggggtgtggttggttgactcaaatagaggctactaaacttattcttttaacctttaacctttccagagttaaaatttactgtcattctttttaaacattagattcccgacttaaggtgacacagttataatatttacagtatcatgttgtattaaatgagatggcccatttgtaatatatgagataacctgatacaactcagaattaaatgtacaactgaaaggtttagcattctagtcctgagccatccaaattcgctcagtgacacaggtcagatcacttatgctgaatgacttgctttgttatttgcctaaattagagaagtgtaacttggttaaatacgtgatagggcaaggtttgaaacatacaaacaaaaatgctgtccctcccttcagtacaccgtgtctgatttgttcacttgagtccttagcatctactacagtgcttcacacatagcaggcactcaaatatttgttggttgaaatatatgtaagagagaagtacacctattttttctgtggtcattattagaggcagaaggtgtatattttcactgtttgtttttgtgtctgtgttggggaaggaacaaaccctaaaacctttacccattacagaaggaaagaacattggtacaagacgaactgttcagcaagaatagatttgaatgtctgatctgtccccaagtcttcagatgctgcagatgttaaccatggcctcttggatgccctcacttgctcattcattcactttgattgattcataagatgagcttgagttcatgccagcaagtaagccatgatcttagagggaaaatgactggaagcagatcacagtgcaatatggtgttagaggtattaggatggatagatgtagaaagtacagtgggagtacaaagaagggaagggagccatcatttttgtctgagcaaatggagcagagtcatatggactcatagaaaaaggggtgcttggctgggcgcgggtagctcacccctgtaatcctagcactttgggaggctgaggcgrgtggatcacctgaggtcaggagttcgagagcagcctgaccaacatggtgaaaccctgtgtctactaaaaatacaaaattagccaggtgcggtggcacatgcctgtaatcccagctacttgggaggctaaggcaggagaattgcttgaacccaggaagcagaggttgcagtgagctgagatcgcgccacggcactccagcctgggcaacaaataatgaaactccatcgcaaaaaaaaaaaaaagaaaaaggggtgattgagcttggacttgaggtaggaatgtgtgtttagcagggggaaggaaagaagatagaagggaagcagtccggtaacacaggagcagcctcatcacttcctgtaggctgcagtataggagaggatgtgtgggagggagtgcaaggtaaaactggggaaaaccagaaaccatgagacagctcctgagacagattagactgtttccaaagtgtggttagaacatgaatacattaaataataaataaaaccttcgttccactaagtgaactaaatgttgtatttttatgtaacttaatcatcttcataatgctcttggagagatagacagtattaacatttatagactgagaaactgagatatcaaagtcaggtaattacacgagatgtggttcctatatattattttttaatttcaaaaactatctcaaatatacagaaatttttttttcctaattgatttratagtaagttacccactgccccatcatttctgtatatttagtgcctttgtttttttgtcttaacaaacaaggacatgcacctacatagctgtaatatagctatcaaaaccaggaagttaacattgatccattattaccatgtaattcccagatcccatttaaagtttcaccagttgcaccaataatgcccttcatggcaaaaggatcaatttcaggattacccattgcttttagtatcctgtctatttaggttcctatagcctgggacagatccttagtctttccttgacttttatgacccagaggtgaaaggccaaatgttttgtagaatgtccttaaacttgggtttatctgaggtttccttgtgattgaattcaggttagacatctttgatgggactgtcatagaactgatgctgtgttctaattgcatcttatcaggtgacttatgatttctgyttgtcccattattgatgctgttactttgatcacttgattaaggtggtgtctgcctggcttctccagtgtgaaatttcttttcttctttgtaatattttgtggggaagtaactttaagactatgtaactgtttcatttcttttcttttcttttgagacagggtctggctctgttgcccagcctaaagtgcagtggtgcaatcacaccttacttcctgccttgacctcccgggctcaagggatcttctcactttagtctcccaagtagctggttccacaggcatgtaccactatgcccagctaatttatttttatttatttttttttattttatttattttatttttttgagatggagtcttgctccgtcacccaggctggagtgcaatggtgcgatctcagctcactgcaacctccgtctccctggttcaagcgattcttttgcctcagcctcccaagtagctgggattacaggcacgtgctaccatgcctggctaatttttgtatttttagtagtgacggggtttcaccatattggccaggctggtctcgatctcctgacctcgtgatctgcctgcctcagcctcccaaactgctgggattacaggcatgagccactgcacctggcctatttttattttttaaatttttgtggagacagtgtcttgccatgttgcccaggctggtcttgaactctcggatttaggagatcctcctgccttagccttccaaagtgctgggattacaggtatgagccaccatgccaggccacctattttttttatcacactttaagtttattcatttatatcagtgtgtagtcaccatttcctaataaattataatcttttacttccctttcaagctggcttctgttctcttttgacaagttcttataattctttgagcatgtctagctgacacaagatgttctaggctcatcttgttcttccctaccctgktactagmatcagcgatttctccaagagccctggtttcttagtggaaaagggtgtatacaaaccaagatctgtctgctaagtatgatcaaaggttgtttctcctttcaggctttcttggtgaacaaaggtagggaatatattcatacacacgtacacatttacatgttgtctctctctctaaaagtcatgaattgttcatactgacatatccacttctgatcttaccacaggattcattccagttttctcccttgccccatttgtaacttcttttcctgaaaatgagaaacctggttcctttatccctaacttacttacttagtcaatcctgctctgtgtaaccagtctcccattgctgctgctccctccctctgtgcagatgtcctatacacttgggccctgcctgacatcctgtgctgcagtgactgccacatggacacaccctcctcacttggcttgcacttggttctctttttaagtgtgacacatctacaaggactagacttcgcttataatttgggtgaagctttgcaaagagcaaaagttcttattgaggtcttgcctatctcctttaaccttaaattgcatttttttggtcagtccttctatctaattaattttctttttgtttgttttgtccttaactactatagtgatgaatatatttacctgtgggtattgattctcatatcaatggttatgcacattattattagacagctcgtgatatgttacataaatgttatatgtagtactttttaaggtataagtagtaaagccatatgtttctacaacaacataaaatgcaaagatgttagaccctgcttaaaagtcccatgtgtctgcctgtgatcctcatgattatggattgcatggagtctgtaatcatatcagagtgcccaatagaactagactatcacaaaatttatgattctctgattttaaaattatatcaaagagatcaccattagtgatttagtttcttttgtgtttgttattccttagaaaggtcttttttttctttgaaaaatgcatgaggtttgaaagttactacttaaggccgggctcgatggctcacacctgtaatcccaggagggatttggaaggccgaggcgggtggatcacccgaggtcaggagttcaagaccagcctggccaacatggcgaaaccccgtctctactaaaaacacaaaaaattagccgggtatagtggcagtgctgagatcactccattgcactccagcctgggcaacaaaagcgaaactccatctcaaaaaaaaaaaaaaaaaaaaaaaaaaaaargtaagttactacttaagatcatgctgatattctaaagataacaataacagagtttcctacctgcccgagctatgttcccgtggagatccttcttcaaaaacaagtcactttgttggacaatagaacttcctgaatgttttttattctatgcgcttaccctaatttataggaagctacgtaaatgtggacactctgtgaacaattgtttaatgactcccaaggttctgactgattaaaaagcatgctgactttaaagttctttttcttctttacatttccttttgttaagtctattctactgaagtaactcttctggaagccatcctgtttcactattatttttcagtgatttgggaaacagttgtataggaaaaaaatttatgtctttgcctgtggtacatagaaatttttgtggaattctcattgccagtaagtaccagacagaattcagatatcatctctcaatcgtaatgaatctagtggtcagtgttgcagccatcagtgggcagataactgttcctccaaaagcaagttaatgcattcatttgtctatgaatgaatttttgatagacaatatttaaatattggtagacaagtaggaagctactgaagaagtgattaatctgagtgtaggtatatcaatttgtaaatgcagttacactgcaaagtaatacaactggctgaattggttagatttacacacaaagtaaagcttcagtgatcacatggtaggtgaatgattttatttgagcattctccttgctttgaattctagtctactgttgtcctttgaaccctatgactcttaatagccaagagtgtattatggtaaagaataagtggggcgcagtggctcacgtctgtaatcccagcactttgggaggccgaagcaggaagatcatgtgagtgagcccaggagttcaagaccagcctgggcaacatacagatactctgtctcttcaagaaatgaaaaaattagctgggcatggtggtgcatgcctctagtcccagttactcagcaggctgaggtgggagatggcttgagcctagcaggtcgagggtgcaatgagcagtgattgtgccactgcactccagcctgggcaacagagtgagattctgtctcaaaaaatgagaatgcactagatacacaattttattgaactttctattatrgaaaatttcaaacttatgcaaagtaaagactagtatgacccccatttacccatcatccagctttgataattattaacacatccaaatagttttatgtaataaagatttataaaacgtgtgtgtgtatatatatctatattatatatatattttatwtatatattatatatatatatatatatrtatatttttttttttttttaaatgtagagcctcactctgttgcccaggctggagcagagtggcacagtcttggctcactgcagactccacctcctgggtttaagcaattcttgtgtctcagcctcccgagtagctgggatcacaggtatgcgccatcatgcctgactaatttttgtatttttagtagagatggggttttgccatgttggccagactggtgtcgaactcctggcctcaagtgatccacctgcctcggcatcccaaagtgctgggattacaggtgtgagccactgcacccagcctaggatctcttaatttatcattagtcctggataagaactccagtttggctgataaattttgtgtgctcatcctacagagaagcaaaatggtgttcagacagataattaacttgcccaacttgcttagaagaagcctaacttgggctcattgtttcaggctttcaaaaacttttttctataattattatcatactttattttttagattttcatttatctcattctttagattgaggagggaaggctcacacctgttgtatttactaatccacacccagtacctaactgaacaactgatgtatagagttcattaaatatttgttgaatgaatggatcaaaactatctttatattaggagtctgatttgcatctaaaaatattttaggtggtgttatttatttccttctcatcaagaataattccacggttttctttgtaagtggactcttgccaccagggaaagattgtggactcgatttctgtgagtgtttagctgttaataaaaagccccaactgaagataaaatgtgaaatgattaaaaaaaaaaaggtttatttcctaacctggtagccagttattaaattcctgatagcattgaggagaaataggcacactgataacgagacatgagagacaagttctctgtgttccaggagcagagcaatgttcttttctctaacattcacactggatgagtaatatgggagtgacttgaaggaatgagcatttgtaccgcatgcaagggtttttactctttctagtaccttcattaagggattagcctttcgttctttgaaatgcaaaatctcagttgcccaaaaagcagagtggaaatgagcagcatcctctcttccttaagagaagtggtctttcttctgtcacttaagacattttcctatagttgaggattttatagcaaagagaattttttaaaccaagttactggttaaaaactttttgttgttgttgttggtcttaatttcataggcacataggttagggccaatcactagtcttttctaagcttttattttttaaaaatcgctaatgctttaaaatactgtcaatgtgataggtcccagctgctgattccttcatactaaatgattgttttaagtaagttttgattcctgtttgtctttgattgtagtagttttgttttacttttaaaaattaaattcaataggatcataaagcatgcttttgaccaaatattttgctggtatcttgaattgaccgcagtacaatttagagtctcagaacattttcttttaagttgccttttttcatcctcagtgttcttgttctgacagtgtatcctgtgatttttaaatttttcttcctttctgggtgaagtgacagaattttaaagtgttttttgaaacatctggtgatctaaatacagtttgggggagctttgacctacttagaatggttctttgtgccagagagcatgtttattcccaaggtaactctgctatggaattgcccatgtgaatgcattgagacttgcaacttgccagatcttttattatacaaacacaatgaagcagcaggcagccaagaagaaacgaggaagattgcattgttcttgtacttccttgaattaagaagtttattcatctcagtattttctacaaatttctttgacaataacattgtgaatgaggatttagcagcaacagttgattgcatgtgtgttcattgtcagtatgtttgctctattgaaacacctttatgcattttgttcagtagattatacttatacataaaattttttatttatatttagagcctttttagacatatggctgtatcatgaagtatagtagtatattccttttagatagtttattttaaaataccaggataattgtatttaaacatatagtatagattttggaatattatattccatttctgtgatagcagaatatctatgccatttcttttatctcctcaaggttggatcatttgcagtagactttccctaatcagttcagtattttaacgtacaaaggtatttacccaaaaactagaaaatagagtcccttaagataataagcaggacatgttctgtgcagcttttatgaagactcaaatttgagggtatgtgatttttgttaaaattaaagactttttgtgaaatagaggtgtttttatgtacctttggcctctaggaggcagcatgatctagtctaagatttctgtatcctgaatcaggaaacttagtcctctgtcattttaagaacttccatgtatgaaaatatttgccttctgaatcataaagttatgctataaatgaattaaataatagcagatagtcacagagttctagactagattgttatcctgttattttctttgtgaatacttaaaaagcaaaaggaattattgtgattgctgtagtagtagcataacaatagaaaaagtaatcatttcagtggacgagtgcactttcagtttgcagaccactagtctccatccaaccttctcagctgttgtgtaaaaccctgcaagcattactgtcattaacagctgaagatatctttttctagctgatgtttttgctaaaatagtatgtcaagtgtttatttaaagataacttcaataaaatcttggcaaatattatagctctcctatagttattactaaaagctatctaaaattgcttgaaattcaggagataccttgtgcccattttttcactgtaatagtgtatacttttgctatgtgattagaatgtacccatgtgactattgccataatttgtggctgcaggggaacagagactaggcatgtatttgtaaggggacagtggatgaacagttaccctttagtcaatctatttttctttacttctttctgttttcwtagcacctgagtaatttctatttagtggctcacatgagactactgtagtaaaaggatactaccccttggttgttggaattgccagctttgggagaatttattctgctcaaaactcaaagataggttcagaaagcaaagtaactcgtgggaggatttatccataatcttattaatgagattgatgctgccaaatattatcattaatttaattttggatctgttttgatcaaaatgttataaagttcaggtcatgccctcatgccctagaatgtacttaatctagaaatacttgaccaaagtagtcaaaagctatactgaaagaattgataaatgtttagaaaaattagagctgctgtatatttctaaataattccagtagatcctcttccacaaaaagatgcagtcctttttaaaggaacaaataacctgccgttttcttgtttgagtggtctgtgacttccatctccccttttgtatttgaaacataaaggtcttcagtcagctaatgagctgggcttcttttgctttttctgtaaatgcttatttgaatgtgcattgtttctgtgttgacaggatgatatttgggacaaaatgaaaatgcgagaacaggaactggtgtatcctattctaagctctgtaatgagcaggagtggacttgatgaagggattgagttatttgaaaacctctagattttaaaaagcagaataaggcttctatcctcagttttttatttatttctacattatgtcattagaaagtttcttataagcaaatacataatttctaccaagaaaaacagtgaagttttaagtattccattttaacattgtttataattttttttttaactagaaatcagagatacatatgtgagacattttatagtttarcataagtgtgccttggcttgtttttgtccattaacttagttcaggactgtaacacttgaaataataatgcctaaagatgtcatgatcttaagacgaggaactgtagttactagattttccttactatttaccactgtgtttattttggaactagcttatcttatgcatgccacaagtatatgtcacaaatacactgcagtgtgcaaggaaaattttaatatctaattgctagggtcttttgcaagaaaagacagtttgtccttggtttattaaattagtatggaataacatgtactgttaacagtgtttattgagcttctgagatgtcttcagtggactcagaatacaaggattgctttytgtgggtgtgtgtaaatgtgtaaataaatgtttactggactcttactaaaatgatcagtttatcaggtactattaaaaatattacatggttatttgtgcctggaacagtatgtagcatataaaaatagaatgcaaattgcagtggaaaccagaaacagagtccctagggctgaaagggaccttggagagtatctggtgccttgatcttctagctctgctctaaggagcttgggtgtggagttctgctactgaaattaaataattaaataattaataattaatgacaggattgttttcttttaattaggtaacataatttcctcatttatgatttttcactttttttttttaattttcattattttctaccatttctctgcttgggagtacgagcctgaattcaaagtgaaataacaggtacaaatgaatacagattaagagggaaacctcaaacagccaattttttttgtagccttgtatgctggtagctgtgattttttctttgtttttctttttttttttcctatttgagacaaggtctcattctgttgcctaggctgaagttcagtactgtgatcattgctcactgcagtcttgacctccctgggctcaggtgatcttcccacctcagcctcctgagtaattgggactacaagtgtacgccaccatgctcatttttgtgtcttttgtgttttttttgtagagacaggattttgccatgttgcccaggctgctcttgaactgggctgaagtgatcctcctgccttggcctcccaaagtgctgagattacaggcctgagccaacgtgcccaggctgattttttaaatttctaatatatataatatggttgaattttccattcataagatatcccctgtgtgtgatagaactgaacttagctggtaaatcaatattttattttatcccactgaaacgtgttatgcaaagatcatcgtttgttaatttcaagtgctccatcgcccataacaattattggaactagtgatttggtccagtaatctcttttactaattaggcccagagagattgactttcttaaggttacttgacaaattagtgatagggtccaggttgtattctgtggcttataactttacattcattgttctagatttaacagcaatacttcacgggtacaactgaatttggagggagtttttgttttaggaagcattcacccattctgtagggatacaatcctcatttttaccaaagaggaaacaggctcatagagtttaaaggatttgcctaaagtttttctaaagtttctccaatagttagaaaagaagccaggtcttttcattggaattatcaatcctttcctcatgtaactggctattggtaggaggaaaattatcaacaggagtgatgataccttcagaaatctcttgagtcaacaacttattagaattaataattttgaagtatttagacagcaggaagagttgggccagcaaagattattaatttggttggcaaattgtgtttatttgggatgtttgacactgcttttttttttttttttttttgagacagagtctctcgctctatcacccaggctggaatccatcgatacactctctgctcactgcaacctccacctcccaggttcaagcgattctcatgcctcagcctcccaactagctggggttacaggtgtgcgccaccacgcctggctaatttttgtatttttagtagagatggggtcttgccatgttggccaggctggtctctaactcatggcctcaagtgatccaccaccttgacctcccaaagcgctgggattataggcatgagctactgtgtctggccagacactgctatttataaggatcataaaatgtaaatttaaggcactcaaagatgcttctgcatttggatttatctccttcaaaaataaagatttgattcttttgtgctattcctgaaataaaaatacaaataaaataaaaacttaaaaaagatttgaaaaagaaatgtatttaaaaatctaaaagtgtttacaagtagattttcttttttttttttctaaatttctagacagggcctcactctgttgtccagtctggagtgcatggcatgatgacagctcactgcagcctccatttcctgggctcaagcaatcctctggcctcagcctcctcagtagctaggactacaggcatacggcactgcatctggctgattttttttgtttttttttgtttttggagagacgtggtctcatgtttcccaggctggtctctaatttcctgactcaagtgatccccccacctcagcctcccaaagtgttgggattataggcatgagccaccatgcttagcctacttgattattattatttagggagacgaggcctttacagtcacaaataaaatcagaagtatcacagagattctttgaagtctgaatttacatccactgttattatgtatgaactttacctgacattttatcatgccttgagatattaactagtattgtgaagccaatatttaaaactacttttcattttatctttgtgtcatcttattaaaagtgctgtttttggccagacatggtggctcacgcctgtaatccgaggactttgagaagtcgaggcgggaggtttgcttgagcccaggagttcgagaccagcctgggcaacatagtgagactttggctttactaacaaaaataaaataattagccactggtggtggtgcgtgcccgtagcaccagctacttgggaggctgatgcttgaggttggaggatacaaggctgcagtgagctgtgatcgtaccactgcactccagcctgggcgacagtgagacccggtctcaaaaaaaaaaaaagaagaagaaaaagctatttttgagtattttataatataatagtagagtrgtacatgtatagaatttataagtggacatatcctggagtggagagtcaaaaagtcaatggattgcatgatgaaaacttgaaacaacttagagaaagatgctggaaaactaaggcaaagaaagattggtcatttgaggattggtttagattctagtaggtaccagtgattatatgatttcctttgcatatgttatgtgacatgatgttaacaataatcttctgaaataaatattgccattttatagtcagcaagactgaggctcagaraagtgtaataacctgcccatgcgcacaatcactgtattgcagattctgtatttcagcctcagtcttctacctaaactctttctacatactgtttctattgaattaactgggcatttgaaaatgccattagctgagataaagaatacaagtaactgatattctccagattactagttgaattttttataaggatgtatttgtactaaccctacttgagacatcttatacatatatgatgtgtgctggttgtatctgtggtccataacttattcatcatgttgaaagttaatattgattcttctaagtttgtgttttataacagaatattcggttatgacaaattatttttcctttgggaaaatatcatattttaaattaagataacgcacaaaaaaccataataactatttaagcaattaaaactggtataaatacaaaattttctgatttttctttttcacccttttcagatgagagttttcatggtcctgtatgattcatgatatcaccaagctctagtaacagaagtgttgattgaaatgatttcttcagtcttaggagctcacatgttatagaaaaataccacaatgcttaagaggcttttacctgaagagattagtagtaacatttccatttattcatctttttttctacttcttttgacatgtttttgccaggtagtttatttaatgtgaatttagcagaagtggaatttgaatccacgtatttgcacagagcactgaaagctcccttaaagcaaacagaagaaggcttccagggagaatttcaagaatgttgtacattttaaaaatataagtctctgctgtgctctgttcccacagtttatgccctttgccttgtgactgttatcctttcttttcatctttgcatcagtttgtttgtttttgttttttagatggagtcttgctctgtcgccgaggctggagtgcagtgccgcgatctcagcttactgctacctctgcctcctgggttcaagcaattctcctgcctcagcctcccgagtagctgggattacgggtgcccgccaccacgccaggctaatttttatgtttttagtagagaygggctttcaccatcttggccatgctggtcttgaacttctgacctcgtgatccacccgcctcagcctcccaaagtgccaggattacaggcatgagccaccgcgcctggcttttgtaacagttttaaccatgaccttttaagttatggatttagtttggtttctgcataatatcaggtggtttatagcaagtaaacactgtatatctgtaattggaaagttggtgggaagattacttttccattcttgatgtggcagccttaagtgccatcacagcttgttctgtggtttgccttttttttgcagtgacctcagctcactgcaacctccacctccctggttcaagcaattccccttcttcagcctcccaagtagctgggatttctggtgcatgctaccaggcctggctaatttttttttgtatttttagtatagacagggtttcatcatgttggccagactggcctcaaactcctgacctcaggcaatctgcccacctcagcctcccaaagtgctgggattataggtgtgagccactgcgcccagccgactttcaaattttttaaccacagcccagtgtaacactgtgtgtatgtgtgtgagtgtgcttgtatgtgtgtttgaaataaaatttttcatgtgcttatacattctgatttttttttatcagaaccactaatgagatgagaccatagtttgtaaaacctcatgccttagagaaaaagataagaagacattttctttttaggtttatttttctgtcttaactgaagaccttccaggctggcaatatccaagggccagattcaaagtgaraaggttatatacctcttgaaatatgtaaggttggatgattagaccttgatgcttaaaatagtgctttcagggcagtgaaattttcatcagctcaccccacatttacttgtgccattgccgtaatataaaagcagtgagaacaacaagaaaatgcagtgtaagtactgtacatcatggcaaatattcttgctaaaacttctgctcaccctgtatttcttttgtggggggattttaagctaatttcttgcaatttttagatcagtgggcttgtgttaactcacatcacttagagaatacacttgatacaactttagaaattcaagtgggagctcttgaatgaaaactgctgcctcagatgctgactgaactgggcaaccagtgttgaacaggtgccttcttgtttataacttggtgtgtatgatctcacttgcctcctcataggtagctgtgagacaagatggaattttcttctttattcaaaacaataaccattaccgaaaaacaagcaaacaaaatccaagagctgagatagcttgttctaagtcacatgcgactagtagaaaagagtaaaacttcaacccagatgtggatttcatattgaagatcttaaaacaaaaaccccttcactatgtaattaagaatgtcaagagtcacctttgttgtggattaaaataccaacttttggggcaacagattaggttacagtataatgcaataaagtatcattcagttttcattgtttaaaggtaaataacgtattcttcttgactttgagcttcagatatctaaaatgccttcatttggagaaacattgatacagtccccacaaatatatattttttaactctgtgcaatgaacatggaagcctgggtaaatgtccctgttttatgatgtgtcttcactgtttttgttcttggaagcctgtgaaatagggggagcaggtggtgccattattggcaaacctgaggttgccccaagaaacttaggctccaagtttcttttaacttttgtgtgagaattgaaatgagaactcaggctttctgaccactgcccacttctttgaagaagcattagtccatgtgggcagaaaatgaaatgttgtggttaaagacaagagataaaaaatggcagaagragatttatttgctatttatttgctacttggatttagaatgtagccttgtgaagactttgtcagtgttgtataaagtgatcccatgaagaaagaattcagtaaaattctaaatttagaagacactgatttcacgtagccactaagtagacaactcagtaggtagaaatattctttaaaattctgatttcctttaggccccaagtttcttttaatgtttgctaagcacttatttgcatgtgtcccagtgaaacgttatgtatgtacatactggattagtcatgtttttgtttttttgtttgtttgtttgagacagaatctcactctgtcgccaaggctagtgtgcactggtgcaatctcagctcgctgcaacctccctcttcctgggtcaagcagttctcctgcctcagcctcccaagtagctgggactacaggcgcgcaccacttcgcccggctaattttttctgttttagtagagacagggtttcaccgtgttgcccaggctggtctcgaactcctgagctccagcaatccgcccacctcggtctcccaaagtgctaggattacagacgtgagccattgcgcccggcctagtcatgttttataattgtttttggccccaaccacctgaagtttgattccacaagggattaaagaaaaaggacaaatgcacatagggtatttatagtatatgctcattgaaaggctgattgaataataatagaagaataagaatggataaaatttattgagagcttctatgtactaggtagtattcaaggtgttttatgcattttatctcagaaaatcttgtctgaagatagatgctattaattactccaatttttatagatgaagaaaccaaagcagaaagaatacaagttaatattaagggtcatagtttcataaatgatagagcaagtgtaatgtgacttacatcctgtgcttctaagaactatgttatgctggtcccttataatagacattaaactaagagttactagaaaatgggtcctaatcataattttatcattaaagttcgagcttgtacaagtcacttaatctctttttttgtttcgtcatcctaaactgtgctgttctacctacaactccagtttgtgattaaattgtgatgtaatagggattaaagccagagaagagtagtggctataggctaggatacattatggaaattagaggaacaggaggagtaaaaacaatagaaagtgttaaaaaatgcagttgacttttgaacagctttggggttggggcagtgacccctgttgagctgaaaattcacatataacttttgactaccccaaaatttaatttactaatagcctactattgaccagaagccttactgataacataaacagtcgattaatacatattttgtatgttttatatatatatataatatactgttttcttccttgtcttaagaaattgccatagcccccccagccctcacctttaacagccaccaccctcatcagtcagccgccattaacatcaaagaaagaggctgggtgcggtggctcacacctgtaatcccagcactttgggaggctgaggcgggcagatcacgaggtcaagagatggagaccatcccggccaacatggtaaaaccccgtctctactgaaaatacaaaaattagctgggcgtggtggcgcacacctgtagtcccagctactcgggaggctgaggcaggagaatcgcttgaacccaggaggcagaggttgcagtgagctgagatcgcgccactgcgctccagcctggcgacagagcaagacaacgtcttaaaaaaaaaaaaaatcaaagaaagaccctccattagcagaaagagtattacttactgaagacttagatgatcgttgtattttttagcaacaaagtgtgtgtgtgtgtatttgtgcatttgtttgttttttgagacaggatcttgctctgtaacccaaactgtaatgcagtggtgcagtcactggtcactgcaacgttagcttcctggtctcaagtgatccttctgcctcagcctctcaagcagctgggaccacagtcatacgccaccatgcgtggctactttttaaatttttgtagtgatggtgtcttgctatgttgctcaggctggtgttgaactcctggcctcaagcaatcctcccacctcggcctcccaaagtgttgggattataggcgtgagctactgtacccagcctaaagtatattttaattaaggatgtcgattgttttttaaaatataatggtattgcacatttgccaaactacagtgtattgtaaacataactttaacttttatatgtactaggaaatgaaaaaagtttgcgactagctttgagatattcactttgttttggtggtctggaactgaacctgcagtatctctgagtgtgcctgtacatatacatataaaaaattgtatcataaggaattaactcatgagattatggaggctgacaagtccaaatctgcagtggggttggcaggctcaagtcccaggacagccaatgatgcaaaacaagtccaaaggccatttgctggggaatttgctcttgcttgggaggctggtctctgttctgttcaggcctttaactgattggatgaggaccactcaccttatggagggcagtctgctttgctcaaagctcactgatttaatgttatccaaaataccttccaacttgacatataaaattagcaatcatggccgggcgcggtggctcacagctgaaattctagcactttgggaggctgaggtgggtggattgcttgaggccaggagttcgaaaccagcctggccaatatggcgtaaccctgtctctactaaagatacaaaaatcagccaggcgtggtggcgcatgcttgtaatcccagatactcgggaggctgaaacaggaaaatcacttgaagatgggartgggaggttgcagtgagccaagatggcgtcactgcactccagcctgggcaacacagcgagagtctgtctcaaaaaaaaaaaaaaaaaaaaaaaaattagcaattacacctcctacggaatgtggtacaggcaaggcctttttagagggcatcrgccttcaccaccctactcccagagcttctctccaagcccagcatttttagctacatttttattgcacatatattttattaggtagaaatatattttattaagtaaaaattctaaaacctatttgaaccaaataaaaataggcaagaaagcatcctattgtgaaacagttacaaatgcaaagaatttaggagagtggtgagttaagaggatgtgggtagagtttattataattgtgtggattgtcacctgtcatgaggattacagtttggtaaaagaaaaataaacccttttttcattttgagcctggaatgtatgttactatacayggtgcaataagggccttattagatctacaggaaaattctgtctccattctaagggagagtggcttgtgggaccttaggaaccctggctctactacccaaccattggacaagtcttacctcttttggatgctgctaactcttcagaagaattccttgtggtggtatataacttgttggttgaagaataaataaataaaacgtaattaaagtctatatagcagctactgtttaaccatattgtctcatataaaccttgaaaggagctaataaagtggagggcatagttatattactgctcttacagaaacagcaaccacaattttaagtcttctagtcagtgtaggacagtgttttatacataggtgcttaatataaatatttgatttaaaaccaatcttgtatttttttaattgttttctttcttcccttccactggtcttctttaattttaacttttggccgggcttggtggctcacgcctgtaatcccagcactttgggaggccaaggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccacctcagccttccagtagctgggaactacaggtgtgcctcactatgcccagccactgcttaactctgattttatcctcaatcattgtctactgtargatgaatgctgtattttttttttttttaattctagagaggaaacctttctgtagtgtaacttgcaaaagagttggtgtttttctttctcagtgatctcttacagcaaatgttcattaattaaaaatagctgaccgacacaggaaacagctcatgtagcagcttatgatgttgttctaaaaacagacttgagctctcgagtgctagagaagcatgaatattgaaaacattgcaaacaaattcaggtaaaagtatggtgtgttctaagaaggatctgtgtgcctttacgttaatattttttctgattataaaagtcgtgtgcttactgttaaaaagatattataggcctgggygcagtggctcatgcctgtaaacccagcactttgggaggctgaggcaggcagatggcttgagtccaggaggttgaggctgcagtgagctatgatcgcccaactgtactgcagcctgagcaacagaatgagaccctgtcaaaggaagaaaagatattgtaaccatgtattttgtagaaagtgaagttctcacccaagttatagcatttatttattctggtggtttctttttttgttgtttttttgagacggagtctcactctgtcacccaggctggagtgcaatggcacgatctcagctcactgcaacctccgcctccgagttcaagcgattttcctgcctcagcctcccgagtagctgggattacaggcgcctgccaccacacctagcaaatttttgtatttttagtagagacggggtttcaccatgttggccaggctggtctcgaactcctgacctcagatgatccacccttatcagcctcccaaaatgctggggttataggcatgagccattgcgcccggcctattctggtggtttctatcggatttttaaaatacataygcaaacagtatatacttattgtttaaatggaattatactrtttattcaacttgtttttttatttatatatactagaaattttccacagaaatcttttaaaattccctaatttgttatcttttatttatttattgagacagagtcttgctctgtcgcccaggctggagtgcagtggcgcaatctcggctcactgcaacctctgcctcctgggttcaaggaattctcctgcctcagcctcccaagtagctgggactacaggtgtgtgccaccatgcctggataatttttttgtatttttagtagaaacrggatttcaccatgttagccaggctggtctcaaactcctgacctcaggcagtctacccgcctcagcctcccaaagtgctgggattacaggcgtgagccaccacgtccggccatttgctatctttttaaagacaacatagtatttcactctatacctagactacagtttgtttaaaccaattttctttttcttctttgttttttttttgagacggagttttgctcttgttgcccaggctggagtgcaatggcataatctcgactcatcgcaacctctgcctcccaggttcaagcaattctcctgctttagcctcccgagtagctgggattacaggcatgcggcaccatgcctggctaattttgtatttttagtagatatggggtttctccatgttggtcaggctggtcttgaactcccaacttcagatgatcttcccgcctcggcctcccaaagtgctgggattacaagcatgagccactgtgcctggcctaaccaattttctattaatagacttgtgggttgataatattttatttaaaaacttttttttycctgaaagtcaccatttttagagcagatacacttgtcattgaacaaatatgtagtaatttaatagtataatatattcacattttactatgtgtctggcagttttctaagaattatcctgtgcgaattagaataattctacaaccttatgagggagttgctatacctcttccagagtttcagaaagcctccaagttccatatatgccatctcgaccctccataagatggaccaaaagacagggtgattggatcagacatgtgaggactcctaaatccaaaggagcaggcataaggcagcagctgcctcagtacaaaaaagcagagcttacaagtttttgctggaagtattgatgccgaagtattctctcgttgccatgacaggtttcagaagaactgctttcttaatccttctgactgcttcgaagttttcttttttctttttcttttttttttttttttttgagttgcagtcttgctctgttgcctaggctggagtgcagtggcatgatcttggctcattgctcctgggttcaagcgattcttctgcttcagcctccctastagctgggagcacaggtgcacaccactacacctgggtaatttttgtatttttggtagagagagggtttttccatgttggccatgctggtctcgaactcctgacctcaggtaatccggcctcctcagcctcccaaagtgctgggattacaggcgtgagccgctgcgcccggcctgctttgaaggtttccttgtctcttcccaccaattgtttggtgcctgtgtagtccttgctgacttccacattctcttgtgaatttacttgatacacagggctttgccttagattgggctgtattctggtctgccatcaagagatgtcagctaatgctgacatgtcccatccttgggtgttctttcttgatggcctccatagctgtttgttgttttctgttgaaaatggaaacttgaaatatttgttattaatggcttagaccctgtgatggttaattttagatgtttctctttctctgtctttccattcttctcctgtccttggacatcggaaccccaggttctttggcctttggactaattaggggcctgccaaccttccccccaacccccacaccaagctctcaggtctttggcctcagactgagaattacatcattgccttccttggttctgaggcttttgggcttcaactgagccaggcactggcatccctgggcctccagcttgcagatggccagttatgggacttctgggcctccataatcacatgagccaatttccctagtgaattccctctcatccatccrtatctctctctatctgatctatatcctatttgttatgtgtctctggagaaccctgactaatatgtactgtagaaaagcctcctgagacttagacgctatgtttcctttgtttaaatgttgttgaattgatcataggtataatgcattagatttttcagaagaaagaaaaggtttattccacattayatctcttcagaagcctacccaaaggggatatctgttttggctatttattgcagtgtaataaactactctaaagcttagtagcttcaattagtgatttattatgtctcatgattcagtgggctgaccaagctgttcttctggttcatgtggtgttggctaggtgctggaatggctgtgttcctctgagacttggatgggtgctcagctgggacccggtggctgcttgggtcacttgtggagtggtatctggattccaacagggaggcagtggatgctacccacacagttaaggactaggcccagaaccagcacagcatcatttctgccatgtgttaatggtcaaggcagtaataggcccagcctacatcagtgtgggaagtgactaaacaaaaatgtaaacacctagacatgtggttcattggggatgatcaccaaaataaccactgaccagagtgtgctctctggcccttcacacatgcacgatagagcagcccatacaagtctcactcactccattactacatcagcttgacaggtctaggatctcatcctctacatcaggtccaggtgaggctccctgtgagaggtgacagtgtgctggcagtcctcagagccctcgcttgctctcggcacctcccctgcctgggctcccactttggtggcatttgaggagcccttcagccccccactgcactgtgggagcccctttctgggctggccaaggccggagcccactccctcagcttgcagggaggtgtggagggagaggcacgagcgggaaccagggctgcgtgtggcgcttgcgggccagctggagttccgggtgggcgtgggcttggtgggccccgcactcggagcagccagccagccctgctggccccgggcaatgggggacttagcacccgggccagtggctgcggagggtgtactgggtcccccagcagtgctggcccaccggtgctgcgctcaatttctcgctgggccttggctgcctttccacggggcagggctcgggacctgcagcccgccatgcctgagcctcccacccactccatgggctcctgtgtggcccaagcctcccggacgagcaccaccccctgctccacggcgcccagtcccatcgatcacccaagggctgaggaatgcgagtgcggggcgcaggactggcaggcagctccacctgcagccccggtgcgggatccactaggtgaagccagctgggctcctgagtctggtggggacgtggagagtctttatatctagctcagggattgtaaatacaccaatcagcatcccgtgtttagctcaaggtttgtgagtgcaccaatcgacactgtatctagctgctctggtgaggacgtggagaacctttatgtgtagctcaaggattgtaaatataccaatcggcactctgtatctagctcaaggtttgtaaacacaccaatcagcaccctgtgtttagctcaaggtttgtaaatgcaccaatcgacactctgtatctagctgctctggtggggccttggagaacctgtgtgtccaaactctgtatctaactaatctgatggggacgtggagaacctttgtatctagctcagggattgtaaacgcaccaatcagcaccctgacaaaacaggccactgggctctaccaatcagcaggatgtgggtggggccagataagagaataaaagcaggctgcccgagccagcattggcaacctgctcgtgtccccttccacactgtggaagctttgttcttttgctctttgcaataactcttgctactgctcactctttgggtccatgctgcttttatgagctgtaacactcaccgcgaagatctgcagcttcactcctgagtccagcgagcccaggagcccactggggggaaggaacaactccagacgcgccgccttaaaagctgtaacactcaccgcaaaggtctgcagcttcactcctgagccagcgagaccacgaacccaccagaaggaagaaactccgaacacatctgaacatcagaagggacagactccagacgcgccaccttaagagctgtaacactcaccgcgagggtctgcggcttcattcttgaagtcagaccaagaacccaccaattccggacacacctgggtgcagctcatctcaaactgaagacctatgaattaaaagcacacgttattttccgttcttccccactttccaccccaacatataatggtaaggcagggacaggaaaattacatcagatattcctcttcaaaaagatattaggagctgtggaccgggcgcggtggctcatgcctgtaatcccagcactttgggaggctgaggcgggcagataacgaggtcaggagatcgagaccatcatggctaacatggtgaaaccctgtctctactaaaaaatacaaaaacttagccgagcatggtggtgggcgcctgtagtcccagctactcgggaggctgaggcaggagaacggcgtgaacccaggaggcagaggttgcagtgagctgagagcgcgccactgcactccagcctgggtgacagtgcgagactctgtctcaaaaaaaaaaaacaaaaagtattcggggctgtggagaaatcagagccctgacacactgctggtagaaatgtaaaatggtacagttgctttggaaaacagtctgggtagttctttgaaggttaaacatagagttgccatatgacccagcaattctgtacctagacatatactcaaaagcaatgaaaccatagttccacagaaaaccttgtacatgaatgtttatagttgcaatataatagccaaaaggtggaaacaactcaaatgtccagctgatgaataggtaaataaaaagtgatatgcctgtatactggcattcttttggctgtacgaaagaataaagtactcctacctacaacatggatgaatcttaaaaatgtactaagtgaaagaatccagtcacaaaagaccatgtgttgtatgcttccatgtatatgaaatgtcccaaagagccaaatctatagacagaaagattagcgttgcttaggctgggagggctggaatgggggaaggtgatagctaaaaggtatacggttctttttgggttgggagaggtggctcatgcctgtaatcccagcaccttgggaggccaaggtgggttgattgcttgaatccaggagtttgagaatagcctggacaacatggcgaaatttctacaaaaaatacaaaaatttgccaggcatggtgtcgtgtgcctgtagtcccagctactcggaggctgaggcaagaggatcgcttgagcccaggaggttgaggctgcggtgagccgtgattgcacccctgtactccagcctgggtgacaaagccagaccctatctccaaattaaaaacaaatttatttttggtgtgatgaaaaggtctaaaattgatggcgggtatatgtatctgtgaatatagtaaaaaccttgccattgtaaacttatttaaacagaaaaaagcagcagatgtgactgggaggcacatgaccttcactggtgcatagcatttctgacatttagctcgatctatatccttgttgaggaactagttcactacctgggtgcctctctttggccctcatctccatcccctaggctcttggctgtcttctgattcttttccacaagaaatggcctgtgttttttggcgtcttcctgtccgagtagggtgctagtatttttcatttttaactggctctattagtccaagctgatggtgtttccactggtatatttctctgaaatgccttttgggttttaccatagatgtcttaggggttcacaacattaggtaaaaaatactcccacaaatcgttttaagatagggctttctttaccttggatgcctttgtatcagactgtcatgtgaaaataaccttttattgtcaaaagctctactgtctggtttagttggtactcaaagcacccacttaagattctttaaagccttttggtctagttatgtgattccaaaagcacgggtgtctgtaccagcagcatttgtatcacctgggaacttacagttgaagtctccatcccagactttctagatgaaaaactgtgatgatccagcccagaaatctaggttttaataaaatctccgggtgagtctgatgcatacgaagttttagaaccactggtctaagagaaagtccatgagcaaccacctaacatcttcatgaggtctcaaaaaaggatcttaccaccacatcctagaggctctactttactgctagcactggatttgatctttgccctaaggccatttcttattttgagtggttttaagcttagttactgaaaagaggaattgttttattttttaacccatgaagtccaacttctttatatttcctctgaattctgcttaaaaaggaaccaaacagttcctttttaaattcatgtcactactcctatattttattgtaggcagctaaaaacaagccagttggcacttttgacattcttcttggaattctccttagttgggtgcatgagttcattaggtaccctttctgttctccatgttactgtatgaaacgggtctgctgctttttcttaggtctccatttcttcagccaccagtaacatttctatactgtttttcaaatctttaccagcagtcttctagctgttgtctaccacctggacccaaaccgtacatattttgagtttttgttatagcagagcctcctttctgataccaaattttgttttggttatctattgttgcataattaataatttcaaaatttaatggcttaaaaacaagtattttctcacgcatggtcttgcaatttggccagagtttggtaggaatggcacatctctgatctgtgtgctgacagctcgattagatttatttccaagataccttaattatatgactgtcgagttggtcctaccacctgaggttttagttggaattgtcaactgggaccttaattctcctccacgcagccctttctgatgcatgttctgctttgaccttctcacaatgtggcagctagattccaaaaagcaggaagcagaagttgccatgcctctagctaggtgcagggctatgtgcctgtaataccagctactcaggaagctgaagtggatggatcacttgaggccagcctgggtagcagtgagaacctgtttctaattaaaaaaacataaaagaaggtgcctggcctcttaaagattaagctcgcatttggcatacagtggaatttctggtcttttctgctggacaaagcaatcatatacctagctcagattcaaggaggtggagaaatagaccccatctcttagtgggggtagtggcagaagttgtggctgtcattaatccactgtaatctgtgagctgtttttctttaacagtactgaaaagacactcttggcttaaggttatgagttggtgaaaagtaattgtttactacttgaaaaatgaagatctggccaggtgcgtggctcatgcctgtaattccagcactttgggaggccaaggcaggcggatcacctgaggtaaggagttcaggaccatcctggccaacatggcgaaaccctttctctactaaaagtacaaaaattagccgggcgtggtggtgggtgcctgtaatcccagctactcaggaggctgagacaggagaatcgcttgaacccagaaggcagaagttgtagtgagctgagattatgcactgcactccagcctaggtgactagagtgagactccgtctcaaaaaaaaaaaaaccttgaagatctggaaggaggtagcaagaaaacctttccatataaagagcctctcttgatatcagtttgttgaagttttattttaatatggaacacttcacgaatttgcatgtcatccttgtattctctctgtcattccgattttagtatatgtgctgccaaagtaagcaccattggaagaaattttaaatggtgtatttcacagatggacagaagtcattttaagttccttgccaacagagtaacactctccagcaccattggttgtgtcaaagtttgtgtgtgacaggaaagtgtgaatgtgtttatacatcttgatcttaccagtgaacggtgtattttttttaaaataaagcttgtcttatacactactaagtgtagagaaagagtccccttccacacactcccctcctcaaaatagaaccagatgctctttaagagttgtgaacaatgaaaggcataatctggatgcattgtagaaatgattgtggtaaaccaaagaaggaataatgggatgacagaagcccagggctttctatcacttggaacttttgtggtgcagctgtttgtagattggtaggagacgacaaaacagatggcagcagaggttgcctctgcctttgctcattcactcgagtcatctattaggtttgctcagacaggatagtaaatggcttcctgaatttgtgaagcacttaggctagtaaatttctccatatctaatttggagttctgtttagaaaaaaaatatcaaattaatgccctgtgacaacagtgattcaacagagtttatatccatctttcataggatctgattagtattaagtctttgacctttattttcttttttatcgtattgttgtacttttgatttaatgcttttgtttctggttatacattttcttgatagcatcagtaagttgttggtaagtattgaaataacttaaatatttttcttcaatgtgattgtgttttttaatgagacagagtctcactctgttgcccaggctgaagtggagtgccacgatctcggctttcactgcagcctccgtctcccagattaaagcaattgtcacgcctcatcgtcctgaatagctgaaactacagttgtatgccaccacacctggctaatgttttgtattttttgtacagatggggtttcaccatgttggccaagctggtcttgaactcctgacctcaggtgatctgcccaccttggcctcgcaaagtgctgggcttacagatgtgagccgttgtgcctggcttcttgttaagtattgaaataacttgaatatttttcttcaatatgattgtgaaaatatttgggatagcacaagcttcccttagttgcttgtagttttactttcccacacctgagtagtttgcaagtgtgattgactttgtgcttcctcctttttctctctttgttcttccatttatgttttaatcttccgtcctcctcataccttaccaagtctggttgagtaacatatttaggaatgatcttatgggtagtgtggttgaggcatgatcacaattatgatccgtggcatatgaatctgcatgaagaatccttccagctccttctggatattctccatcccagtgtcaaacttccatggcacgataccattaccaaccatttcagcaacgatgcccacactgttggtttctagagattatttacttctgtatctgcccaacttataactccgtttgctttgggatatgctagatacttattaatctgtcaagtaattattgtatgtgaactagtaaaatgttaactaggagatacagaggtgaacaggaaatgttcactgtaattggctccttggtcttcagtcttcacaatttttcacagtcagatttgaaagctgaatgtagttttctgaaggcttggagtacatacttgtgctatttgaggaggtctctgagtttttttggtgctcttgcctcacaactatacttaatcatatttaataggaccttgtttcatttcctattaaatatga

SEQ ID NO: 17677 - DNA, 29517 bp, Homo sapiens
gaactacgatggtgccattgcactccagcctgggcgacagagtctccgtctcttaaaaaaaattaatggaatcatcccaaaatgtaatcttgtgtccagcttctgttgctcaacattgtttatgagattcaccatgttgcaacatagtagtaatttgttcatttcctttgtagcacagaactccggaatttacatgtactctaaacatgttcatccattctactgttaatggctatctgggttgtttccagtttggggctactaggaagactgctatgaatgatatcgtaaatgccttttagtacatttatatatttatttctgttggagacatacctaggggtgtatcttagttcgtcctctccagaaagcagtgcctggggcaaaagcttagaaggtacttctgtttcgttttgtgtttttagagataggatctggctctgtcatccaggctggactacagtggtaccatcatagctcatcactgcagcctcaaacttctgggctcaaaggatcctcctacctcagcctcctgagcagctgggactacaagcatgcactaccacgcccagctaatttttaaattctttgcagagatggggtctcactatgttccccaggctggtctcaaactcctggcctcaaacgattctcccccatcaacctcccaaggtactgggattacaggcatgagccagggtgcctggccttaggtagaacttaactgggggatgcaattgcagggaagcaagagtaagggggaaaggaagtgaacagggatggcatgagagccaatatgagggtgagtttcagagttggccaccacttggtgccaaaggcagctgatgctgaatcttgtagtaacatcttccaagaggtttttataaggaatatgattcataagggtccatctgggatgaggtagagggaagaatttatccactgactcccatctgccatttatccatctgccattgtccaagtgagataggagaacagggaaaatgaggcaggaaagtagcaaagggaattgaaagttggataaagggcagaataagtaaaagcagagagcagaagaagcaaggtgaaggggcaggtgagcaagaagccagacaaaaagcagaggttcagcagccaaaacaaaagtaagataaaaaagtgagcagggccgggtgccgtggctcatgcctgtaatcccagcactttgggaggctgaagcgggaggattacctgaggtcaggggttcaagaccagcctggccaacatggtgaaacccactgtctactaaaaatacaaaaattagccgggcgtggtggtgggcgcctctaattaccagctactcaggaggctgaggcaggaaaattgcttgaaccgggaggcagaggttgcagtgagccaccgagattgcgctaccgcactccagcctggatgacaagagtgagactccgtctcaaaaaaaaaaaaaaagcgagcagtatcccatggccggcaggatcctgaccaaaccagtaaggggctgcgcttcagagatgggcatgtgcattggagagaaaaggtatccttaacataaccccgttatgataatcagctacttaaggttcatgcatatgagctgcatatcatgtatgtacttaggattatgggatggaggcaaggtgcaagcgcacgggggccaaagtaactaagcaacacacctgtcaatcaaaaagatagacactggctagagattaggcagccttgggaagagggggaaaaaaacaacatatagaaagacccaaagtacaccaaactaatgccgatctcatctcacaaagatcagtccactcttcctctccaagagtggaatactgcacttaatacactttttgctatctgtatatgtctcttccaattctttgttcaagtcgcccagatcctggaactgtgtggcaccattcagtaacacaaggataggcccgagtgtgctaactctcctgcatttctgattgcaagtttgtgggtgccagattggtcccttattatctcattcctcaggggcatcagagaatccctgagggtgatggggggtgctggcaggttgtacctgcacctgaagtgggaggaaaggtggcaaagccttgacaccaaggtgaggctaggggctggggaggtggcgtgatatccaagaggcatctaatacagagtggagatgctggatttggaggtactgccaaatggttttccaaactggtggtaccaactccacatccttgccaacattgggtgtgtaattttcaccattttggtggctactcagtggtatcttattctcrttttaatttgcatttccctgatggcccatgaggtttgagtgcctgttcaggagtttaacagtcattggacatcctcttttgggaagcacctatttaaagtcctttgttttttttttttttttttttttgagatggagtctcgctctgttgcccaggctagagtgcagtggcatgatctcagctcacttcaacctccgcctcgcaggttcaagcgattctcctgcctcggcctcctgactagctgggaccacaggcactcaccaccacccccggccaatctctgcatttttagtagagacagggtttcaccatgttggccaggctggtctcgaactcctgacctcaagtgattcacctgccttgcccttcccaagtgctggggttacaggcatgaaccaccatgcccggcctattttaaaactttttcctattgatttgatacatatttttcaatacaactcatatgcttatatttttagatagaagtcctttatcggccatatgtatggaaataacttctctcatatgtggcttactctttcctctttaatcatgtcttttgactgacagaagtttctaatcttaatgtagtccaatctgtcactttcttactgtgtttcttatgtctgtttaagaaaatgtatctattctctcccctgagttttcttctagcagctttgatgtttcacctttcacatgtacatttcacatgtacatcacctgggactggttttagggtataatggaagggtgacattaaaagggttttggtttttttcttcaatatatagatccaccaccacttattgaaaagcccgtcctttctccactgttctgcaatatcaactttgtcataataaaccaggatgggtctgtttctggatttctgttttcttccaccagtagatttgtttatctttgcatcaatgccacactgtcttccttactgtagtataagtcctccagatttgttcttcttcacatactctttagaatcagcttgttgagtttcatccctccaaaaaagccttgtaatcaacaacaaagttgtctggtgctttgatcaaaattacattggatgtatttatcaattctataaatcaatgtggagaccaacattttaaattccaatccatgaacatggtatatccctccattagcttatgtctttaacaatttctctcagaaatgttttgtagtttcttgcataaaaattgtacacatcattcactagaattatttttaggtatttgattttatgctattattaatttcattttctaattatttctagtatatagaatacaattagtttctgtatattaaacttctgtctagcgactttgctaaatgaacttatcttccttaaattaacctgtaattttttttctacatactgaatcacatcatatgtgaatggcagctttatctttccctttactatcttcatacctttttacttatttttcttgtcttattgctctggctaggacctccagtacactattgtatagaatattgacaagtgccaacatcccttctcattttcaatctcagtagaaaagcattcacactttcaccactaaacatgatgtcagctgtagggtttttgtttgtttcttggtttcttggagatttgtttttaggtagatacttttatcagattaaggaggttctcttctgtttctatttgctaagagttgtttgtttacatcacggatgactgttttttgcatctgttgaggttttccttttttctctctattaatgtggagaatcatgctgattggtttttggatggtaaaccaatcctactaaccttttgttcccattgaaatttgcaggttctagttcaattccacgaaaaggacctcctgagctatggggcctggctgacaacatacaaactccatcctgtgcaaagccctaggccgacctttcccccacaaacgcatactccacattccaggtcccagagagacaccctcgaaaaccacaggcttcagagctgcgaggcttgcgccagcccctgccccttggcaagctgcccctgattgcaccagccctggctagaccctctcccagcagaccctagaattgcgagggcaactggggggctggggagagtcaaaccagaaggtcgaggcctctggcccctaacacccgcgacaatcaggggtctccggagccagggctgcccctaccctgcgcgaggctcctttaagagagtcggcctctgaatggtctctggggctggaggtggagggcgccaagaatgccggtctccgacgacagaagcgagagggatgcagcttcgccgggtggcctccccctcggcgtcccaccagcacgtccaccctggatcctcccgctcctactcctaccccaagtccccgcccccaacttcgaagctcctgtgtgcctgcaaacgccggccccgccccgctcccacctccaggccctgccgctgccagggacccgcccctgccagggacccgcccccgccccgtcccaccccggtccaccctgcagccgtcggacccctggcagggccccagcaaacccggaggccgccactggggggaaggacggggcgcccggcgaggcctcatccacatgcaggggacggcgcgtcgcggcggccgccaggaagaaacaaaggctgttccgccgccggccgcacagtgccaggctcgccccgcccgccgccccggtggccccgacgcggcccccctggatcttttccgccggcctcggctgcacagtccggacggcttccgggaggaggcagcctccctcggatccccgcactcccraccctctcccgcgaccacagcctccttctccgtgtctcccgggcattccaggtcgcctggccttcttgggccgggctggatcgcgcgggacctgcaccagagacccgagttctagtccgctgagccctcactctgacctgggacgaggagcctgtagtgaagatctcaggccagaggtggcccagagcctggtagggtgggcgagccgtgtccaggactcgtcacaggtcttgggtccccgtgatgaggatgagagcccccgggatcttcacctcgaccctcaggcctttgatccagggtgcataggacacccagacccctcagaggagttccagacctcaacccccacccctcctgaggttgtccgcctgggagcctcagggggcacgagaaagggtttggtctcagccctgcacttgctcggcgatcgctactgatctctgggcttcaacttccacctgtagaatggactcaccctgggagctgtctcctacacacacacacacacacacacacacacacacacacatcgtgcaggcatagagtactaaagggagcacacactgcatccccacacgcggccagctgttattcttgccgtccccctcggcctccctgagagcaggggattgtcttgtctcggagctctgctccccaacccggccccaagaatggatgtaactcaggcaactggagggtcccttccttcgcccaactgggaagtccttcctagatctgccccaagtcctctccttccttcccaggccgggactgggggagggggcgttccctttaagggaggtgggggagggggctgtgggccggccctccttccgcccctcccgggcccccgccgcccggggcccccagtcccgggcccggagccagcgcatgcgcccgcctgtgggcgctgtcccggctgcgagggccgtgagctcacggaccgacggaccgacgggcggccggccggacagacggggcagcgcagggagcggggacgcggcgggacagcgacatggccggccacacgcagcagccgagcgggcgcgggaaccccaggcctgcgccctcgccctccccagtcccagggaccgtccccggcgcctcggagcgggtggcgctcaagaaggagatcgggctgctgagcgcctgcaccatcatcatcggtgagcgggacccaggcgggcgggcgccgggcggaggccgaatgaggggcgcagccgctccgaacgaggggcgtcccctctccgggcgctcggacgggtctgcctggggaacctgcagtctggcctcagagagcgctatgaccgcggggaggtcaggggctgctggcccagggtgccaaagctccgtgttcccacctcccggccgcctgcacctgggggagttttgggtcccctccaccgctggactcttcctcctgactcgattttgctgcggggcttttgcaaggcagttaccctcagtttcctcatctgtgaaatggccatgactgcagtcctgcgattagcgcaggaacttgaccagtgtaggggctggtcaggctgcggcaggctgagctccccaagttctgtactgtgggtcagtctgagtacctactgtgtgcagggtccaggtgccacgcagtgcagtgactttattcttggaaagcaggagggcctatgagcagagtgagcaagcgcagcctgcgcagaagggacggaggttcagagcaggcaatgactgcagggtttggcagcaggacccaggagagggggcgggttagccagcaattgggggcagcagtgggcagacccagcctgcagaaggccagctgctccctgagctsggatcctggtgggcactggacactcgcctggtctggaggccytggactccaaagtccccacctgagaatgggtccatgtcctgcccccacataggggtttctgggcaggcagagagctcagaggtcatgggaatggcagtggtatttttccactctctgtcccaagtcatggatactgacttgtttctttgtctacacagagtgcctctgagcccctccagggagggacaggagaagtggtttggggggtgagtgactggggcctcgactgttctcaccttaccgccagccagtcttcccggtcccctgccagtgagagccacttgtgtcttcactgccttcccaccctcagacccctggagatggagaaagtttgggggctcagtagggcagacccagggtcttcacctcgtcctctcccacccccacattagcagctcttcacatccaragttgcccctgaacacagcccctggccaggtcactccgccatctcaccccctccccttagaatgctgtctcccagagcctggtcctgacctggccctgggagcttcttggcctaggatgcccctgcctgatggacggtctgctggaaggaagggctggttccagggatttggccagggtgctggttagagctttttcttggcccacaccctctccaggaactgtcctccagggaaggggaagctcacaccatgagtgggtcataggattgagaccatgcctagaaccagctacagtgccaggcaggtgcagaaagacacagctctgcctgggctcctcagctaagcccagcatccttgacctgtcttcctactctatcccctccccacatcccatcctccccaggccacagggaggctgcctggctcctttctccccagaaaggggccctggtggtggtggtggtggtggtggtggcggtggtggtggtgatggtagaggtggtggtggtgggagtggagaaggccaactccactatcaccctccttttccaggacagactctgtaagtttcccatgcagcccaggtctgccctgacagctcccctacccttcagttccttcctgctgtgccaggtccactaccttggcctccaaaccttgaacactgagccagggtgaagggccacttagctaaccaaggatgctggattcagctacagaacccaagcccggggcactcagtggtggtcttggggagccttgatcttggcctggccyggggagcctttgaggattacagcaggcaggaggctggacgaggcaggaaaaaacaaggagatcaacctcaaccagaaggtgataggaggtggggactgggcaggtgaggactgagctggggtctgcactgccttccccacctgatgtactaagggtctcccctccccagcccaccccacctttctgccccagrtgggctcactctctctccaccaataccctggggagcctggtcagaatcaaaaatgtctgcaaagtgtcatattttagctctaaaagtcaagaacttgacgtcctgcttcctttcctttcctttctttttctttctttttttttttttttttctgagacagagtctggctgtgtcccctaggctggagtgcagtggcacaatctcagctcattgcaacctccacctccggggttcaagtaattctcctgcgtcagcctcccaagtagctaggattacaggcacacaccaccatgtccagctaatttttgtattttcagtagagacagagtttcaccatgttggccaggctggtctcgaactcctaacctcaagtgatctgcctgccttggcctcccaaagtgctgggattacaggtgtgagccaccctgcccagccaacgtcctgcttcataatctaccttggtttgttattgttattgaacatgttatttccaaaacttccacagcgaccctcctaggagatcctgtcactctctccctcgtgtataccctctgctccagctcagactgggaattgaggcttttgagaatgggaagacctggaagggtgggctatgggctggcgtgagactcatgtatagtgtgtttagggcagtgcccgccggccactgcaagcacagatggaagggaatcggccaggctggaggaaatagaactggctggggcaggggctctgcaggacatcatcacatccaatatctgttcagaaaaacacctcttactgccttatgaaaacatgttcttcctttatctcatttgaatctcatgcccaccttgcaaggtaggaatttttatacccattttacagagtggaaactaaggttggaagtgaaatgatactgctccaaggggtaggctcaggatttggaaccagatttgggctctgttcccagtccagtgcctattttattttattttattttattttatttatttattttattttattttatttattttattttattttattttatattttattttatattttattttattaaaacaaactcttgctccatagcacaaactatagtgcagtggcatgatcatagctcactgcagcctcgacctcccaggctcaagcaatcctcccacctcagccttccaaacacctggaaccacaggtgcccgccaccacacctggctaatttttgtattttttgtagagactgggttttgccatgttgcccaggctgatctcaaattcctaggctcaagtgatcctcccacctcagcctcccagagkgttagggttacaggcgggagccatcatgcccggtcccagtgccctttatactgttctgatgctgggcaaattggggccagagtcagagccctgacgggggagggttggggaccaagctgggagcttgtccaactaggcttcactgagctcctgctccactatgggtggacaaacagacagacggccagggaagtctgcctccccatcggcggctggactcacagggcctctcatactgacccaggaacctcggccagctcccttgccggatccacaacccaaggaacacacccagatcctccaaagtgggagtcccccctgggtctgctgaccaggcccttcctctgctctctctttgacttgagagtccggctcctgcaggggtttgtgggccagatgtgtgttcagtgactcaggagttgacatcatgaacctcaactcctcaggaaccaatccctgctcacccagcytcagccaggaccctccctggtctccagggctgcaggtggctgggcttcccagaggggtggacctctgcagaaccccagcccctcctcaccggggccctgaggagccatacaactgtgcaggggcttagctgttccccactacagttccatttacaggtgaggaaactgaggcaacctgccctggggtcagatgccctcggtgtgctccaggaccccaagggaagccccaactataatttcggggacctgtcagtcctgggcacactcatccatttattcaaccactacatactgaacggtgtcaggcactggcttacatgccagagacaccatgggggggtcaagacagacaaaatccatcttctggtgtgggagtcccgcaacaagatgaacaagctgaatgtgtgtattgttaagtgctaagaccagacagtccagccaggaaggaggatggagagagccagggtcggggattgcagcttggaaatgagctgagatctggggtggggttcagtgtgagcaaggcattgcaagctatgttaagggcattgccttttgctctctgtgaagcaggagccctgggctttgagcagagggatgatgggatggggcttacagggcccactatggagaagaggcagtgggggaagaagtgggaggaggaaggccggtcaggaggctacctgggtctccccgggcaagagaccacggtggctcagggcagggcggtggccatggtggtgtcagaggaggttccattccggatgagtttggaagatgagagccgaaggatttgtgatggaatagaggtcctgggggagaaagagaggaaccatgggtgactcaaggttgtggcccaagcaattgggaggacgttttgccatttattcatcagggaagatcgagaggagcattctgggggcaaggaggtaaaagtcgggaattccrttttgaacacggaaagtctgtgatgtccgcggctgagtggttcgttgcatatacagatttcatttagcagagcagtctatgctagggatataaatttaggagttgccagcagaagtcaaggtaatagatgaggtctatctatctatcaagaaagcatagaaagaaaagagaagaagccccaggactgagccctgggcacccagtgtctggaagtcaagcaagataagggattctgaaaaggagaagccggtaaggccgaggggaggccaggaggccgagtgaggaggaagcaatccacttgccacatgttgctgatgcgtcaataacgtggcctagggctcgactgttgcgtttggcaacgtggaactcaccggtgaccatgagaagcctcagccaggagacagggccctgggcgaggtttgcttggctgggctggctgagccgaacgagccggagagggccgcacacttccgctcatctcctgtctccaaaggaaagtgggttaggctggagtcgggtgccggccaagtggcagttccaggcacatcctggatgtccccactcacctccttggggtgctgcccagacctcagtagtcacagtcagcatcccggagaggtacctgacacaggcttaccgtgaggatgtgaggacacccgtgcgcttgaggcgagtaggcttcacccaggccgcagccgatcaccccggggtgttggggtcccgggtggctcaggtctcagaggaaagatggggctgcctagggggtctccaaggcagatggcagtgcgtagggagatccaaaagcacttcccatggcctctgatgtgccagacgggatcaagagaatgcctgcatcaaataaaagcatcccttcccagccatcatccaggtaccgtggccgtggggcgatgtccagattgcaggggccagggtggctggtcaggragagcttcctggaggtggtgctgcttcagggagaccagtgagctgggcagaggcctrccacagtgagggacatgttccctgagcagactgtttccttggcccagcacagatatgcagggtgcatcccctctgctgaagtcacggttggactagccctctgctgccccctagcccagtggccccacctggcagatggggaaactggggctcggaagggcagcgctggcctgagtcacacagtcgggtccagaatgtgcttcaaggcatgaggactggtgccagtgtcctggcctgacaggccctccctgccccctccccaaatcagactgcacattccccacacaccacaggaggtggctcactctgcgactcgacctccgtgggccgcccctgtgacctcagtggtctgccgctgcctccagaaataggtcagcatgcaccgcagcggccacggggaacaatggccctttcttcgttcctccaagaagctgagtaagccccatcaggccaaacatcttaatgtgataaaagctacccagcgaaggctcagggaagaggggcgggtggtggagactctgggaaggccgacttggggggcagtcacttcctcgcctacctgcccggagctctggcccacggaggacctgcagggaccactgagctgtcatcccaccgggtggacaggaacgtggaggcctcagaacctacatctctctggtcagccatgggtcagacacccaacaggggctcagcggtatctccaggcccatcccgtgccccctcatcctgttccactctgagttcctgcccctctaaaccaggttcccccaacggctgggcttcttcattgctgctccccgaatcaggtagatctgcttggctgaaatacagagtctgggaagggagaccctccgaccttcccacaccactgggaggaacccaaggcagcccccttccagctccactaatctggccaggtgtggtggctcatgcctgtaatcccagcactttgggaggctgaggtgggtggatcacttgaggtcaggagttcgagaccagcctggccaacatggtgaaaccccatctctactaaaaaaaaaaaaaaaagaaagaaagaaagaaagaaatccaccggtccctcccatacccctcctataatcattagagcattggaggcccccatccctgtccacagccccctccctcctccgtgcccaagcccgcagccccggctgctccatgcagtgccccacccatccttcatggtgccgggagcagccagtgtgcggagtgygtgatgcgattttctgccaccttcaaacatgatcctgagggagatgctgcgagtggtctaggcccagagggagaaacccctgaggacctcagagacactggctaacgcctgtggtcctttgagccacaagggagaaagtcctgaactgtggcctgaggccacgtgttccaaacaatagtggcctctccacccctggcaagcccagtatctgagtcttcagccactgrgcacaaggctagtgatacagccctggaagatagggtgccagatgtggcttaccccggagctccacccaggaggccccaccaagcagaagcatggtgggctctctgcagggtgggtggctcagggcctgggatgctcccagcgtgaacatgctcagctccttccaaggccacccagcccccgctggcttccaacctccctggctttcggcaaatcccagtccgccaggtcctgagaacagaggccctgctgccggatggagggaactcaaagrctctttagaaaccttacagcccacccaggcctgggcccctctgctagatgagagaggcgcttctctctctcccccgagaagtagactaagggtacagcttacctctgggggctggrgcacaggaattagttcgtccttatctggatgtatttagggctcctgggatgtgactggaaaactgagtggggcgtcgtagctgtccagactggaaatctgtgtcggctgggggtgggggcagtgggggagcaccgtggacaaggagtgaatacaaattggcggctacaaccgtgtccttatccagccccctgcgggcccggcaggtggaggaggcgggctcccgctctgagggagatggacccgtcctctcaggacccggtctggtgtggccattgcatagagaacgatgttggtcctaccaggacctacaggttctaccagggctgtttgttcatatggtctgaggttctgggtttatttcttcttggacaggccctagtgcagatctctggtgaagttaccggattcatgtgcacagatggtgagacccatataacccagaacattgtccctctttgcggagctcagggctcagcaggcactcagagtcttgctcatcctgggaacctactctacagaccatagttggcccccctgaatgtttcccatcatgtcagaaagcagaggggctgggcacagtggctctcgcctgtaatcccagcacttcgggaggccgaagtgggtggtcaattgagcccaggagttcgagaccagcctcagcaacatagtgggacccctcaactctacaatttttttttgattagccgggtgtggtkgcactcacctgtaatcctagcactttgggaatccaagcagggagggtcacttgagcccaggagttggagaccagcctaggcaatatagtgagaacctgtctctacaaaaagtaaaaaaaaaaaaaacctgggtgtggtaatacacctggagtcccagctactagggagactgacgtgggagaatctcttgagcccaggagtcccaggctgcagtaagctatgatcgcaccactgcactccagccagggtggcagagcgagaccctgtctaaatgaaagaaagaarctgggcacagtgactcatgcctgtaatcccagcactttgggaggccgaggcgggtggatcacttgcagtcaggagttygagaccagcctgatccacagggtgaaaccccatctctactaaaaaagtacaaaaaatattagccaggcgtggtggctcatgcctgtaattctaactacttggaaggctgaggcaggagaattgcttgaatccaggaagcggagggaaggaaagggaagggaaggggaaaagagaaaggaaaggaaaggagaaaggaaaggaaaggaaattgaagtaggaagagaagcccaaacctgatgtggtcaaggagggcttcatggaggagatgctatttcctgagccactccatgagtctggactttggccggtgggaaagtggcaggagagtggttgaagtcctgtgttaggggccagctctggccagtgggctggatggaggcaggacaagtggctgcatgctgatatgcctggggctctgaggtagacgggagggctgagcatgggccttgtggggtgcctgaggagccaccgtctgccrtcgctcaggtggttcagcctcctcactttgctggccccgcctcacgggggcaatggagggctgagaaagtcaaacagggcctgtctctggcagaggggcctggccagctgaacgaggtgccatttcctatgtgagggactgaggaaggggcagatgatgagcccagaatggcacttgctgggcttgggggccagtggcattcaacacctccagcccacctcctgcctcctcctcctccgggaagcaccccgggctgtcttcctcctggcagcaggcagatccccacacagaaggccgggctgcgaaggggaccccaggcctgatgcctccccatctctccccctgcagggaacatcatcggctcgggcatcttcatctcgcccaagggggtcctggagcactcaggctccgtgggtctggccctgttcgtctgggtcctgggtgggggcgtgacggctctgggctccctctgctatgcagagctgggagtcgccatccccaagtctggcggggactacgcctacgtcacagagatcttcggggrcctggctgggtgagtgtggggcaccagcgggcagggggacaccctcttgggaatgggatggccaaatgagccctggcatcagtttccactcctgcttccggcttcctagggaggtcgtgggggtggatggagagaaggtgtggggggtggatggagagaaggtgtgggggctggatggagagaaggtgtgggggtgctggacagccttctgaggacagggcaggtggaactgaggcccactccaccccactgatgtgtgctgggcactcctgcaggcccctgggcctctctggatctccttttaaatagaggtccctctgaaccccaccccctgccttgtacttaaggaggggggattcttactgtctgaaaaccctaggtaatgtgagtgcccaggcgaggaggggcctcaattttggtaaacccatatgttgcatgaggagcaaggaaggaagtgtgatattcttaccatataccctgcataaggtccttttttttttttttttttttgagacagagtctcgctctgttgcccaggctggagtgcaatggcgtgatctcagctcactgcaacctctgcctcccaggttcaagtgattctcctgcctcagactcccgagtagctgggattataggcgcccgccaccaygcctggctaatttttttgtatttttagtagagacggggtttcaccatgttggccaggctggtcttgaactcctgacctcaggtgatccacccgcctcagcctcccaagtgctaggattacaggagtgaggcactgcacccagccagaggtctcctttccttagcaccctgctatccttccttcgttcaccagggaatatttgctgagcacctaccgtgagcctgggggtggggaggcagtgatagaaaggtctgtccctgtactcaagctgctcacagaacagagaggaagcagccccttaaatgggattaaggcctggatgagccttgctttgagagtgtgtacaagaggcagcagctacacagcaaagagaacggtgtgcgccatctagggaggactcccaggaaagcaatgcttgccctaaggctgggaggaagaagattttccccaccgggcctagctgaccagtgaggaaagcatcccaggatgggggaagtgtgaacagagggtgtggtggcccaggtgagcgcagggagtctgctgtagctagaggtgaggtcaggttgggtttacggcaggygccggggcttggagagcatcaggggattgaagctgttgtatttgtccagctgcgttgtgccaagagctgcaaaggtacaggcagattctaaaatcgtttaggagcctgattcgagaggatagggcagccagcatagcagagggagaggtgggtgcagcggaggtggcacccacttccctactgagaggctcctagatggtctggggctcagaggaaaagtctgggctgaaatttacaaagtttggttctgagggatatgggccggggacccttaactgggcagccttggatggggagacgtgccagggcttgcacgctgctgtgggtgcatctgtggcagtctcctctggggagagggtcctcaaaggggctgggacccaagaaagcagaataatcatgcttcgggcctggagaggacgttcgggagggagaagagggccaggacctcatccctgggcacggaacatgcggggatgggcagaggggatgcctggcaggggaggagggccatggagctaggatgtcccagaagcccagcagggatggttgtgcagagcaaggggcaggtgatccagagatggctgatgtccccgatgaggcagtcctctccctggagggctggccaggggctaggaccacccccaagggcagacccacccctgggtgcaggaaagcccctgagaacaggtcagactcacagtctgggtgccctgcagaggcaagatttaggtagaaggggcatccatcactctccacccccagctagggctcttggtaaggtctagtctctgcaccccataggtctccctcagggggaacacagctcagagtcacccatcttcagccacagtactctgcgagagccagggctgaagccgagaggtctggggacagggaccctggctcaggagacagcctccgtccaatggggggcctagttgttattagaaaagcatttggtgactgggcgcagtggctcacgcctgtaatcccaacactttgggaggccgaggcgggtggatcacgaggtcaggagatcaagaccatcctggctaacacggtgaaactccgtctctactaaaaatacaaaaaatttgccaggcatggtggcaggcgcctgtagtcccagctacttgggagactgaggcagaagaatggcatgaacccgagaggtggaggttgcagtgagccgagatcatgccactgcactccagcctgggtgacagagcaagactccgtctcaaaaaaaaaaaaagaaaaaagaaaagaaaagcgtttggtgcctatgttgttcccagcgcctgccccacagcagccttgtcaatgtttaagtacgggtaacaccttctctgttaaaacagtctatcaatgcagccgcaagacctcaacaaggtcaaccctgcctccctggaccggtgctggcctctggcagcctcgccagcccccgggcgccaggcccagggcagccctgctgcacacatcagggccaggttggccgggaagggctctgggcagcttgagccactcccgcccctgctccttccagctttctgctgctctggagcgccgtcctcatcatgtaccccaccagccttgctgtcatctccatgaccttctccaactacgtgctgcagcccgtgttccccaactgcatcccccccaccacagcctcccgggtgctgtccatggcctgcctgagtaagcatcccctttggcccactgtccccagatcagccacctgcccgggcyccatcctgccctgagcaggaggacagaggggtgaaatttcccttcagaaaattccagctgctataggggatgccattcycgggccgcctgggctggacttggccatsgtccactgtgaaaggtcccggcctcggcgcccacccccgccttccctccgcagtgctcctgacatgggtgaacagctccagtgtgcgctgggccacgcgcatccaggacatgttcacaggcgggaagctgctggccttgtccctcatcatcggcgtgggccttctccagatcttccaaggtagggccgagtcggggtaagggccgggctggggagatggtgctgacccccgacttctgggcctccaggacacttcgaggagctgaggcccagcaatgcctttgctttctggatgacgccctccgtgggacacctggccctggccttcctccagggctccttcgccttcagtggctggaacttcctcaactatgtcaccgaggagatggttgacgcccgaaagtgagtggggcccccaactgggccctgggaagcagccaggccctctggtgggacaggcagcctctccgcccagccccactgccacccaaggctcrggctggtcctcggtggcccacgcctgttgccctgcaaaaatggccctgggaagaaagccggggggcttgcattctagcctggccctgttctctctggctatggacacgtcacagccccttgcagggcctcagaaaggctgaatatcatcatcctgctgtaaatagatccagagatttgcatttggcctaaaattatgcatatacacacaatatggtccctacaaatgaagccaatgactgcgtctgatgctcggccagggatctcgacagtaaacctttgcagctgagcgagctgggactggaaagttccaggaagactctgggtctgtggactgggctctggggccattttggggaattttccaggctgattttggctgtatgcgattttatctttctgcacagacatcagaccctgtcctcaggatgtgatggggcccctcccccatctcccatcctaccagcctgtgtccaggtgggggtggggcagggcagacaacagggtccctgtgtctcgggcagcaatgctgccccctttcctgccccaacatccccagcagacacaagagatggagactatgagctgctctcgtggctgggtctcgggggtcctgcaccctcaggagctgacgctgacgcactccactgcctgtcaccaggaacctacctcgcgccatcttcatctccatcccactggtgaccttcgtgtacacgttcaccaacattgcctacttcacggccatgtccccccaggagctgctctcctccaatgcggtggctgtggtgagtgggcccctgctcggtccctggctcctgcccaggcccctgccccggccttacacayggcctctctactgygcccacccagaccttcggggagaagctgctgggctacttttcttgggtcatgcctgtctccgtggctctgtcaaccttcggagggatcaatggttacctgttcacctactccaggtgactgcactggggagaygtgggcatggggagggaaggctggggtgcaggtgtgcaccagtcatgccgtgggccagaggaagggacacctgccgggggaggggtctgcctgaagctgggatgatgatcccacacggtaacaagtgtctgatcacaactgggaggcaaagaaagcaagaggcaggcaggctggatgagggggagaactgtccagtggggctgctgggcccggagcaggaggtcagaggcgacagcttaagagggacatcaggtccaaagctgagacccaggatgtggccagtgcccatatctgtccccaacgctaggctgtgcttctctggagcccgcgaggggcacctgcccagcctgctggccatgatccacgtcagacactgcacccccatccccgccctcctcgtctgtgtaagttgggggacctgggccaggcagggcgtggaggcagggctacccggcaatgcaggaccttccgggtaatggcaggggtgagccattccagggtgggggttgggggtggggccagggctcatcctgcaggggcgtcaggaggcaggctaggggccagccgtcagccccaggtcctctcccagtgyggggccacagccgtcatcatgctcgtgggcgacacgtacacgctcatcaactatgtgtccttcatcaactacctctgctacggcgtcaccatcctgggcctgctgctgctgcgctggaggcrgcctgcactccacaggcccatcaaggtgaggccctgggacagctggccctgtgcygggtgctgccagagccacccctgcatccacagtgggcaccaggggcaggtgggatgggaggtgccagcttttgtggagtgttgggccctgctcagggctctctgtgcactgaggcagccattcctcatagcagccccatgaggacagagctttgaatgctcccagtgtacagatggcgaaaatgaggctcaggactgggcacaggggctcatgcctattccagcactttgggaggccgaggtgggaggattgctggagcccaggagtttgagaccagcctgggcaacataacgagacttcctctctgcaaaaagttaaaaataaaagggttagcctggtgtggtggtgcgcacctgtggtcccagctacttgagaggctgaaatgggaggatcgcttgagcccgggaggttgaggctgcagtgascggtgctagggccaccgtactccaacctgggtgacagagggagaccctgtctcaaaaaaaaaaaaaaaattaaagaaaatgagactcaggaactgttcaaggtcacaaaggctgccaggatttcatgagcccacacaaaaacagaagaccatagcctgagctaaaagcaaagccccccatgtgtgtataaatccttaagtggagaagtgctcagtgcctgaaatgtgaaacaccaaaaaatcactgacctccagccaagtgcaagcctcaagtccacacgcaaccgctgtgtggagctcggtgccgctgagactttgaaaaatcctcagcaaaactggccaacggcctgacccatgaattggcctccaacacactgggctgtcgccaagagggggtgtagtgggtgcaattgcccttcaggcctcagctcccagggaagggaggaaaattccccagacccccaggggtcggggrtacagacagctggaggccctgcaccatcggtgtttctgctcccccttccccaggtgaaccttctcatccccgtggcgtacttggtcttctgggccttcctgctggtcttcagcttcatctcagagcctatggtctgtggggtcggcgtcatcatcatccttackggggtgcccattttctttctgggagtgttctggagaagcaaaccaaagtgtgtgcacagactcacaggtgagccgggcagctgcaggtcacccagcacagggggccggggcctggagaccagacctccctcttagaggctcaccccagagcagggtgtcctagcagctgaggtgggaacacagggcccagccgccaccaaatrtctcttcccaagatgtacccaaagtttccagaaccacgggtaccgacggagcaactccctgaagacccctgcccaaggggaggtgtccggagctgggggtcacccctatcccgagaggtcaggccccaaggtccatctgtctgtcctcagagtccatgacacactggggccaggagctgtgtttcgtggtctacccccaggacgcccccgaagaggaggagaatggcccctgcccaccctccctgctgcctgccacagacaagccctcgaagccacaatgagatttttgtagagactgaagcagttgtttctgtttacatgttgtttattgaggaggtgttttggcaaaaaagttttgttttgtttttttctggaaaaaaaagaaaaaagatacgactctcagaagcctgttttaaggaagccctaaaatgtggactgggtttcctgtcttagcactgccctgctagctyttcctgaaaaggcctataaataaacagggctggctgttcgctcgtgctatggggagtccctgatgggcacagaygggagtggctggggcgtacctcggtgggtgcacacatgttgctggccaggaagatgccgtggcaggccctggaggaggctcttgacattagggggctttgctgcttgacacaggcgctccctaccatggcacccagagtccccctgccctaaagggatgtcgaggatggggtagcagctcagtccgcccctaccccaggcccctcgatgccagtctgagctcggccacccaggagagctcaggggctccaggctgggattgyctttcttcccgtaaatcaccacagagtgaaggtcaggacttcagagcccacagtctcaccctggcttacaggtggggaaaccgaggccctgagataggatggaacagacgtggccactgctgttggtgcctcggcctctctgtccccagaaagcacagagcagcatgtcctgggggctttgaggcctgcagggaactccaggggcttcatgtacagcaggcacacaccccagcccttccacggtgcccaggagattggaccttcagggagggcaaagggcgcctgcctggccaggggcatgagggtttggcaggagccacccaacccaggtcctccagaggccttgctggacaggaagagggtgaggcgtgagcaaaatagtcaccacggatgagacccagcgtccccatggcccggccccatcctcatgacaactcccagctctaggggcagctgttgccactgcagggcagatgaagcaaaaaggctctggtcccctgcttctctggaaatgggttcccagaatggagtggggggagagaagtgagaccccagggtgcttgtgtacaatgggaccctgcagacgggctcaccactccactcttctccccccccgccccgttcagtcccacagctcccgcccaccagtgcagccagctggcttaggggccagcccctccgctggggtccccggagggcctctccataagaaaggacgcagaggcagggtagaaatgactgtgtattccctggttacaaagcggggctgtggcggtcaccagcgagcccagcggtcaacagaccaacagggcctcatcatcgctggcctccagcattggggagcaggggggcggggggttcctgcagacccccagtggctctggcgagtgggggcccagggtgctgctggcagtggagacctgggggtgcgggtcctgggctgagcagggctcccgaggtgcatctgcaggagctgggccgtctgccagtggctccctgcagacctttctgtccttgtccacgggcctgcactctgggtctcgcaggcccgagggcaagggtggccctgaaggtcccacctccggtgcacggccgggggcactggggggcctgtctccggccgccctggtgctgcctgtgtccatgagcggtgctggggggtcgggggcagcccctggagcaggctggaggaagccatcgcccagcacggtctgtgaggggcgtgctgcggtcagcagtgggatctggcctcggggcgcccgcggccggtgaaagagccggttccagaggcggccgaggcggcggcgggagggcccccggcgggaggcgtgccgacgcatctgtctccgcatggctgtgcgaagattctgcagcacagaggcctgtggggtggagcagggtaggggcggggggatgcggctgagggggcagacaggctgctcaggggcaggagacagcacacccccaagggacctgagacccgagagaccaccttgtccaccccccccacctggccatgggccctcaggtcaccctgcgcaggccttgcctcctgctcctgtgacccctggaccagcctcctccgcacactgtcccaagtggccccggaggggcctcacgccctccgggggctcacctgggacgcactgtagacaggaaagtcctccacgggtggaatgaggccctgggcgatgagctgaccataggatgggggtgcctcccgccgcacgaactcagcctccaggcgcgtcatctgggtctcgaaggccctagaagcagtgggcggagggcgacatgactgggctgcccgggacctgcagcaggaacaacaacaggattccaggacgaccctccacccagacaccccaagatatagggaccccagtgtgcaccagggcagcctccatgtagctagtccaggcccccgtttgcaaacccacagctacggggacagcaagcctgggtgatgaagaagcccggtcccctggctgcgggcacagcgcccacctgtattcctgcgtgcgcagtgagtagagcttgaaggcgcagcccagcgcgatgaccagcagcaggccacacaccaggctgccaatgagcgccgccgtgatgaccttgcggggcacggcggccaggcacccatgctcatcgctgccgtcctggcagtcttcctggccgtcacagcgccacgtctcgaagatgcacaggttggtaccgcagtggaaggtgccgggctggcaggagaagcagttcttctcgtcggcgccgtcgggacagcttttctggttgttgcagcggtcggcaggcgtgtagcacagaccactgccaccctcgcaggggtactggtcgggcgggcaggcagggcagccctgctcgtctcgaccgctggcacaatgccaccagccatcacagcgctgtggctctgagaagcagccctggtcgcccaggctgcccccgtcactgtcactactgctcccgcacggctgctcccaggggaggcaatagcccttcacctggtaggtggcattgaagccgtggccggcgctgcgggcgcgcgcgtggtaggccacggtgaggcggccctgggcggcctccaggctcacgggccggtggttgctgcggtaggacagcgtctgcagcaggcggtccccgcgctcgcccaggccctcgtatacctgcacgtagtcgtcatagcccagccgcagttccagctgcagcagcacccgccgggagtcctgtgtgtccaccagccacgtgcagtgaaggtctgagggcccgcgagcggcgccgaacaggtctggggaggcaaaggagccgtagaagctgcccagccgccggccgcacgccaggtcggggcagcccgcctcatccgagccgtcgccgcagtcctgcaagccgtcacagcgccgctccacaggcaggcagcgcgtggagcgcgccccgctgcatgggaaggtccccccggggcacaggctgcctggaggctcggaggcgggcgccgagcagttgccctcatcagagccgtctccacactcgtccaccgtgttgcactgccacgggccgggcaggcacttgccgttgtcacagcggaactcatctgcctggcaggatgcctggcccagcttccctgtggggtggagacgtagcaggggacagtcaggagacagaagagcctcccttcggccagggggcctggggccaaaagcgggcaggtggttccccatcactgtggcagcagagacccctccaacaccagggtgggctctgtccctgacctgagcctggggttaggggtgagttcccaggactagccaagactgggaagtggggccagtgaccttgagaggtccaaggcatccgcatgcccagtcctgccactgtcctgagattgacagggcggtcaggggacatcccacagggagccggggccctgtggagggtgccgcccctgtgggccgggagcctgtgggcatgcacggtgtgctccgtggtgtcctgcctgccctgcagcctccatcacctcggatgtaagacagacggaagccctgggcctggccggagctggaggcgtctgagtggaagaaaatccagacatggtcgcgggcagagatgaaggcaggtgggatggcggagccacagaggcggaaggcctcctggcggggtggggctgctgggcccagcaggagccagtccagggagcactggtgggactcctccacgtcaaagttgcggaagctgcgggggggcggagaggacccagacatgaggcagtaggtgggatctccatggccgaggaccagcagggagtggtcaggctggagccacggccaggacagccagccctgtcccggccggctgcccccactcctcatgttccagactgcctggttcctccactcccagccactctgtccccacactgtccccatccaggtgtgcacgggaggctccatgaagaattgcgacatccacgcaggtcatttccagctctgctgcggctccccttccctccatcagtgcacacagtacccccagcccgaagccgaagtggagcaggaagtcaagagccccctgccccgacaccctccccaaaagggcagtggcccaagggcccagaaccctccacctcgggaccactgggatgggcccagcacaaagtcccaggcatgggaagtgagggtgagactgcccacggggctggctaaggctgcagcaggttgacagcttgtcatctccggagatacactggccctgaaccacctggcccttggggaaactgaggcacagagactaggatagaccctgcccatgcccatcacatcctcacgcattgcagctatggagtaagtcaggggttgcgctttttgggctctggcatttaggaaaactatggcagatggaacctatagtgactccccagccaaatgtccctgtgaccacccctggccaggaccaccgctcactgcctggccccctttccctctgcatgtccctgcagctcaagcacccgggctttgcctgattcactcccctccccaaggccccctccagaaaccatgctctgggctcagtgccagcctggcccccagccacccctgcaggacagagaggacacctctgccacctcagagacatcagaccatgcccaccagtcccaggctgtgttcccagtggcctgtgtgctggccctgccttcctggcagagctgagtgactgagaccccccacaccccatgaacgaggctcaaaccaggaagaggtccagcttgggcacctcgccacagaggcccgtggagacccagagcactggacacacttgcgtgcatgcattcacatgtgcacatacatgcttacggttcacacatggttacacctgttatcttacatgcatgcgcacatacacgctctctgcacctttgcaggcatggctcgtgcacatacatgtgctcacacatgcagtctctcacatgtgtcctttatgtcttctccgacatgggcttttccatgtacacaagcacacatgtgttcacatacatgcacacacacacatatgcacacacacctacttacatgtgttcacatgcatgcacacaccacatacctgctcaaatacctacacacgcctacctcacacacacacatctgcatgcacacacacctactcacaaatgctcacacacatgcacacacccatacacctgttcacacgagtgctcacacacgcctcactcatatgctcacacacatgcacatgatcccacacctgctcacacacatgtacaccctcaggcgtgtgccctccacacctgctcacacacacacattctcacccaccccatgcacgtgggcccacattgattccttccgacacccccgggtgcccctacctgatggtaatcatgtcaccacggtcgccctggatgtaccagctgcagttggtgcctggcgggtagttgaggggccaggccgggctgtagatgaccccacgccgctccgtgtgctgctccagcttcccactgcaggccgctgtcgggagaggaggccgagaaaggccggcccatctttggttgggatgcgggttgcagtggggggaagggggcttcagcacaggcctcccccatggtgggatcgagtccagccaagggtggccatggccaagggcaaggccacaacttgtgacttcatggaggtggtgtgtacgggaggccaaggagggccccctagacttgaggcagctgtagcccccaaccctatgcagtggactacagcctaggtcctgtcccccgcatctctggcagagctgggagaaaacccaccaacaacccgtcctgccagccggcacctccaaggtgtagcctcgtggcctcgggtcagtggagaatcccacacccctaggcctgcccagccggcatagcccatcctgcgatggccccctgcctgccttccctgaggctttgctcactcaacaagtatttactgagcacctactacatgccaagcatgcatggtaggcacactgagtaaggtgggaataaggcctgctctatg

SEQ ID NO: 17678 - DNA, 26330 bp, Homo sapiens
gcttatttctcttagcataatgtcctcaagtttcatccatgtcatagtatgtgtcagaatttccttctgttaagactgaataggtggctcacacctgtaatcccagcactttgggaggccraggcaggtggatcacctgaggacaggagtttgagaacagcctggccaatgtggcgaaacactgtctctactaaaaatacaaaaattagccaggtgtggtggcccgtgccggtaatcccagctactcaggaggctgaggcaggagaatcgcttgaacctgggaggtggaggttgcagtgagctgagattgcacaactgcactccagcctgggcgacagagggagattctgtctaaaaaaagaaacccaaaaaaacaaagaaacaaaaaacggaataatattccactgtatggatggaccacattttgcttattcattcatcatccatcaaggaacacttggttactcccaccttgtggtcattgtgaatgatgacgcaatgaacatgggtgtacaaggatctgtctgagtccctgctttcaattcttctgggtatataccctgaagtggaatggctggattacatggtaattccatttttaattttttaaggaacccgtatactggtttccacagtagccgcaccattttacactcccaccagcaatgcacaaaaatgtcaatttctccacatccttgccaacatgtgttgttttctgtgtattccacccctgccccccaccgtagccatcctaatggaggcaaagtggtatctctctgtgattttgatatttttaattcaaataaaccttagcacctgtattagtccgttttcacactgctgttaaagacatacccgagactgggtaatttataaaggaaagaggtttaatggactcacagttgcatacggctggggagtcctcacagtcatggtggaagatgaaggaaaagcaaagagacttcctacatgtcagcaggcaagagaggacttgtgcaggggaactcctctttataagaccatcacatctcatcagattcattcactatcacaagaacagcatgggaaagacccacccccatcatccaattacctcccaccaggtccctcccacaacacttgggaattgtgggagttacagttcaagatgagatttggatgggaacacagccaaaccatatcaacaccctttctcaaaagctccattttttctcttcttttctttcttgtcctttcaccatcttactccaaagttggacattaacttctgttcagaaatcccacagtcacaggccctcatgttaatttctacccaaatggctgagcttttcaaatgtaattggagaaacatggattttaatgtatacgatggccgggtgcggtggctcactcctgtaatcccagcacattgggaggccaaggcgggtggatcatttgaggtcaggagttcaagaccagcctggtcaacatggtgaaacctcgtctctactaaaaatacaaaaattagctgggcatggtggtgcatgcctgtaatcccagctactcagcaggctgaggcaggagaatcatttgaacccaggaggcagaagttgcagtgagccaagatcacgccattgcactccagcctgggtgacagaatgagactctgtctcaaacaaacaaacaataataaaaaaatgtatacgagagcaaaatagccatttagaagacatcatcctgtgaggcacctctgctagggttccgggagggatcaaggctacaacaaaccatgatcacaccactgcgcaaagcatttcaggacagtttctgcccaaggagagactgggcagacagaccttcctctttcactgctggccccaggtgcttgcagttctctccaagggggccctggagacctgggggtccatcagtatgtccatgtgctggagcggctgctggcaggatcaagaacttccctccaaacgctctctggcttgactattcgcctgatggaacaggcagaaggatagaaattagctctggggggagcggaaacattctgaggccagagcaagctggtgatgagtggggcttggagaaggtggcaggcagggctgttcacaggatcatgcagcttgagctaaaaactttgaagtctgttctggagcattttcagcagtggggatgaaccaatttgcatgttaaaaacgtgagcaatgaattgagaggcaagggaccacatggagggaggcctctgtggaggtccaggagacaggagatggtggctgggaccagggaggtggtcacggtgatggagaaaggtgggtagatttgagatacatcatggggaccagcaggttgtagtgatggattggatgtagggagattggagtaaaaatgatcaactcagtaatggacgtggccatgaactgagtagggcacagtagagaaggggcagatgtgggggtgaggggtgtctggtctatggctcagctagaataatgagaggtttgccctcttggaagtcacctgtgataaacttgggcataaaggtgatcataaaacaatttttttcagttttatttgccaaagccacttttggcctttgaccttcaaatagattgtaggatttttgttgttgttgtttttgagacagaatctcactctgttgcccaggctggagtgcagtgtgcgatcatggctcatcgcagcctcaaactcctgggctcaagcaatcctcccacctcagcttcctgagtagctcagactacagatgcataccaccacacccagcacattaaaatttttttttttgtagagccagggtcttgctgtgttgcccaggctggtctcgaatcctggcctcaagtgatctgcccacctcggcctcccaaagtgctgggattacaagtgtaagccactgtgcctggctggttctagttatttgaaatcaggaaagacactgaccattcaacacagagtcctcttcattagtgtctggtaagcaactggataagagagcgcttgagtttgcatctgcctgtgggtgaatgttgggggaggatgtgggactctcctgtgtcattggtttcttctgtgtcccacgagggctcggggtatgtggctgatgagtgggcaatggtggtggccctctcgtatgggatggagtggggacttacatgggatgcctctgtgtcccttccgtctcctctctgcatgtcctgtggctcctcactcctgcagcagattcctgaaggcgtcactggcccacagtgactgtgacagcagctttgcttcctcctaactgggaaggccagcttcttgccaggaagcccctgctctcatgtctgagccctctgccccaccactgctccctcacctgccccagccagtcagttcccatattctgggtccatgcccaccatctccttcccagtactgaattctccaatggttagaagcttttgggttgtgatgaatagacacgttctggatatagcttgagtcaatgagggaggtttacgaaaaggtttcagaggtggagagacccaggcgattgcagctagcgtggaagagtgttgaagcagagacaggaataccaggaacctttccagatgtggtgagagggcggtgggggagaggactgggccagagctgcattggggacccccagcaagggtcttgcctggcacagcaacctctagggggcactagaccatcatgagacaaacgggaaatggggtgtcagttatgggccggggtctcaatatgggccgggagtaggatagggcagtgaggcactcaccttgggcacagaattgaaggaagtgccaaaaaactcaataatgaagataaatcaactttaatgcaaattttttgtgtgtgtgcaatggggacagttgtttccaatcagcccaaggttcctgggtaccttggccgtttcttgccttatgggtttatgagggttcacaatgggatgtgcatagattggggagcatggagatttagatatagtcatgtgattgtagagcttttcttagcctttccacttggttcaaaatatgggaggatattttgataagtgtgtctaggggctcacatttttcttttgcttcaggctccaacatgattcccatattggtcattggtctggaccctagattccttacataacgtgcaaaacatgcattgaagcaggcagcatcttcaacaaaaccgcatattttggccaggtgtggtgggtcctgtctgtaactccagcactttgggaggctgaggcaagaggatcccttgagtccaggagtttgaggttgcagtgagccgtgatcacaccactgcactccagcctgggcaacagagcaagaccttgtctctacaaaaaaatgaaaaaattagcctgacatggtggtgcacacctgtcatcccacctacttgggaggctgaggtgggaggattgcttgagcccaggagtttgagggtacagtgagctatggttgcagctctgcactctagcctgggtgaaaaagtgagactgtctctaaaaaaactaagaagcagcagcagcagcagcagcaacaacaacaacaacaacaaacgaacaaaccgcagatccaccctaccattgcccctgcctctgttgagcatttttgccatgcgtaaataaatgcctgctcatccgcagtcagcagtctgaggaaattctgaaaccaaattacacataggctagtgctctatgccatcaatctgtaatgtatcttgttatttgatttttacgtcctttaatacatttcctaagaagtctgctttggaaaaatcaccaaaggaattagaagagagagaataagaaaacccagaaaaactaaaaggatttttcttccccccattttttattaaaatccaatcaacctgcacagtgcgagtgagtgagtgactgtctacgctttcactaacggaccatcagtttctctcaaccttctctccataaacggagaatatcaaatgagggtctgggggtgttagaaaagggttgggagcctcagctcaggttggtgggcccgctgtgccatggagcctttggggacctctgatttcacatccgtcttggccctaaatggccttctcaaaccttccccctgtctctcctggttcttgcctcattggactcaacctcttggtgggcagctctccagagggcacccccagcctaagaagcaggcctcctcccaagtccccagcctcacgaggatagtgggtaacagggtgggctcagggggccctgggagatctccagaggcctctggtgtgttcaccaatgtcccctgacaggtcttgcttggcacagggggttcctcttagagacgtgacagggcacttggactgtggcaaatgaaagaagcggaggggcaggaacagggacaccttgcgaagaagacaggccttagccttgtgccacccctatgaggtccctaagcagccctctctctcccaccttttcccagtcctcgctccccggtcctcctcagcacagccggctccaggagggatcaattcgtgggcccgggaggaggccaggcgagcaccggctgcctggagcactgggctggagcgcggggagcgcggcggggggcgcgggcggggcggggctggtgcgcagagctgtccagcaccccgaggcggggcgtgcgcccccggcccgccccagccgcctccgcccgcccagccagcgccactgcggctcggcgggcgcgtcacgtggctggcgcagcgcggcctccaggctccgggcgcgggcgaggggccgggcgggaggactgacagacccacggacgctctaccggcggcacccggccgggcgggctgggcgcagcgcggggcggcccggggacgccggggccgggcgggctgcgcgccgcggggcatgggcgcgccgggggtccccgggcccaggccggccgcggcggggctcccggggcgcgggggcagcggcgggcgggggtcttccctggcggccgccgctgagcccccgcagggcccgtgacgccgcggccgatgtggccgcgcgcgccctacgggcctgcaccgccaccgcacaaagacgcctcgggagccgccgcctgcacccgggccgcagcagccacgccagccggagcccgagccctagcccgagcccgagcccgagccgcagccagagccagagccggagccgcagccggaaccggagccggagccgcggggcaggaggcggcgcccgcgggcggccgggcccggcatggagaagcgcgcggccgcggggctggagggcgcgccgggcgcccgggcgcagctggccgtcgtctgtctgggtgagtgggccgcgcgggccgggcaggtccgggtcccccgcatggcagtccgcgccgcgccctgaccgacctcctctccggccgcggcatcccgagccccccaccgcggtggctcccgcgcggagacccagagaggggccagcaccgcttgcccgcctggccccgggcctgggagggcgactctggtggcgcagccccggctcccgccccgctcggagtagcgcccggagcccgggctgagcgctggcaggmggcccttcgtgcaggcggcagccttcaacccggcccgcccgcgctgagcctggagacgagggggccccgggagctggggacaaaggccaggccggctgtcccctgaagaagaaactgtttccggcccggagttggggtgggggctggtgtaagccgcagatggggactcggggtgcggggcagggctggaggagggtgccagtgtggaggcggcttccaggggactcctgttttccctttgtgtctctcagcccccaggcaggcctgttcagtttaggagggtgcttgggttgggccagggaccggtcaaggccaggcatggggtgggaggggctcccgccctgtccgggagtttttctgtccagctttccagcgctctgtgtaggcgagaggaggagttaaatccccaacccacatggctcctttatttactgtgatgaaggagggaggccattataagaactgggggtcattaggggacaccctgtgatgtcaccagtgagggctctgtaacctgacaggtttgctgaagccactgaaatgacaaagtaatcacccccaggcctcagggagctccgaggctctggcaggcccttgccccagctgtgtgagcctggctcagtgggaatgtgccattggggagcattgagggtgtaaccccagcgcgcccaccccaacctcrgtgcggggtcatgtgtgctgggctctgagctgctgggtgctggcatccctggtgagcagagcagggggacaggcgctccatgcttaggagctttggcctggctctgtccagggggcctgggtgtcctgggtgggggcagcggttcctgcttcctggccaggcgggatctgacacacatcctgaaccccgggaagttgggtttccccccaccccccgactctgggcccgtaaccccccgggccagagcagaaggtgaaagtaagggccaaaccccacggaggtgggtgcttgargggtggctggggagttctgctttcctcctcaargtcagcttggcacgggggaagaggatggttccgtcactagctgcgtgccctgtaaatggggattatcagaactgcctcccctcctgcctctgctgctgctgggcgagcaaagccccttggtagggggaagcccttcaaagttgtaggagcaggccagggtgcggtggcaggtgcctgtaatcccagcactttgggagaccaaggcaagagaattgctggaggccaggagtttaagaccagcctgagcaacacagtgagacctcatctctacaaaaataaaaaataaaaaaataaccaggcatagtggtgcacacctgtagttccagctacttgggaggctcaggtgggaggattgcttgagctcgggagtttgaagctgcagtgagctatgcactccagcctggataacagaacatggaggcagggaggtgggggtgaggtggtagggaccctcttgatgggcagtcttgggctgcgctctgggccttgccctgtaagaggaaggggaccagcgggccagccttgggtttagctgtggtgtccctcatgggctgctgctggtccccagcaggtatgtgggacccctgaccctttctttgtatctcccacagtgaacatctttctcaccgggagactcagcagtgcggttcctgccttaggtaagtaagcactttctctccttcctccactccttcagtcccttttgggtgagtggtccctgaagayaggccttcagggtcctggcactaccccgagttcctgtgtgcatcttttctacatcacaaaggagctgtttggctttggacaggcttcaacttgtctgagcctcagtttcctcatctgtaaagtgggtgaaataacaaggtctactcaaaacctgtctcttagtattccatgagccagtgaggcaagctcttagtgtggtgcctggcacgtggtggctttataccaccggcaagctgccgagggtcccgtggaattgacatcttgtgcctcattgcaggccatgagcttcctaggatttaatttataggrgtatgactgaggggtgacacagagaggcccatgccagggaaagaaggctttattaattttcttgaaaggaggggacatgcyacgccatgcagggccacctgggaattactagatttggacaagcaggagcaggggtggaagaaaggtgtaagttagaagctgcatcacagcttccgtgggaaagtctcgacatccaggtgctgtggctcacgcctgtgatcccagcatttgggaggctgaggcaagagaatgcttgagccctggagtttgagaccagcctgagcaacatagtgaaactccatctctacaaaaaaaatctgaaaattagctgggcacggtggcatgtgcctgtagtcttagctactcgggagactgaggcargatgattgcttgagcccaggagtttgagattgtagtgggctatgacggctccacygtgctccagcctgggtgacagagcgagaccctgtctgtaaaaccaaaaccaaaacctgaggtcaaggtgcagcccgggagaacaatgggggcctctgacttgttcgttgcctgctgctctgctcggtggggcaggaggtgcctgggtttctagttctgtgcagggcccggcttgctggagaaaggacccggagctgtcaggcagcgggacccctgctgtggtcraaggggaggcccagggtgcacagaagctgtgctcactggctcctctggcaggcttgggcctctttccctctctctctgccctgagctgtgctctcaggagcccggcctcctctgatgcttcgggctggctcaaggccgggccttgctcagcrctgacctagccccagccctgtctgctgtcctggtccacacaactgatggaggcccagtctcccatcccaatttccaggaaaaggctgactggcccagcctgggtcagatgtctgtggccatggtagagtcaggggaagggggaatgagggtgtcacagcttatgaatgtgagccccaggacaccctcctgctggtgggtgtgtcaccccaaatgtgtatatactccactttcagaaaagtgcttccctggggactagggccagtcatggagcttgggcgaggaggacactgtccaggtccttgcgtttggttgtccttagctgtcaagacctcaggccccagcagggtccacgttgccaaactccaacggctgctgttcacccctggtgccctctgtgatgggagctgcacgcccagcgcgcaaggccatgggtggtgatctgggaccctagctgtcctagagtccacttctgacacctccagcattactgaccacctgcaggtggcccaaggtacccacctcccaccacagctccatgactctgcatttccagagctttccctgggattcctgctgtgtgggaccctggattgggaaacattcccccagccccttctccaccctaactaggctcagttgctccagagggtctagcagggctacctggggacctcacaggtttttacccctcagcaaaccccatcctaagcccaggtatgttgggccctgactggtcagaacacctcctgcatccccccagcctctgggctcagccctgaagctactgtggctccaacggggagggcctgggcaggggcttcatgcagtttgcaggcagctggcagcttccccggcacgtctggggtgggactcccagctccccgtcgtcggattacaccaggcaggttggcgggggtattgatcaactttggaaattggatctgcaaattgtgctttctcaggccttgcagtgtcctctcaggaatatttgatgactctttggaccaggaaaggacactggcccgaaagtacctggtcattccttccctacttgtgtgggccaccatggctccgagggcccaggccatcttctgcctgagagaagkcaggtcacctccagctgaagctcagacagacctcttgacagcccccaacacctccgaacccctccctcttccccattatcccgcaaatcatgcagtcctcccatctgccctcactgcctgcccgctgctacacagcctgtcatgaacctcacctccatggagcattcctggagatccccctcctcattggcaacccctgaccctgtgccctaccacatgcacgtctgcctcaggtcaagcagggttcttgcctaggctgggcatggtggggcacacctgtagtctcagcactttgggaggctgaggtgggaggatcacttgagcctggaagttaaggctgcagtgagctgtgatcgcaccactgcactccagcctgggagacagagcaagatcttgtctcagaaaaaaaaaaaaaaaaaggagtccctgcctagaacttgcagctscctgcacagagcccagcctccctcctgcctcccatcccctctgcatgaggctgggctgctgctgcacccaccatggtctctgccaacccgctttggagaagagcaaacagtttaaccaagtttccctgatgtggaaatttccggggggcccccaggggtgaggctgtttggaggcacccgttgtcagggttttgctgagaggcagggcagctggcagttgtcccttcctctgctcctgatgtggctggtggcctcccaacccctgatgaagrggtcagacataggtctatgagggagaagggttctggctgaagtgagtgggaagagagaaaggtggcaggtgacacctggcttttcccagaaagcgtgggtgagacacctggcccccaagggccccaaggagaggggcaggtctatgtctgtcccctaggggaggcctctggggctgagtaggaatggacagcgccttgccctgcccctggccttgtcctccaggacaggggacstcacaggtttttacccctcagcaaaaaggtgaacatgggaggttcccagccacgctgactcagaggctgacacttcagcttagcatgcgctttagagatgcaatgtgggggaccataccacttcagcctcactgggccttcccttctgtggaacctcctgttcrgccccctccaatgggaaagatctcttcttttggatttccttcttttttttaawtttttttggagaaaaagtcttgctgtgtcacccaggctggagtgcagtggtgtgatcttggttcaccacaacatccgcctcctgggttcaagcgattctcctgcctcggcctcctgagtagctgggatcacagacgcccagtaccacgcctggctaatttttatacttttagtagagacagggttttgccatgttggtcaggctgatctcaaactcctgacctcaaattatccccccgccttggcctcccaaagtgctgagactgcaggtgtgagccactgcacccggtctcttttggatttcttcaccctacacctcccaaggaatcccagttcaggacctcagggctctgtgaggtcctcatggccagtagcctcacccggcaaagggaaccaggctggggccggggccactttgcatgtttgggtggctgcaccctgagactcctttctgatagtttatctcctgcccttcctggctgggagcagggtgtacagtgccctatttctggggcaggatcagaggctcattgtgggggctgcctcccagggccatgcatgagttccaggtggagaggtgctggcttgcacctcactgacctgggactgtcaagggtctgatggtgacgcagtggtggccagccttgctttaggaccaagagttctgttcttatccttgatgctctcacgagctgtccgtgggggttactggctccctatttgtcacagtcccgactcacctgggccttcatggtcctagtaggcccccaggggaaggggcttcagctctcagctcatggctccagctgcccagcaggtcctcagatggacccgtccactcagggacccacatctctggagcacctgccatgcattaggcactgtgcagggccctgggacatggcacggccctacctgcctgtgtgatgttcatccatcagtcccaacaacaaaagggaaatgctctgtggccgaggctggggggagggatggagggttggagctctgtgggggctatcccggagggcttccctgggaagggaccttggagctaggggtggaagctgaggagtccgtgaatgggataagaaggtggggatagcacccactagggaccaccagggcctccagggcaaagtcccctccaatgtgagagatcggagaggtccggggggctaggggttatgggagggatgaggcagagtgtggggcagggagggggctggcgctgctgtagtgaattgtggttttgtcctaagagcatgggaggcagccagagggctctccttcctttcctgcagctgggtgccagagagtcttgctgagaaccagagagaacttggcttgcaaggtcacggtgccaggggccagccatgggagagtgaggagagagtgtcactgggctcgggaaaggggtcgtccctcacctcagtttttccatctgcaaaatgggccctgccttcatctcaggctgttgtgagaawcagatggaccagcgtggggaagggtcagggtgctgtggggtgggaggtgtggtcaagtgcaggggccagccgcctggtcctgggagggtcagggcacagcggggcagggcaggctcaccacactgccctggatggtttagaagcagagagcatggagaatggatggattaaagcgaggcccatggggctgggcatggagggctcctcctttgagctggcgggcgtgatgctttgctcaacctgagcggtatacagttggcactccatgagtgcatgctggctcagtgctgcagcaagaagctgaggcccccagaggcctacagtgattcctgactctgcccctccctaactgtgtggccccaggcaagtcgctgaycctctctgagcctgtttcctcacctggttccgagatctacctttggcggctttscacttgtactcaggataaaactcaaattctgcacaaggtgtgatcagatccaggtggcgtttccagccacagctggactttgccacctctcttcaggcctgttgtagtatcttcattccactgaggggttctgcgtaaagttcgtctgctcccacccccagcctatgagttccatagagcaggccttattcccaccttactcagtgtgcctaccatgcatgcttggcatgtagtaggtgctcagtaaatacttgttgagtgagcaaagcctcagggaaggcaggcagggggccatcgcaggatgggctatgccggctgggcaggcctaggggtgtgggattctccactgacccgaggccacgaggctacaccttggaggtgccggctggcaggasgggttgttggtgggttttctcccagctctgccagagatgcgggggacaggacctaggctgtagtccactgcatagggttgggggctacagctgcctcaagtctagggggccctccttggcctcccgtacacaccacctccatgaagtcacaagttgtggccttgcccttggccatggccacccttggctggactcgatcccaccatgggggaggcctgtgctgaagcccccktcccccyactgcaaccbgcatcccaaccaaagatgggccggcctttctcggcctcctctcccgacagcggcctgcagtgggaagctggagcagcacacrgagcggcgtggggtcatctacagcccggcctggcccctcaactacccgccaggcaccaactgcagytggtacatccagggygaccgtggtgacatgattaccatcaggtaggggcacccgggggtgtcggaaggaatcaatgtgggcccacgtgcatggggtgggtgagaatgtgtgtgtgtgagcaggtgtggagggcacacgcctgagggtgtacatgtgtgtgagcaggtgtgggatcatgtgcatgtgtgtgagcatatgagtgaggcgtgtgtgagcactcgtgtgaacaggtgtatgggtgtgtgcatgtgtgtgagcatttgtgagtaggtgtgtgtgcatgcagatgtgtgtgtgtgaggtaggygtgtgtaggtatttgagcaggtatgtggtgtgtgcatgcatgtgaacacatgtaagtaggtgtgtgtgcatatgtgtgtgtgtgcatgtatgtgaacacatgtgtgcttgtgtacatggaaaagcccatgtcggagaagacataaaggacacatgtgagagactgcatgtgtgagcacatgtatgtgcacgagccatgcctgcaaaggtgcagagagcgtgtatgtgygcatgcatgtaagataacaggtgtaaccatgtgtgaaccgtaagcatgtatgtgcacatgtgaatgcatgcacgcaagtgtgtccagtgctctgggtctccacgggcctctgtggcgaggtgcccaagctggacctcttcctggtttgagcctcgttcatggggtgtggggggtctcagtcactcagctctgccaggaaggcagggccagcacacaggccactgggaacacagcctgggactggtgggcatggtctgatgtctctgaggtggcagaggtgtcctctctgtcctgcaggggtggctgggggccaggctggcactgagcccagagcatggtttctggagggggccttggggaggggagtgaatcaggcaaagcccgggtgcttgagctgcagggacatgcagagggaaagggggccaggcagtgagcggtggtcctggccaggggtggtcacagggacatttggctggggagtcactataggttccatctgccatagttttcctaaatgccagagcccaaaaagcgcaacccctgacttactccatagctgcaatgcgtgaggatgtgatgggcatgggcagggtctatcctagtctctgtgcctcagtttccccaagggccaggtggttcagggccagtgtatctccggagatgacaagctgtcaacctgctgcagccttagccagccccgtgggcagtctcaccctcacttcccatgcctgggactttgtgctgggcccatcccagtggtcccgaggtggagggttctgggcccttgggccactgcccttttggggagggtgtcggggcagggggctcttgacttcctgctccacttcggcttckggctgggggtactgtgtgcactgatggagggaaggggagccgcagcagagctggaaatgacctgcgtggatgtcgcaattcttcatggagcctcccgtgcacacctggatggggacagtgtggggacagagtggctgggagtggaggaaccaggcagtctggaacatgaggagtgggggcagccggccgggacagggctggctgtcctggccgtggctccagcctgaccactccctgctggtcctcggccatggagatcccacctactgcctcatgtctgggtcctctccgcccccccgcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgaggtgatggaggctgcagggcaggcaggacaccacggagcacaccgtgcatgcccacaggctcccggcccacargggcggcaccctccacagggccccggctccctgtgggatgtcccctgaccgccctgtcaatctcaggacagtggcaggactgggcatgcggatgccttggacctctcaaggtcactggccccacttcccagtcttggctagtcctgggaactcacccctaaccccaggctcaggtcagggacagagcccaccctggtgttggaggggtctctgctgccacagtgatggggaaccacctgcccgcttttggccccaggccccctggccgaagggaggctcttctgtctcctgactgtcccctgctaygtctccaccccacagggaagctggrccaggcatcctgccaggcagatgagttccgctgtgacaacggcaagtgcctgcccggcccgtggcagtgcaacacggtggacgagtgtggagacggctctgatgagggcaactgctcggcgcccgcctccgagcctccaggcagcctgtgcccyggggggaccttcccatgcagcggggcgcgctccacgcgytgcctgcctgtggagcggcgctgtgacggcttgcaggactgcggcgacggctcggatgaggcgggctgccccgacctggcgtgcggccggcggctgggcagcttctacggctcctttgcctccccagacctgttcggygccgctcgcgggccctcagaccttcactgcacgtggctggtggacacacaggactcccggcgggtgctgctgcagctggaactgcggctgggctatgacgactacgtgcaggtatacgagggcctgggygagcgcggggaccgcctgctgcagacgctgtcctaccgcagcaaccaccggcccgtgagcctggaggccgcccagggccgcctcacygtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggycgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacaggtgggcgctgtgcccgcagccaggggaccgggcttcttcatcacccaggcttgctgtccccgtagctgtgggtttgcaaacgggggcctggactagctacatggaggctgcyctggtgcacactggggtccctatatcttggggtgtctgggtggagggtcgtcctggaatcctgttgttgttcctgctgcaggtcccgggcagcccagtcatgtcgccctccgcccactgcttctagggccttcgagacccagatgacgcgcctggaggctgagttygtgcggcgggaggcacccccatcctatggtcagctcatcgcccagggcctcattccacccgtggaggactttcctgtctacagtgcgtcccaggtgagcccccggagggcgtgaggcccctccggggccacttgggacagtgtgcggaggaggctggtccaggggtcacaggagcaggaggcaaggcctgcgcagggtgacctgagggcccatggccaggtggggggggtggacaaggtggtctctcgggtctcaggtcccttgggggtgtgctgtctcctgcccctgagcagcctgtctgccccctcagccgcatccccccgcccctaccctgctccaccccacaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggyagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtcwgttgaccgctgggctcgctggtgaccgccacagccccgctttgtaaccagggaatacacagtcatttctaccctgcctctgcgtcctttcttatggagaggccctccggggaccccagcggaggggctggcccctaagccagctggctgcactggtgggcgggagctgtgggactgaacggggcggggggggagaagagtggagtggtgagcccgtctgcagggtcccattgtacacaagcaccctggggtctcacttctctccccccactccattctgggaacccatttccagagaagcaggggaccagagcctttttgcttcatctgccctgcagtggcaacagctgcccctagagctgggagttgtcatgaggatggggccgggccatggggacgctgggtctcatccgtggtgactattttgctcacgcctcaccctcttcctgtccagcaaggcctctggaggacctgggttgggtggctcctgccaaaccctcatgcccctggccaggcaggcgccctttgccctccctgaaggtccaatctcctgggcacygtggaagggctggggtgtgtgcctgctgtacatgaagcccctggagttccctgcaggcctcaaagcccccaggacatgctgctctgtgctttctggggacagagaggccgaggcaccaacagcartggccacgtctgttccatcctatctcagggcctcggtttccccacctgtaagccagggtgagactgtgggctctgaagtcctgaccttcactctgtggtgatttacgggaagaaagrcaatcccagcctggagcccctgagctctcctgggtggccgagctcagactggcatcgaggggcctggggtaggggcggactgagctgctaccccatcctcgacatccctttagggcagggggactctgggtgccatggtagggagcgcctgtgtcaagcagcaaagccccctaatgtcaagagcctcctccagggcctgccacggcatcttcctggccagcaacatgtgtgcacccaccgaggtacgccccagccactcccrtctgtgcccatcagggactccccatagcacgagcgaacagccagccctgtttatttataggccttttcaggaaragctagcagggcagtgctaagacaggaaacccagtccacattttagggcttccttaaaacaggcttctgagagtcgtatcttttttcttttttttccagaaaaaaacaaaacaaaacttttttgccaaaacacctcctcaataaacaacatgtaaacagaaacaactgcttcagtctctacaaaaatctcattgtggcttcgagggcttgtctgtggcaggcagcagggagggtgggcaggggccattctcctcctcttcgggggcgtcctgggggtagaccacgaaacacagctcctggccccagtgtgtcatggactctgaggacagacagatggaccttggggcctgacctctcgggataggggtgacccccagctccggacacctccccttgggcaggggtcttcagggagttgctccgtcggtacccgtggttctggaaactttgggtacatcttgggaagagacatttggtggcggctgggccctgtgttcccacctcagctgctaggacaccctgctctggggtgagcctctaagagggaggtctggtctccaggccccggccccctgtgctgggtgacctgcagctgcccggctcacctgtgagtctgtgcacacactttggtttgcttctccagaacactcccagaaagaaaatgggcaccccmgtaaggatgatgatgacgccgaccccacagaccataggctctgagatgaagctgaagaccagcaggaaggcccagaagaccaagtacgccacggggatgagaaggttcacctggggaagggggagcagaaacaccgatggtgcagggcctccagctgtctgtacccccgacccctgggggtctggggaattttcctcccttccctgggagctgaggcctgaagggcaattgcacccactacaccccctcttggcgacagcccagtgtgttggaggccaattcatgggtcaggccgttggccagttttgctgaggatttttcaaagtctcagcggcaccgagctccacacagcggttgcgtgtggacttgaggcttgcacttggctggaggtcagtgattttttggtgtttcacatttcaggcactgagcacttctccacttaaggatttatacacacatggggggctttgcttttagctcaggctatggtcttctgtttttgtgtgggctcatgaaatcctggcagcctttgtgaccttgaacagttcctgagtctcattttctttaattttttttttttttttgagacagggtctccctctgtcacccaggttggagtacggtggccctagcaccgctcactgcagcctcaacctcccgggctcaagcgatcctcccatttcagcctctcaagtagctgggaccacaggtgcgcaccaccacaccaggctaacccttttatttttaactttttgcagagaggaagtctcgttatgttgcccaggctggtctcaaactcctgggctccagcaatcctcccacctcggcctcccaaagtgctggaataggcatgagcccctgtgcccagtcctgagcctcattttcgccatctgtacactgggagcattcaaagctctgtcctcatggggctgctatgaggaatggctgcctcagtgcacagagagccctgagcagggcccaacactccacaaaagctggcacctcccatcccacctgcccctggtgcccactgtggatgcaggggtggctctggcagcacccggcacagggccagctgtcccagggcctcaccttgatgggcctgtggagtgcaggcygcctccagcgcagcagcagcaggcccaggatggtgacgccgtagcagaggtagttgatgaaggacacatagttgatgagcgtgtacgtgtcgcccacgagcatgatgacggctgtggccccrcactgggagaggacctggggctgacggctggcccctagcctgcctcctgacgcccctgcaggatgagccctggccccacccccaacccccaccctggaatggctcacccctgccattacccggaaggtcctgcattgccgggtagccctgcctccacgccctgcctggcccaggtcccccaacttacacagacgaggagggcggggatgggggtgcagtgtctgacgtggatcatggccagcaggctgggcaggtgcccctcgcgggctccagagaagcacagcctagcgttggggacagatatgggcactggccacatcctgggtctcagctttggacctgatgtccctcttaagctgtcgcctctgacctcctgctccgggcccagcagccccactggacagttctccccctcatccagcctgcctgcctcttgctttctttgcctcccagttgtgatcagacacttgttaccgtgtgggatcatcatcccagcttcaggcagacccctcccccggcaggtgtcccttcctctggcccacggcatgactggtgcacacctgcaccccagccttccctccccatgcccacgtctccccagtgcagtcacctggagtaggtgaacaggtaaccattgatccctccgaaggttgacagagccacggagacaggcatgacccaagaaaagtagcccagcagcttctccccgaaggtctgggtgggcrcagtagagaggccrtgtgtaaggccggggcaggggcctgggcaggagccagggaccgagcaggggcccactcaccacagccaccgcattggaggagagcagctcctggggggacatggccgtgaagtaggcaatgttggtgaacgtgtacacgaaggtcaccagtgggatggagatgaagatggcgcgaggtaggttcctggtgacaggcagtggagtgcgtcagcgtcagctcctgagggtgcaggacccccgagacccagccacgagagcagctcatagtctccatctcttgtgtctgctggggatgttggggcaggaaagggggcagcattgctgcccgagacacagggaccctgttgtctgccctgccccacccccacctggacacaggctggtaggatgggagatgggggaggggccccatcacatcctgaggacagggtctgatgtctgtgcagaaagataaaatcgcatacagccaaaatcagcctggaaaattccccaaaatggccccagagcccagtccacagacccagagtcttcctggaactttccagtcccagctcgctcagctgcaaaggtttactgtcgagatccctggccgagcatcagacgcagtcattggcttcatttgtagggaccatattgtgtgtatatgcataattttaggccaaatgcaaatctctggatctatttacagcaggatgatgatattcagcctttctgaggccctgcaaggggctgtgacgtgtccatagccagagagaacagggccaggctagaatgcaagccccccggctttcttcccagggccatttttgcagggcaacaggcgtgggccaccgaggaccagccygagccttgggtggcagtggggctgggcggagaggctgcctgtcccaccagagggcctggctgcttcccagggcccagttgggggccccactcactttcgggcgtcaaccatctcctcggtgacatagttgaggaagttccagccactgaaggcgaaggagccctggaggaaggccagggccaggtgtcccacggagggcgtcatccagaaagcaaaggcattgctgggcctcagctcctcgaagtgtcctggaggcccagaagtcgggggtcagcaccatctccccagcccggcccttaccccgactcggccctaccttggaagatctggagaaggcccacgccgatgatgagggacaaggccagcagcttcccgcctgtgaacatgtcctggatgcgcgtggcccagcgcacactggagctgttcacccatgtcaggagcactgcggagggaaggcgggggtgggcgccgaggccgggacctttcacagtggaccatggccaagtccagcccaggcggcccgagaatggcatcccctatagcagctggaattttctgaagggaaatttcacccctctgtcctcctgctcagggcaggatggagcccgggcaggtggctgatctggggacagtgggccaaaggggatgcttactcaggcaggccatggacagcacccgggaggctgtggtgggggggatgcagttggggaacacgggctgcagcacgtagttggagaaggtcatggagatgacagcaaggctggtggggtacatgatgaggacggcgctccagagcagcagaaagctggaaggagcaggggcgggagtggctcaagctgcccagagcccttcccggccaacctggccctgatgtgtgcagcagggctgccctgggcctggcgcccgggggctggcgaggctgccagaggccagcaccggtccagggaggcagggttgaccttgttgaggtcttgcggctgcattgatagactgttttaacagagaaggtgttacccgtacttaaacattgacaaggctgctgtggggcaggcgctgggaacaacataggcaccaaacgcttttcttttcttttttctttttttttttttgagacggagtcttgctctgtcacccaggctggagtgcagtggcatgatctcggctcactgcaacctccacctctcgggttcatgccattcttctgcctcagtctcccaagtagctgggactacaggcgcctgccaccatgcctggcaaattttttgtatttttagtagagacggagtttcaccgtgttagccaggatggtcttgatctcctgacctcgtgatccacccgcctcggcctcccaaagtgttgggattacaggcgtgagccactgcgcccagtcaccaaatgcttttctaataacaactaggccccccattggacggaggctgtctcctgagccagggtccctgtccccagacctctcggcttcagccctggctctcgcagagtactgtggctgaagatgggtgactctgagctgtgttccccctgagggagacctatggggtgcagagactagaccttaccaagagccctagctgggggtggagagtgatggatgccccttctacctaaatcttgcctctgcagggcacccagactgtgagtctgacctgttctcaggggctttcctgcacccaggggtgggtctgcccttgggggtggtcctagcccctggccagccctccagggagaggactgcctcatcggggacatcagccatctctggatcacctgccccttgctctgcacaaccatccctgctgggcttctgggacatcctagctccatggccctcctcccctgccaggcatcccctctgcccatccccgcatgttccgtgcccagggatgaggtcctggccctcttctccctcccgaacgtcctctccaggcccgaagcatgattattctgctttcttgggtcccagcccctttgaggaccctctccccagaggagactgccacagatgcacccacagcagcgtgcaagccctggcacgtctccccatccaaggctgcccagttaagggtccccggcccatatccctcagaaccaaactttgtaaatttcagcccagacttttcctctgagccccagaccatctaggagcctctcagtagggaagtgggtgccacctccgctgcacccacctctccctctgctatgctggctgccctatcctctcgaatcaggctcctaaacgattttagaatctgcctgtacctttgcagctcttggcacaacgcagctggacaaatacaacagcttcaatcccctgatgctctccaagccccggcrcctgccgtaaacccaacctgacctcacctctagctacagcagactccctgcgctcacctgggccaccacaccctctgttcacacttcccccatcctgggatgctttcctcactggtcagctaggcccggtggggaaaatcttcttcctcccagccttagggcaagcattgctttcctgggagtcctccctagatggcgcacaccgttctctttgctgtgtagctgctgcctcttgtacacactctcaaagcaaggctcatccaggccttaatcccatttaaggggctgcttcctctctgttctgtgagcagct

SEQ ID NO: 17679 - DNA, 20320 bp, Homo sapiens
agctcatgcaatccacctgccttggcctcccaaagtgctaggattacagttgagccactgcacctggcctccaagctcttttagtctatatggaaaagtccctccacttagccatttgtttggcatttaaaaaataaaactatcactaggaatctaaaaaaagaacaagtacaaaagtgctgaagcaattaactttctgagaacagattctctagaaaagtcgcctcgaggtggtttggttggcacaaggctctcaggtatacatccctttccttgattcatccctgtctggggaatgctgcccaaagacctgccttgtagtcccgggccatccccacctctgtgttctcctccggcccccatctcaaaggatggggttgaagtagaagccccagtagatagatagtttgtagtttagttgggtgaaaaaaataaaacaacactccctagatatatgatgcattggctgacattttccccacttgtttggtgatgagaatcctctgggtcacctattaaggttccttcagattccctcctatcagattccttcacttgaggccaggagttcaagaccagcctggacaacatagagagacctcatctctacaaaaattaaaaaaataacagggcataatggtgcatacctgtggtcccagctactagggaggctgaggtaggaggactgcttgagccaaggggtttaaggctgcagtaaggtatgattgcatcactgcactctagtctgggtaacagactgacacgctgtctctctttaaaaaaaatcagatttctaggccccgtctaaagaatcagaatttacaaatgggtaacctgaaaatctgtacttcttcaactttcaagccaagtgactcttatcatcagacaagtgtggcaaagataacattactgaatatttattatttcagatacctgggcatctactcaacagggctttttttcgtctttttttttttcccccttcagggaaggataaagagacaatgccatcttagtgatgattatcaacacaggcttgggagcaggaaacctgggtttgatttgccaggtattggctgtgtgatcttggacaagttatttaacctctcagtgcctcagtttctttatccataaagtggggatgatattgcatctccttcactgaggatcaaatgaaataatgcatacagaactgttagtccagtgcctgctaaataaaagccattgtcaataaatagatgctattgttatttccccatagaagaaccctagagtatccccatcatataaatatgggtgaatagttgtggaaaaggaagactggctatgggtggttccaggagtccacacagatatataagcacagccagaaggcccagtgatcacttctctgactagacccagcagacacaactgtggctggctacattagacaaatggaagaacactttaatcagtctggttcaaggtgggcaggcaggaatcaaggcagacatgacttggatggacagctggagctatcctgggatgtcaccatgggttagaagtaggaagattcccagttagaaggacaagcacctccactagcctgattgaatttgatactgcctcagagatagttctccaaacctggagtcaaccaggtctgcatgtgagtcttggtgcttccatttccctggagtttaaccttgtggaaattgcttaagcccagtgaaccttcattttctcatccataaaatggtgacattaatagtaccttccttaaaggtgttaagatgtaaaaagaaaatgaatgtaatgcaaataaaagttggttattattattattatctatctttaacaagggataaattgtaagattgtattgtccccttggagacaacagacttcttttttatttttattttttgagacagagtctcattgcccaggctggagtgcagtggtgtgatcaaggttcatcgccacctcaacctcccaagctcaagcaatcctcccacctcagcctcctgagtagttgggaccacaggtgtgtgccaccacttctggctaatttttaaaaaatatattatagagacgaggtctcactatgttgcccaaactggtctgatactcctgggctcaagccatcctcctgcctcggcctcccaaaatgttgggattacaggtgtgagccactgcatctggcactcttccttttctttagtccctgccacattccccaccatcactgtctccagagtaaacaaagaacgcccatgtagattacccacatactgttcctcccattcactctgcacacacacctgcctccagggatccctgctccctcttcccacagatattcatacatttagtcctctagcagccttctcaaaggagactgtcccctctgcaggacgtggctgcctccaaaccctcctcagaggctcagcaaaccagagaaaagaagcaccttctgcaggagggtgggcaagatagattgaggatggggatggatggtgatcgggaaaagggaggagctgaggattcagaataagaaaggagagggtggaaatgtgtcatgaagttcctcaaaatctgtgaatcctgaatctcatcatttttagtgaatgaactcagatgattcacttcccttcattagcctctattttcctctctgtgtaatggaaggggaagtgcttgctttgaagacagagatgcatatagaatccagcacatagaatccagcttgggagagccatgagcatgtggaattagacatcatatgggttatgaatattatgttagttttcttctgaataggattttttcagtatttcagcttctggctgaacatatatccctaaatattattgattttttggcagtcttcagcaagcccaccatttgctggttagtcatcccagtcctttgttcctgggcatgcccctttgcttctagttaagcatctattgccacccaacatggtaaccagaactctgagcagaagttttaggaccagggcctaactttggttcctggtgaggggctcagaatccagaaggtctggtaagccatgaccaacactactttttttttttttttaatggagtctcgctttgtcacccaggctggagtgcagtggcccgatctcggctcactgcaccctctgcctcccgggttcaagcgagtcttctgcctcagcctcctgaggagctgggattacaggcgtgtgacaccacactggctaatgtttgtatttttagtagagacggggtttcaccatgttggccaggccagtctcgaactcctgacctcaagtgatccagccgcctcagcatcccaaagtgctgggattacaggcgtgagccaccacacctggcaaactactttaaagcagtaagttcctgacttaggtaataagtgggtttgggtcagggagggacaaagaaaaatttggccaagactcatgacatacatgcagaagtctgagctgagtggcctgggtaggcctaggaagcaggccagagctggtaaggcagaaaaagagtgaggaaggttaggggggtcatagcctgatgctggagggaccagctttagttcccctttcatggtgctactgacgacagtgtaacctcagggttcagcccctgggctctttgctttccatgagtaaggaagcaagaatgctgcctccctccaccccttccacagcctgctgggggcctgcagctccagcaatccccctatcatgttacatgcccagaagcggctttcagtgcctgccgttgccagctggcttcacccttcacactagacactcaggaagaaggggtccttagactcaaggaagctatgtgaccagcattccgtacctccttcccagaactgttgaagagtccgtctgccccatgtgtaggagggaaagaggcgcttcaggccacacagggacacagacaagagggagagggagtaagcataggcaatgtgggagtgaacagcacatgcagctgtgggtccagctgcctgattgctgggaactgctggccaaggatacagcatccccattggcctggaatcctggaatggactccagcctgacttggtcttctgagtcaatccagccacagtcaaaaaggggaggcaggcactcgatgtaggaattacagtttacacagttcctcttcctatctctagcatccagaactgcgcccagcacacagtaggtccatgataaatatggaatgaatgaatacttttacatgcaagcatgatctcagccaatctgcagagtgaggcacaggctggacaggtggatcacctgaggtcaggggttcaagaccagcctggacaacatggtgaaaccccatctctactaaaaatataaaattagaccggcatggtggcagacacctgtaatcccagctacttgggaggctgaggcaggagaattgcttgaacccagaaggtggagggtgcagagagccaagattgtaccattgcactccagcctgggtgacaagagcgagactccacgtcaaaaaaaaaaaaaaaaaaaaaagagttaagcaacttgcctaagatcattcaactttgatgtagcagactgaaggctaggcactgtggtctttctatagtgccatgctgagcattcttcatatacaacacagaattgcatcctatgactccatgggaacttccttttgggtcagaaaatagtccttaggggctgagtttcctggacttagtctcagggccaggtttggataccctgcccctccctgcgcatctggcatctgccttcccttttatgagaatctcctggaaagggcttctccagcagtctgtgttgccacatctgactcaggagctctgtacccttgagacacagaggcaggggttggtggcttcaccctaggagtcaggaaaagaatgaaatcatacacattcagttccttattctcttaccctcaacagaaatttcagacagcctagaccacagagacagttcttggaattcaggcaaacaactaatttgtattacagcgggtgcaacttaagagctcagagtccatagtccgagcagtctttctggaaggaggtctccaaagtcaggaggagggctcccctgagctggatcatcttagctcactggcccctcccttcacagcgttctgtcttttatggagacagtgaggtatagcgcataggaacaaggatcagaagacgctgggttttagtgctggctttgctgctcatcaactgtgtatcttctctccacttcattttccatatctgcaaaatgggaacaacaataccagtctatatcataaggcagttatgagtttaaagagaaatggtttacattaatgtgccttgaagcacaagacagaaatacaatataaaaaatatggctggggccgggcacggtggctcacgcctgtaatcccagcactttgggaggccgaggtgggcggatcacaaggtcaggagatcgagaccatcctggctaacacggtgaaaccccatctctactaaaaatacaaaaaattagccgggtgtggtggcaggcgcctgtagtcccagctagtcggtaggctgaggcaggagaatggcgtgaacccgggaggcggagcttgcagtgagccgagattgtgccactgcactccagcctgggtgacagaccgagactccgtctcaaaaaaaaaaaaaaaaaatatggctgggcgtggtggctcatgcctgtaatcccagcactttggaaggatgaggtgggaggaccccttgaacccagaagcccagcaaaaccttgtctttaaaaaaaaaaaagaactgtgcacaaagatttcagagagtgctaaagattagcgcatggataaggaagttctgtgaagagttgaagtgctaggtgaagaggtggcacgggggaggagggggcggaaggggagaaagggtgtcacgcttcataacggtctccaaacctctttgtccaggaggaaatgaagtcatctgctctcagcaatcagcatgacagcctccagccaagtaatctggagtcatgaragctgctaggggagcaacatgaatcatgacggyccctgggaatttcctgataactaacctgggagtttcggggtaagtcctcaggctgcagcatctctgtttatgttctggtcacgtttatttacaattaatgggttctcaaatccaaacaaaactgaccacagtcttctagaggaagtagcaaggttggctctgaagcctatagcatckctgactcagtctgtcccctggaaggctggcagctcagcaagcacagaagtctctccagaagacagtgggtcacctgcctcccaaaagctgaaaggctaacttgtactttccccagcaggcagctggcaycctgagccctcggctggggcagagcaaaggagccttcctccttcctaccttcctggcactctccctgccttccttctgtcactctcaggtggacccagacccaaggtccagatttgcaaggcaggaaaatgctgcaggcctaggctgggaaagggcccaaagccgctagtggattgctgggactcagcctcctccttcccactaagagagcgagtcctactgggttcaaaatgaccccaagccctggttcctgacactaggggaaagagatgggggtgacagaatcacagaatccctgctatgttcctccaagtgtgcccagagatgcgtgtgtgtgtgtgtgtgtatacacaaatgtctgcttatcctcaggcaggaagggtggatgcagtcatttacacatggtctgtttttctggaggacaattttatttgataaacaattgtttctatctgaatagaataaacaaggctctatgatgaagtaaaacactaaatacacatgcattaaaaaatgcataattatctttttggaatgggctatacagagatgtgctttttaaaatgttaagagtgtaaaaggacaaacagtgaaaaataaatcttcctcttattttgtcctccmgtctcccaattcctctactcagaggtgagaacagaacttccacaccctccagaacctccacagttagaactgtctacatgtttccattgtctttacttttattcttgcctgcacaaataaatgaattgctcattatggaaacttcccaaaagacccgttaacacttcartaggaagcaccaacagtttatgccctaggactttgttcccacaatcctgtaacatcatatcacgacacctaacccaatccttatcaagccctgtcaaaaacggactttaaaccaagctgcaaattttcagtaatctggccttgcctttccccctctgatagcaccatcaaacaaacccccttactgccgaaagcaataagcccggctttgttccatccactggttgtgttggtgatatctggggactgccactgaacagacgcacagagggagcccctacaggcaggggtttttctgtctgtgcttctgggagagtatgtctcgtacatttgtcgcgttgatgaagacttcacagctccatcagctgcgggcaagggggtctgaggcagtcttaggcaagttggggcccagcggggagaagttgcagaagaactgattagaggaccccaggaggcttcagagctgggcgaggtagagagtctcctgtgcgccttctctcctctctgcaattcggggactccttgcactggggcaggcccccggccaggtgcatgggaggaagcacggagaatttacaagcctctcgattcctcagtccagacgctgttgggtcccctccgctggagatcgcgcttcccccaaatctttgtgagcgttgcggaagcacgcggggtccgggtcgctgagcgctgcaagacaggggagggagccgggcgggagagggaggggcggcgccggggcgggccctgatatagagcaggcgccgcgggtcgcagcacagtgcggagaccgcagccccggagcccgggccagggtccacctgtccccgcagcgccggctcgcgccctcctgccgcagccaccggtgagtgccgcggtcctgagatccccgggccggatgcgcggcggccccagctcccgagcgtctgcctcccccgccctgggctgcccgggctccctgggctccccggcggctgcacggagtcaaggcgccccgtcccgggcgtcccccgcgggtgccgatccaggctgcccggagtccggagcccakagaggagagagacagctggggagcctggtcaccgcgggcatctcccctgcgctgcagtcgcccgcctggcckgccttcccrttcctccgcctcttgccctgacttctccttcctttgcagagccgcygtctagmgccccgacctcgccaccatgagagccctgctggcgcgcctgcttctctgcgtcctggtcktgagcgactccaaagtgagtgcgctcttgctttgactgatgmtgcccaaggacctctgatcagcaccaggggagaggaggggctgctcagggagctggggtcctccggattccatcyacagcagggccagactctccccaggaaatgggacagggtggcagcggaggcttgagaaccacgggggttggcactggctggcaagggaggaagaggccgccgggactgccccagcctgcgggcatctggtagatgaagcttgcttgggtcaatccatttctcctggctggaaacccatggtcttccatttgagaactagatacgaacagggtgaggcgagagggagagggaagagtgggttttgggattggggccagtttaccctcaccctggagtccctggagcatgggacctttgatgaagcctcctcccgaatctcttccagggcagcaatgaacttcatcaagttccatgtgagtatccacccctacaacagttggctgcacagacaarttgggaagrcttcaggggacatcccctccctgccctctgctgcagggctgcgccaccccttaccacttccactccccctcgcttaccccacctttgttctctccagcgaactgtgactgtctaaatggaggaacatgtgtgtccaacaagtacttctccaacattcactggtgcaactgcccaaagaaattcggagggcagcactgtgaaataggtatggggatctccactgcaactgggagagaaatttggggacagggagggatgggtgggaggcaagagcaggcaggagttaggagctggaggtagggtgggtgacatcttcatccctatgtgacaagcataaacacacacacacgctcaygaaacagtggccacacaaatgtgaggtggggttggaaggagaccctgtccagtcttctggcaggtctgaaacgacatctttaaaatgtccgttggcagccgggcatggtggctcacgcttgtaatcccagcattttgagaggtcaagkktgagtggatcatttgaggtcaggagttcaagaccagcctggacaacatggtgtaaccctgcctctactaaaaatgcaaaaatcagcctggcatggtrgtggatgcctgtagtcccagctacttgggaggctgaggcaggagaattgcttgaacctgggaggcagagatctcagtgagctgagatcacaccactgcactccaactggrcgacagagcaagactccatctcaaaaaaaaaaaawaaaagttagttggaatgttcttctctttctcatattctctcatcctcctgtccccttgtagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctgggraaacataattactgcaggtgaggtgggggcaacaaggaccaaaagccctccctacagcttcccagaaaccttgttaccatccccttctcccagagggctggccatagcacaagagaagtgcrgcctctggttgagtcttccctgaggggaggaggcagggaaggccctctggrttggaatgacatcccctatctttctgtgttgccaggaacccagacaaccggaggcgaccctggtgctatgtgcaggtgggcctaaagcygcttgtccaagagtgcatggtgcatgactgcgcagatggtgagcatcactgacctgctgatgacagtggggtggaaggggacaaacttacatgtccccttattccatcacaggaggactgaggaggtggggggtgcccgagagggatgctttctcctacctgcctccctaagacatccctctgtttgtcctccaggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcatgtacggccctgggtttctcctcttcgactcttctgccccaccccaagcacatccctttctccttcccagcaaagtgttcygcctcatttctccctcatctgcccctgtccatgcagcccatggccttggggacaagtcgtgctttgaggcctctagggagggaaggaagaagtggcagatttcatgggactaagctgtttgatgggtatcttctyccacagtgattacccamagaaggaggactacatcgtctacctgggtcgctcaaggcttaactccaacacgcaaggggagatgaagtttgaggtggaaaacctcatcctacacaaggactacagcgctgacacgcttgctcaccacaaygacattggtgagggggaaccccgcgactactgtggccataatggcttggggagagtgggacccagggagagactggagctgaggttgaagctgcccggtggggcaggggtggggcgagggaccttgaagcctcgatatacatgacaaagggagtggcagggaagagttccatgaagtctgaggggcctggtgctcctctggagagaccctgaatttccccaacaagtagcctcttgcgagtggaaacagccctgtgggtatatggcttgggctgggaaggccctgtttatatgaattagaaaaagacacaccttcctttgtgggatgcagcctctgtctgtgctaggatatagaacttggagaatggagcctygggatggattccagcctaactacctcagctgggagtttttgcagaaacracctgtacagctgtatgcagtggctctggmcatccaagcctttttcaacacctggaacaaagcccttggggcatggggcaggggaggtttccaggtgataagcgaccagcagacctccctggatgactgacctagggataggcatagctacttcctcggcacttggaggggacagatggggaccgcctaaccagtagtgatctttctcctctgaccctctgtcctcccccagccttgctgaagatccrttccaaggagggcaggtgtgcgcagccatcccggactatacagaccatctgcctgccctcgatgtataacgatccccagtttggcacaagctgtgagatcactggctttggaaaagagaattctagtaagtgacaattgcgactgacttagaaggtcctgaggagtgttttgacctgaaaatgagcccagygtgatcaagggaagactgcagagttagaggtgggagcactgargcggtggcagatgggtccagggatggatgaagagtgttgtttagggagcgatgggctgcaaaggtaaatagatggtaggggctataggtggagtaaaggctcagatttgcatggaagagaataagggccttccctggtagagatactttatggttcccctctctggcagactcccagtggacagataaatcttgatgcaaacgcctccctgttttctccacctagccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccaggtgagtgttccaagcatctctctccacctcttccatatctccccagagctcctgggcttgtyccagccagcttaagggtgtctctctctagccaaagccctaagtagccagaatcaggagctcaggtctttgagggtttaaaccagtccttatgtgtttgccagacattaccaaaaaaatcccagctctgcgctagtcacttcagactgggggcacgagatcctagaaagaggaaacagtaaaagacaatgtaactcagtgcccagggtgtgttgtgaactataaatgatcaggtgttcaggagagggaggtgagtgccaacctgagggtcagggaggggaggctttaaaggaaatgtgacttgataggcatttgaagaggcagagggaagaaaggaaggtgtttcagttgaaagatacaaaactgagaaggaggctggcatattccgggtggggaggagaactagggtctgggagtgtggatggaatagtggcagatgacagggcttttaaagccaagcaggggattttaaacttgatgtggtagaaaatggggctgcgtsaggcacagtggctcatgcctgtaatcccagcactttgggaggccgaggtggatggatcacttgaggccaggagtttgagaccggcctggccaacatggtgaaaccctgtgtctactaaaaatgcaaaaaaaaattagccaggtgtggtggtgcctgcctgtaatcccagctaatcaggaggctgagacatgggaatcgcttgagcacaggaggcaagtttgcagtgagctgagatcacgtcattgcacgccagcctgggcgacagagcgagattctgtcctccccccgaaaaaaagaaagaaaatgggaagtcgctaaggactttgactgggaaactcttccctctctctggtatggttgggtgatgggatcagaaatcccctcctcacttctctagggctcatcttttgtatctttggcgtcacagggagactcagggggacccctcgtctgttccctccaaggccgcatgactttgactggaattgtgagctggggccktggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgscacccaccagggygaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtktgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgatgacaaatctccctggtgcttgtatgggaaggagttggagtacataaaaaggagaaaataacaaaggtggactgcaccctagagtttcttatgggactgcatctctggacttaatggagctttgggaggtagaggttaggagagctgtagggcagggccaccacagcacttaatgtatacaaagtttccccaaaccacaatcccatggctgtgtaagtagtgtacaggcttagtgtcagctcccaattgcctccttaacctgatgcctttgtgcagtgcacatcttgtacagctgtacatggtggtcttctttagggttaactccacaacagtctcttcactctgcccccaacaatccttgagctgacctcaaccaagaagaacacctgtggccaggtgtagtggctcatgcctgtaatcctaacattttgagaggctgaggtgggagaatcgcttgagcccaggagtttgagaccagcctgggaaacttagtgagaccctgtctctgcaaaaaataaaaaaattagccaggtgtggtagcacatgtctgtagtcctagctacttgggaggctgaggcaggaggatcataagccaaggagttcaagtttacagtcagctgattgtgccactgcactccagcctaggtgacagagcaagaccctgtctcaaaaaaaaaaaaaaaagaagaagaagaagaagaagacctgtaagtgaaaattgctggccaggctcagtggctcacgcctgtaatccagcactttgggaagccgaggtgtgtggatcacctgaggtcaggagtttgagaccagcctgaccaacatagtgaaaccccatctctactaaaaatacaaaaaaattagccgggtgtgggggtgggtgcctgtaatcccagctactcgggaggctgaggcaggagaatcatttgaacccgggaggcagaggttgcagtgagccgagatcgcaccactgcactccagcctgggcgacagagggaagacttcgcctcaaataaataaaaaaataaagaaagaaagaaaattgcttatccagaatgccagcttgactctgtggcattcaggaaacaaaaaacataatttcccatcatctgtgtgtgggactgatgctggaattttctcagtgtgttaacagagcttgtgaccagccattgctatgcctatgattagggggcccagaatctcaaagctggatgatgtcctaatgggggtgactatatattttgaacaaaacatcaagttctgaaaagctggggtgtagaaggcaggttgggagataattgggtatcaaaaattagaattgccaagctgtgttaatgggttggggcagtgtttcttaatcgagtcatctgaggaccttttaaaatatgcacacctacactccacctgtagagattgtgattcaggtcagggctggctccaggtctcgtggttttagaaaagctccctcagtgttactaacatgcaccactgattgacagcctttggggacaattggtcagaatatatgaagtgcccagaaaaattcaagatatggtcagcatgagttctctgcatgaacagccagttttctgagtggggtttggtggcacaaggtctcctggatttcctggttaaaggctttctggaccgtgcttccctagagggcaagaactccaagtatttggctttttcttttttttgaggcagggtctcactctgtcacccaggctggagtgcagtggcgcaatcttagctcactgcagcttctgcctcccaggttcaagcgattctcctgcctcagcctcccaagtagctgggattacaagcatgcactaccactacccggctcatttttgtgtttttggtagagatggggtttcaccctgttggccaggctggtctcgaactcccgacctcaggtgatctgcctcccttggtctcccaaagtactgggattagtattcggcttttgatccccatcatctagtgtgctgttttacacaggttgatgcagtggtttagagcatggattttcgagtccggtggcctgaactagaatctaacaccagctgtgtgacttgagaaaggttattagcctctctgcacctcagtttcctcatctgtacaaaagagatgatacaatctacctccctgggttgttataaggattcatgaaggccagacacagtggctcagcctgtaatcccagtgcttcgggaggccaaggtgggcggatcacctgaggccaggaattcgagaccagcctgaccaacaaggtgaaaccctgtctccactaaaaaaaaaaaaatacaaaaattagccaggcgtggtggcatatgcctgtaatcccagctactcgggagtctgaggcacgagaattgcttgaaactgggaggtggaatttgcagtgagccgagatcacaccactgcactctatcctgggcaacagagagcaagacttcgtctcaacaacaacaacaacaacagaaaggattcatgagttcataagtcctttagcataatactggcacctaataaaagcataaaaacggtggttattattacaaagctaagtaaattattgtagcatcagatcagatgggaaccctctgccctctcccacctcagaactgcactattttgcgggagtggaaacctgctaggaagctgcccaagccgagtggctgttcagtttctgccttcccctcaggggccaagaaagatcttgttcaaacttgagcagctccagcatcagggctcagagacactgaaaacaggaagtatgagccctactggcagggttaagccaggaggctgttaacaattttcaggccatttcccagccaacaccctgacccccagccagctgctgtctctttgcctaatattagatctcaccccaggctagcaggcatcagccgcttctccagcaaccagtttcacagttccagattctcactccagagactgcctcctattagtgcctccatgatcaagcactgtgctttttctgtttttgcttttgttttttttgttttttttttttttgagatggagtatcgctctgtcgcccaggctggagtgcagtggtgtgatctcggctcactgcaacctccgcctcccaggttcaagcgattctcctgcctcagcctcccgagtagctgggattacaggcgcccaccaccacgcccggctactttttgtattgtttttagtagagatggggtttcaccatgttggccaggatggtcttgatttcctgacttcgtgatccgcctgcctcggcctcccagaatgttgggattacaggcgtgagccaccgtgcccggcctttttttttttgtttgagatggagtcttgctctgtcccccagtttggagtgtagtggctcaatctcagctcactgtgcaacctttgcctcccgggttcaagcagttctcctgcctcagcctcccgagtagctgagattacaggcgcccgccactacgcctggctaattttttgtactttcaatagagatggggtttcaccatgttggccgggttggtctcaaactcctaacctcaagtgatcaacccgcctcagcctcccaaagtgctgggattacaagcatgagccaccatgccagaccaacactgtgctaaattattcatgtgttgtctgagttaatcctcccaagaatcctatgaggaaggtagtatcactagccccatttaacagtagagaaaatggaggcacagacagattgagtgacttgcacgaggcaatgcagctccaaatgcaaagagtcagggttcgaacccaggcagccatctccagagtcctcatgcgcggtactaggatttatcacctctcaggagagtccaactagggcaaaaggagagcagcccccctttcaagctttctactttatggttgctgggtttctaggcaacagctatcagaattttttttttttttttgagacggagtctcactctgttgccaggctggagtgcagtggcgtaatcctggctcactgcaacctccgcctcccgggttcaagtgatcctcctgcctcagcctcctgagtagctgagattacaggcacatgccaccacgcccggctaatttttgtatttttagtagagacggggtttcaccatgttggccaggatggtctcggtctcttgaccttgtgatccacccgctttgggctcccaaagtgctgggattacagttgtaagccacccgcccagcccagaatttttttttttttttccatacacagtcttgctctgtcgcccaggttggagtgcagtggcccatctcggctcactgcaacctctgcttcccaggttcaagctattatcctgcctcagcctcctgagtagctgggattacaggcgtgcaccaccacacccggctaatttttgtatttttagtagagacgggggtttcaccatgttggccaggctggtctcaaactcctgacctcgtggttcacccacctcggcctcccaaagtgctgggattacaggcgtgagccactgcgcccagcctcatctatcagaattttaatcctctcctagataacaattctttcctcctagaagattcccaggccagatgaggagaccacactcagccattggtttcaaagtaaaacttcactgttctcacagtaacctcagcctttctgctgcaatctggtttcattgaagtggtttccgttttcaccagaacccctctttctgaagtattctcagcccattatattaacagcactcagcctgctttccacgtatgccctatctttcccaagctgaccacagcagcacccctgcctatacccctccatactcactcccattgggtccaccttccttccaagaaggaaacatttaagccctccctttgaattagatgaagtaagaggagttgctgaggtgttttttgaaaatcaattctgggctaggtgcaatggctcacacctgtaatcctaatactgtgggaggcctagacgggaggattgcttgagcccaggagctcgaggctgcagtgagctatgattgcactactgcactccagcctgggtgacagagcaagaccctgtctctaaagaaaaaaaatcagttttattgagatataattcatatatcatacaacttacccatttattctttctcttttctagagacagggtcttgctctgtcacccaggctgatctcaaactcctaggccagagtgatcctcccacctcagcctcctgagtggctggaattacaggctcataccaccacgtctggcaccatttgaagtgtacaatgcaatggtttttagtagattcacagaattgtgagacatcacaatcaattttagaacacttcatcacctcacaaagaaatcctgtacccactcacaatcactccttttttctccccaaccccctcagccctaggcaatcactaatttactactttctgtcctctctgtgggtttgccaattctgggcatttcatatcaatagaatcctataatatgtggttctttgtgactggcctctttcactcttaacatgatgttttcaagttttatccatggcatagcatgtgtcagtgaggttgctgagttttaataacaaattgagggaaaagatggtctaggcgaggtgcagtggctcacatctgtaaattccagcactttgggataccaaagtgggaggatcccttgagttcaggagttccagaacagcctgggcaacataaagaggccccatctcaaaaaaaaaaaaaaaaaaaaaaaggatgttctaggtctctttttgaggtttcagtcacattgagattcattcaacaatctttgtcatttctttctttctttctttttttttttgagatggaatctcgctctgtcgcccaggctggagtgcagtggcgcaatctcggcttactgcaatctctgcctcccaggttcaagcaattctctgcctcagcctcccgagtagctgggattacaggtgcctg

SEQ ID NO: 17680 - DNA, 32304 bp, Homo sapiens
cggccagccaccctgtccaggaggtgaggggcacctctgcccagccgcccctactgggaagtgaggagcccatctgcccggccaccaccccgtctgggaggtgtactcaacagctcattgagaacgggccatgatgacaatggcggttttgtggaatagaaaggggggaaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtcccctcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaaaaaaaaaagaaagttggaaaggcttcaggattgtcagttaaatataattgtttttgcctgggtctactgacagacaggtttacatcgtctctattacttttctttttctttttttttttttttaaatttgttttttgtttttgagctggagttttgctctcattgcccaggctggagtgcagtggtgagatctcagctcaccacaacttccgtctcccaggttcaagtgattctcctgcctcagccttccgaatagctaaactacatgtgtatgccaccatacttggctaattgttgtatttgtagtagaaacaggatttcaccatgttggccaggctggtctcgaactcctgacctcaattgatctgcccaccttggcctcccaaagtgctgggattacaggcatgggccaccgtgcccagcctattacatgttttaaggtcataaaactgctacttctggaatatttcttaaacttgcttgatttgtctaaattgagctaaagctgtaaggtctggctgctgggctccctgaaaccttgcacatatcttactgtatgactgtatttcgttttgagtctctggattctggggtttggacagatgaccatagtgaggcctgcagaaatatgcatgtcctcagtgtttggactgccagctgcaaggcagagccaaacccaatatggccccatcatccctggctcagctgtgctacctggccatgctggaaggggtttgatcttccaggaatttgcttcacagctctttcctgtcccaagatctatgcctgatgtgtaaattcaggacccaaaagggcacaaaaaagcaataactactaaatataaggaaaacaactctgtatacagcatgtataaagaaaagcaagatatatttggggagataaaagttgtaaaggcattaagatgtgtgtttgttgagaaaaaataaatttgtgcatttaagaagttaaaaaaaaaaaaaaaaagagtgccctggcagaggaggaagtccattcagatggctggggggccctcagaattttatttttggtttacaaaaagtttaggatatgggggacgttgctcatggctggtcaggagctcgagagtggaagggtttgagggaactggggatgggggaaggggtctgagaaggggatatacagagctgtctggggcaaggggtggcctggggggactcgaactttccatacagagggagaagcagcataatgagcttcatcctggggtctacagtggcagacagtggggaaagcagtgacagggaktttgccagcagaggaggcagctgagggtgtcttactcaaagaccctccctgaatgctgggagctgggaaggggttggttttgcccaagcacatggggtctcacttgtcttcaggcaatggtggctgcctgaggatagcggaggctcattgccctaggccaagtgggaaaactgcctcacccagaaggtcacaccctcccccacaacccagtgcctgattgatgaggggagggagaggagacacaaaatggtcctggcctcaaggcagggacagccgtgaggtgcagtgctcccgagctccccttcatccaaccaggctgaagcagtcacagccttgctcagctctctgcaccggctctctacccccactctcctttcctaggagcacccctccataatcacctccacaggaattccatctcagctctgcttccaggaaacctgacccaagacagaggttgttgcaarggcagaggccacaggcatctacaccagcctctgtgcgttcagtctgtgagcggcccaacgctgcccatgtgctcctccttaaagcctactcaaccctggggtctacaggcaaattcctcgcgggcgccttcccttgtcctggctgccgctctgcttcctttgcaagctccttctcgcacccttgcgctggctccctccagagggctccatcccctgcccactgtgccttcgtgggtggtgcccagatctctgtctcctctgccctggacccctctgcccctgactggcagatctatagagttcagtgcccctggagggctccacgtccatcccacagggacccggactctcatcttcctcctgagcgtgctctccctggagacctggcattggaattcrccctgccaccttctggtctccccaagtggaaacctgggcgtcagtctggacgcttgtcaccaaattctgtcccttccaccttcacatggcctctccatcttcactgcctccgtgtctctatctcatcccgatcaccttcgcctctcctctggcggagagcaccagcattcccactggtctctgcttttcctcaaacgcatctctgtgtaactctcccctcaggatcactctgtggcccccattgctctgggtggaatcttccttccagtggcgtttcagtcccctgggtctgcctcactcttcaccaccgtcttgtgcttctgcactgagctccagccagaccacckgcctgcagccacctggcgctacctgttcccgtgtgcttcctgcctttgcctggagagaataacaatctatagtccaaactcaaggacaaaaacaaactgctttttggccgtggtggcatgaaaccccaataagtcaatgacaatgctgcatgcttctgaaagccggccagtcagggacagccccacactacagaacaggcccaggcagcaagaaccttgtgcccctgaagtcaggctgaacactctcacttctgaaagctggacaatcctcaatgccaggcttcccaagagactcaatttgttttgctctgagagatggtcctataagcacagttccccttttctctcgtaagcaagatactcagcttcagcactgaccagcctcacaatccgtcctcaccaagtggagggccctccctccgggttcctccacggccgtatstgtctctgttcatacaccttcccctcagcacttagagacacgggctggcatggcgggtgctggcggcaggggtgagaaataaactttcagccctagaggaggagcccaagaggagagcatgccrtcacctggagtctctggtatgtgcctggcacctgtactgattgcattaaccactgtgattttttagaagatgtactagtttgaaatgtataatacatacggagaagtgtatgaaatatgtacaatttaaagataaggaaaaatgcatgcctgtgtgcccaccacctagtgaagaaatacaacctggacaccactttggaagcctgtctgtgttcacccgtcgcattctccctcctcccccagcccaggtatcctccatcctttagccatcccctgactttctttagtttcattgcctgtgtatgcagccacgaataaaatattgcttagttatctgggaaaccgggctgtataggaaaagggctcttagaaccccacaccactgtcagatgcaggatcccagaagactctgctcccagtccagcttccaattcctgtgggtttataacgggcctttctagagacactgggggcaggattcacagagctggaacatttgcagttaggaccacattccagatgaccaacagggacatgcttgggggggataggccaatttggactgtccccttctaagcccaccaagacctacctgtagctctcaggagtggggtcagggcaaaacatgtaagtggggtaaaacaggtgacctctgattctaggcaccaggagatggagagaagagcaggaacgagggaacacaaggggaaggcaggcacaggtgagaatctaggccaggctcacctggccattctgtcctgaggcttaaaaacatgcaatgatggcaatgacagcatttgatctgtctctggagtcacttcgcatgaggtcattctccctccaccaccctcctgggggattcctttacctcctctcccccatacatcccatattgggaacttgtgcttccagctaagatgcagtaacagactgaatttaccctcttgcctgaaacaactcaacagctggaaaaaaagaaatgaaacgatggctctgaaaatactagaaaagcagcacaggacagaagcagatcaccttgattccagggacctgaaatcttctctggaacaacacaagatacaatttaaatgtaaattagggtaggcccagtggcccacgcctgtaatcccagcactttgggggaccaagacgggagggttgcttgagcccaggagttggagaacagcctggacaacatagggagacctaatttctaccaaaaaatttcaaaaattagctgggcgtggtgacacgcacctatagttccagctacttgggaggctgaggcaggaggatcgctttagcccaggaggtcgaggctgcagtgagccatgatcatgccactgcactccagcctcgatgacagagaccctatccccccacgcaaaaaaaggaaatgaattaacattaattcctctcaagatgcccaggctctattcaccccctttgtcattgtccctccagttggaaattcctccctcccccggcaaaatcccgcccacccttggaggccttttcagatcattcttgccagatgagctccccttgtcccttctctgagcccaaaggggcccagctgcygtctgtctccctccttccccttgtttcccgcgctacctccagggcacttcccaactcactggccaagcccccaacgagcggtctatgctaactttggctctgtgaatttcctagagtgtcatgggttggggaaaagcgcgcgaagtcctgccttgcagcaggcgcgagagcaggcgcttgggacgcgggttggggcaggggccccgggacgtagggggacgtctgcgcggccctgcgtccccgggacaacctggcctgggcttacccacggccaggcgctccgcggagggcagaagcgggctgggccaggctcctcagcgccaggcccgggccgcagtgccaacccsgcaacggcactggacatgcaagagtcggcgtcagtgcgcgtgaagccggagcattatcaggctcagccaaacgcggcccggttcttgggctttccgctctttctktggggcagagagggaaagaggcctcgagtcgtgcgggctccaggctccgggctctgggtgaggcctgatccctgctcccacccggccaccctcattctccagttgtatcccctgccagagtctgcagcctcgggccgcggcgtggttgcctgggaaacgcttgcgcctgcgcagggcttcctaggcgctggagtccgccggcggcctcgccgctgccggccgctcacggaggaactacaattcccaggagaccgcgcggtgggtgggggcggggtagtgggcggggcatcggcaggctaggttttctccgcgcagsgccagtcgcagaggaagatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgagtgagcgcggcccgcggtcggtggagcggggccygggggcgggggccgtggttggggtcgttggagcggggcccaggggtcggaggcggaggggggcgcagccggggcacctgtgccctacgcgccctgtccttggcacagcctcccccaagtgtcaggtggggcgccccgacccyttctgcagcaggaaaggtacccgtgccggcgacgacgccgtgtgaagcaggtggcggccggcaccccgagggtcagtgtcgccctccccagcctgggcggcctgctgacccgagcgtagggacagaaccaggctagatcacaggtctcctgcctcccgagcctttgcctgttccctcaaccttatctccctatgtggggaaacaagaaaaacaaaatgttgggtagaaagacgtgtccagggacagaaggaatcccagtagcaagcccgtgcttgttcatttgagcgagaaatgaggaggtgaggagatgggatcggtttagagcacataaaacgcgaccttgggaatgctgaaagtcagtcttaacagggcgctcacctgacctctccttcatttgagagatgagggtacggaggccccgaggggaaagggcacccccaaggtggctcggccggtggggccccccgggacaacagcttcctaattggtgcgtgaccctgggccagctgctctcttcattaagatacggttgcttcatttsttaggtgttcctgaaaacacctgaaatgggtgttttcgaactatgccgaccatctgggcctcattatctcatctcaaatgcaggagtcagattagatctctgtctcaatagtccagttttaagcattcctgagtctttgagagggaaagtaartgatttgcagaataagaaggaacttttggaacgaaaagggagaggagaaacaggtgggggacagacagacgacagacggttataagactgcgtggggatggggattgacgcctgggcatcagctccacaggccctycctgaactgctcctgggaccagcagtcaagccccaggcgtaatgttcagcctgcggaggtgggaggtgggagaacgctctgggctggagcggcagggcggcttcttggaggaagggattctggaggggctggggacacggctgggtttggatgtgttgatggcctcccagcagcagggaacaggtgtgaccaggagcagccgggatgcagtgctgcctccccgtgcccactgcactgggcatctgttgagtgggtggagtcccccctccccatgaggaatggggagcccgaaatagactccctgaccgattggaggtggcgctgaggaagtgcactcggrcccaggaaccccagcggctcccttttgggtgctggcccaagtcttccacctgctctgcagggccgccctggtgcgctccaccttacctccagccacctccagctggtcctctgtctttgtcagcccaggcctcctgcagcaatacacctgccctcaggctgcccctgcactggtccagctaccctcgggctgcccctgcactgtcccccggtgctgggtgctcgcctgaccagtttcagtcttgggttgggtcatgtctcctraacctccctgaggttcactgggcaccatggtagggcgagctgctcacctccactttggactgagccttggactagatgatctttctggtccctttaagtcctgaagttctagttgtgtgggcaagtcttttttgctgaacagaacgtgaagttcttcgggggtgagggtgttttgggggattttgtgtgtcttcccccmttccagagagcctggtactatggcaggcaggcctgcagagcccattcgtcctgattttccttccagataacggaagcttggagggtggcggtgctgtgagggtgttctatcctggagccaagtgtgcaggcgtcagacccgtccgggtctttttgaggttctcagtggcggtagtgcatcccgggtggtctttgtgctgtggctctttctgccgagcgtgccagggcccagggtggtcaggaggcaggaggagccacagtcagttcaaacgtagggggagagaattgttcgtgcaaatagtcactccagtcggcttcttaccccacctgactcgccgctctaggtaggtatcagacggagacggggtcttggatcgccccctggaagataattgaggtgagggctgctttttcagagaagcacttcctgcccggctctgcagccactgctctcagcctcctgcgacctgcgctcagcagccaggacggtcttgtcctttctttggtttgcttcatgaaaacatcgtgtccctgttttctgcatgtaaagccacatcctggcatataggattgcgtagtgtgtcagtaggcatagggtgaagggagcgtttcaggaaacctttgcctttgatgggcttgggctgtgagacctgcgttgaggttgccgccaagaagatgctgagacccgctttcatcaggcgagacccggccrggggggtgctgcttcatcctctccagcaacttgaatcttgactttctgtgactctcccagttcctctttcacaggcgggctccactgtgttgcaagactcctgagcagaggctgtccctggagctttggaggtcagaggccatgcagagcccttgtgctcacagacgacttctgaggactctgcctcttcagagctctgtgtgttgtgttgatgctgaggagtaagctccagggtctgcatggtccagctgcggcgctcagggacacactcgtgtacctcttggcctgggctgcacggtgccatgagctcggagtccttggccataggtccttagtttttttggttttttgtttttttgttttttttgagacagagtctcactctgtcgccgaggctggggtgcagtggcgtgatctcggctcactgcaacctccgcctcccaggttcaagcgattctcgtgcctcagcctcctgagtagctgggattacaggcatgcaccaccatgcctggctaatttttatatttttagtagagacggggtttcaccatgttggccaggctggtctcgaactcctgggctcaagtgatcctcccgcctctgcctcctaaagtgttgggattacaggtgtagtcccaggaggcaccgcacgcagacagtccttagttctgacrtgaatggtgactgcaatgagagtgtgtgaagcatcttgttctcagaggtctgacgagtggaaactgaggtctgcagagaggagccctcagagccccaccccagctctcaagcgtcccccctggcttgagaagggcctctgaggatgggccagccagtggcctccatgggcacctaggactcgccaggccaatgcatgacctcacagcagctcaaggcgggtacggctgtgcccttgtccacggagctcaggtggaaggagctggggcacagtggctgggctgggacagtgcatgccacctgccgkggtgagacaggtacagcgtgccaggaagccttggtcaccgccacagcctgctcctcatggtgggtgccttgcagtctggcgcgggcactcaggtgagcgctgggaggatggcacatgccctctgaagaggtggtccattggcgrtcctggtggcattggaacctgcccagcctgaactgtgckgtgtgtgcaggttgacaccagtggtgtagctgtggaccctggcctgggtttcctggggcgttgagaagcagcagcaggttattggaaagttccagaaagctctgctggcacgcgggtggtgctgtgtggggaagggccactgctgaggtcccragcagtgctgggcccttgggtctggtcaggaggacacggtcggctctgcttgtgtctggggacacaggaccggcgtcgtttgatcagctgagccggctttcttgcctgcatgtataccctggttgttgatgatttgcctcgctgcttcatgtttgacaggttcttttctgcagttggtttccacagggtacttctaacttgatgcgttaacatttaacttgagagaggtgaaagaatccagacgtggggtctggggtctgcacgtgacctgctggtcttcctctgcacagagctggggctgctttttgtggtggtgctgccaggctggccccttctgcgctgagcactggcagccacacatcaggggaaagggagctggcttttgtgagacatgcggtgtgaaatttagaccccctgttgcctgagagttkgggaatcagagggagaaaatgactttcccctgtgggttgcagattttacagcccacagagcacctgcccttgattctcccagcaccctagggaggcagacaggaagccagtgaggactgcaagttacaggggttggtgcctggctgtgagcctgccaggatgggcccaggacttcagcagccctgggtcttcagctccgctttccagcaggcagcccatgggcagtcatgggacacctgcatcctctcccctgcagccaaagagggcagacccggggcccctcaaggccagcacacacttgagagcatgggcctgaattgcctgccccagggtgctgcttctggctcagaccatcactgtgggcctcgcatctcagaccctcccgggcagtgcagcacggtaagtaaggcgcctacagggtagcagcagccacggggaagtagagatrgaagcagacctgttcctccaggagtttgggtcacaaacaagataggcaggtgtgggctccccctcctcctgaggcaccgactgcccctcctgagagttcagcgtcactcaggtgcctcattgtcctgggtcctcctgctgggaatgctcagatcagacctcaggtctcctagggccttccagtggacgccgcaggcaagtgtccagggcacagaggggcacggggtggagctctggggagaaggggctgggtggatggggctggctgggtggatggggctggctggggaagaggcacacaggtaggggtgtgtcgaaggctgccagggaaagggttttcaggttgggacartcctggaaagcagcccctgcagagatgggggcgcagagcatctaccaggagggcccagacaaaagactgtcctgggaccacccacyaagggttagagaaccttctagagaattagaagctttcctctgccctaggccctgccattcattttgtgcctaccgtttgctatctttttaccattggggatcttggctcagtaatctgaattcrtccctaactaaattttaaactcctggagggtggggcctgtgtggctagggcagccacagagtcaggctgggcttctgagagaagagagggcggagctgacagccccagcacccagctggagacagggcctgtggtcaggggtctccttcctcccaggcccaacacagactgagctgcagggagcaggatgggctcagtctagatacaggcagagtgaggcgaggaggttccggagtgtggggtgtgccaaacacacagaattggcttcgtgcgagtcttgaaagaaacgtgtgcccctgcgcggcgcggacctgagggctgggcctcctgaggtctcgggctgcaaggcagtgtgggccacaaggcggcgcgggctgcgggacactgggaaggcagccggctcttgacgcttcgtggggatgttcactgttttacgtaaactttattgaaatataacacacrtactttggatactagcttgtgttgtatttatgttagaaaatagctaatgaaatatagataaaagattaatatttcaaacstctaagggaaaacagactccatatttaaacacacatgatcagagacaggcgttaggtgatgggcacctggagctcagaggcaggagctggggttccctcctagagccacgggcagctcatgaggaccagccccgggggaatgtgagaatgcaggtgctcagggaaggggaccctcctgagagccgagagatttggggatctgcactgcacagtgccgagcacttcctttgctgcaggactccacagaggctttaatgcgctggcgtcactacaggcatgcggtgcagcctccccagttagccagggacagcaccctgtctccgtgaaccctggtcccacctcatgacacgttctggttcacacagctgggccactctgctctgcacggaagagccttcgcttccctgaagggctagcctgccccagygcacgcctcttagcggccgggccagccccgaggccagagttgatgagagctggccggtgggtttcattctgctgcttgcctcggccgcctggcattctggcccagtcwttctgacgtggggacactcttggcctaaatcctgtctttgcaaccaaaaagcagtgtgcccagcggtcacctcacttgcttccttctctcacccagggtcccagagctgggagggcaggggtgggatgaatgaagcgtggcctgccctgcggagagggatgagggtggggcggggaagttcctcagccccagtgcggcagctcrttccggggcgctgcctgtgtggtctacgccagcaggtaagtgagagggtgacagattcctgctccagaaggatctggggctgtgtaagaaccgtctcagcaagacagttcggatcatggtacacttgagaggtggtgactgagggtctttgggaaatgaagatggggcagatctgagattacagtgattttttttaaaaaagaacttctaggtgtctgtgtccttgcaatatgtatctgcaatggtaatgcagtgggtatcttcttcctgctctgtttatccgagtgcccgatgactgtcctcaggtgctagggtggggtgtcctgttacagccggacaggaatgagcagccgctgctggtggggagcccccgatggacttggggtttccggatcgtgtatacagacaggcctagagactggtgtccatgttgagttcttgtctaaacctgtggggtttgaatcctgctgacagtgaccctgactccacctcttcctggtctcccagaacctcccggtggccagcctcctccgaggtcagtttctcgctgtgtcctggtccgtcctgctcgtggctcacaggctcctccccttcrttcgcagctgcatcttcctcccgtgaggctggccgagctccacgctgatctgaagatacaggagagggacgaactcgcctggaagaaactaaagcttgacggcttggacgaagatggggagaaggaagcgagactcatacgcarcctcartggtacgtttgtttctttcctaatgcaggtcgagtatccctcttcctaaatgcttgagagcggcagtgttttggatgtcggattttgtttttggatttgggaatatttgcattatgcttaatctggatatccaaaatgagcctttccccgagcatcctgagtgcccagaaagcttaggatttgtgttgggggctcaccctcatgagggaggtggccactggcttcagtgtttgggggggctaaccctcatgagggatggtggctgctcscctcagtgctgtgggctacgcctctgactccttggcttttggccaaggggsccattgggcacagcctgcggggggctatcctccgagcacagatgcgcccttggccgtggtctcagtttgctgtcacagatgccattggcacgccagagggagggccaaggcaggggctctgggtgcaggaaggggccggaggacagcaggaggctctgtcacccagaggaggaagcaggtctgccctagcatcttgaagttttggggacatactccagatgtcatcagaatggacacttggttgtcatgcgcttagtgagtcctcgtccctgtgggtattcaagaagaggcaggacagtcgcctgcttggtaccagcatacggaagacaggtgtgtcctcagagccgggagggttttaaatgacagagttgcgactgttccttttggacccctctcctccgccatcctccctcaccacgggcccgtcggcagggcactggcgggcagaggacgcacaccaggtgggcccgtgggactggggttggggctgctccggagagtcgagtgctcagctgcctgctgtcagctatgtgtagcagccctaggagctgctgtgcctccacccaactgctgcccctggscctgaccccaggcaccccttccccaatcccctcccccgctgctccctgtgtgacctgggcccccggcacagtcccctgccccccacctccgtttcctcctcctgtctcacaggacggtggtgtgaaccaagtgggatactccccactgtggtgggggtgggggtggctgccatcgcacttgttgctgtcgtgagggtggccccagagccctggccatgtctggagtctgctgtagccctgcttttcacacgcgctgatggcctcaggcattgcagcgcccgggttgtctctggtaaagagaggaggtgtctacggagttccttcgttaggcctgatgctctaacacctactcctcaaaactcgttgtcgtcccatttgacaggctcagagagggtgatttgtctggagttgcagagccgagtagtgcagcaaagatttggagtcagggttttctgactcctgagcaggtggtctgttmccagccacccctcttctsccattggcaggcatcagcagacatgtcatgtggctgcgcccgggttaaagacagagggccggcttcatttttgctggtttatgccaccatgttcaagagtctggttgagacgtaagccaagatacggcggcagggactgcctggggaagagagacatggctgaaacaattctggatggttgygtccccaccagcgtgtctagtgggccattcccaagggccaagaaagagcctgtcctggaggtgcccccaggaagaagggactggctatgcagcagggcagcattcggggcctggaggagacagagyagcttgcagggggcacagaagtgggctaagaaccagctccctcctgcaggccaggcagtgtccttgcagggtgtccaggtctgtggcccaagtggagctgtcttgttttctgccattgcctagtgacctggcagaaaacttagtgggactctaggagccggcgtcccagaagcagaccctgcccacactcaggaaagaggctcgtcctggccagttccccgccatcttctgggtgtggtccctggacccccgaggtcccccgtgccattatcaagtgtgataccatacctgggggaccagccatagccaggtgtgcctgcccttggcaccctccatgctgaggtccaccctgagacagacgggccacgctccactctgccctgccctgctctgctctggggttcgctcctgtcctcacccccaccgcgcccccagggccacttcactccccaggcagggagtgtggggcggcgtccgtcctccccaggcagggagtgtggggccgtgttcatcctccccaggagctctaagggctcggtgctcctgaggccgcctccagcttcagtgctctgtgactccattccatgcagaagaacccagcacctccagaatccagaascttccatagtccctgctgctgatcgcagccgtgggtactctgccttttgatggggtctgaccagccactttgggctctggctcagagcttttggctccaactaggaaggcttgagccaggctagcctcagagccccaggacatggcccaccctccccgtctccccctctcctcctctcgggctcaggggtgcacggcctgggggtgggacctcagtgctgctgagcagtggctggacttgggggtctgggcaggacggccttcacaggcaggcctggcactggctttctaaggccaggaggcatccaggccacttttttaaaaagtttgtgtatttttgtatgtatttatttcatttattttctcatcccccacagccggtattatttatttaattatttatttattttaaaagatggggtctcactttgctgccctggctggtcttgaacacctgggttcagacggccctcctgccttggcctcccaaagtgctgggatcacaggcatgagccaccgcgcccggcctaaaatagttatttcaggtataaattccctgccatggaagacaggcccagcatgtggttgagctttgaagcatgcatctacgggacccgtgcccagcgccagcagctcttgactgctgtcaggagagacggctttcctcagggacaagaccacaggctggtttttcacgcttaggaagatcacaagcgcttccaggctggaacacaagaagcacatgctgcgtgtggccttgagacccccatggcccaggcttccggacagagtgagacaggagggatcagaggccagggtggtgtcgatgagaaaggaggcctgaggctttcagggtgtccctcgagcagggacactccccagggctggcagtgacagaggatggacctttgggagaggtgcgggggtggggcctgctgagcccagagcatgtggaggccccgctgggagtagttctgtccagtagggtcacgggtgaaggcccagaggaggcgctggggtccgggagtcaccatctgggtgaagaggtcctcggggtgaggggaagtgtgaggcgaagggaggytccgagcccagcatcttgggagaggcctactcggggccctctcggcccggaggggaaggcaggaccccattctgtgggaggcggggccctgggagaattcccccagcccccaggaaagggcgggcaggcaagcccaccrcccgctaaggagrcgggtgtggttgcatgggccccggattccaggggacctagtagagggcctgtcacacagagccacagcacaggacttggaagtgggaattggggcctggggagagctactgccgtggagggcgaggccagcccccaggctctgctctcacatcccaagtgcaggacttgtcctgttggcaccagggcccrcgtcgagcgcctgctttcatatcatgttggtggcagcgtgtggtgacagacacagcccacagatgccgagtcccccctagggaagcggggctaggggagcaccacgtgggcagatcctagagggctccccgagtggctgggccacagcacactgcagactatttattcctcctggctgctaccagtaactttttgttagaagctgctgacactgacgtttctcctttagaaactgtttttcctcccaataaatataagatgtgtgctgtcagaaagccctgccaccctgcacagtctgcaggtggcctctgtcctgtggtccttagagtttttgccctatggcakcaggtgaggctgcaaattttgttcttgaaaatctgtgcagctggtcgctaaagacgggccaatcggtaaccactcttacagcccagcccaccagctgctttcgacagctgcgtctcagggggacacagcttgatggaggactccagccggcgtgtccctggtaggaaagagggaggtcctgggggtgtcccgtgagtcgccagacccgttcctaagtgctgggagaccacagaccccacgcttgtttacattcttgttctccccagatctccagtggtcatccaggaaacaggtgaaaggaaactactggaaaatgagaggcaaacctgtctcacccaccgtggcaacccagatgtgttggcttttgactgtttttcacaggaaaccatatcaaatagwacctcccctctctcctagtcatcttggccaagtatggtctggacggaaagaaggacgctcggcaggtgaccagcaactccctcagtggcacccaggaagacgggctggatgaccccaggctggaaaagctgtggcacaaggtactcttcgattgtttgcataccttgcagaattggtgccgttacgttgagtgttaaggcgggggctgtgaggggcagtctctgctctgcatgggagccggggtttgggaaagtctcaggaagacggtggcttcctaaggaagccattccactgtcattctgtgaatcttttcagctttcctgtttagaagattccttgctctttgagtaaaggagctctgtttggcctttggcctgcagctgtcagaccttcagctcaggtcacgtgtggttacgggatggtgacgtagcatgggctgcgttctttactccgtgtcggatttttaatgtagtgagtggtgccgtggacgtgcctctgtgattagaaaggtgccctcgtgtgtggggctgggctttcaccctgtgcctgggaagggtgcggggccaggcgctgggacccagcagggcctggtgggcygtggcagggtgtttacctgccgcagctcccccatttccagcggctcctgctccagaacagtttctctggatcacattgatttggggtcaacagttagacttcttgtactagcccagtctcagctcaatgtccttggccaggagagatggagtcggtagaagggggcagagagggagagagggccctgtgtggcctccctggacgtgtgtgagccacgtcatctcacaaccaggaggcaggtgggatgacaatgaggggctggcagaggtccccctaggaaggtggccttgctgtcctcaccacctgcagccgggagagccaggcaagcccggrgtcaccgggctgctgccctgtccccctccttgggatcttctgctccccaccccagccagctcggtagctgtcccctgttgagcctggacacgtccaagaraagggtggttgcctgccggcagctcttctccggtttgttttttgttttcctgcccttcgtgaggccaagaacctggcctggcactcacgtaggcaagggcctgcctggccatgaggagtggttggctgaagagyggccctggccacacgagcccgcggcgggttcactccaggccttgtttccctcttaggcgaagacctctgggaaattctccggcgaagaactggacaagctctggcgggagttcctgcatcacaaagagaaagttcacgagtacaacgtcctgctggagaccctgagcaggaccgaaggtgccccccgcccccaccccctcctgccctctgccccaccccctcctgccccccacccctcctgcacctgaggctcrttgtgctcagtgggcagyctcagctcccctcaggaacacrgcaggkgcagggaggcggcaccagacgccctcccagggttccaccggacttgtgagtggggaggttgctgtgcaggcaggctctgggagtcgcctgcctgcattggatgaaccaagtctcaccggcgcctgcccccactatgggcacagctgctgcctttgtcagacctgagcttcgctratgggtccttcattctggactcgtgaccctccccaaatgtgtgactttcccaccccacaaagctggagtaaaatggagggtgacccagcagagagggggcagggcaggggtccagagtcagcccccaggggacctggtgccccagctgtcaccgccaggcgccacttggtgcgcgtgtcccggcgtctcgcctgtctcgcctggaaaggaagctgtgccaacggtcgtttctgcggcgctgcaggaccgcggaagggggacattttcagcccagaaatgagagcgagtttgagctccccagcagtgggcgttctagacagtggtctgggcaggcagtgcgaggactcccagcctcatggcgtcctgccttcggttttacagaartccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggcyggtgagtgcccgcccgggactgttggttcccgagggtggggccgtctctggttgtgttttggggacaagcagrcaggtgcttgtagcgacgggaacctgggcctgtggacgcagcggagaccctcggygcgctcagtctacccasgggtggtcacaggcctcgctcccaggagctgctccgtgaaggtcactcgccgtccccagccttgtacctggagactagcrgagggcagtggcggcagcgggcctgggagcagcccttcccagcgtctccccagcctcagcagcacggcccctcccgtgctgctgttggccaagaacagagacyactcgtcaaacatagctccgtctccatctcatgccacccacaccgtccatcagtccccctcagcccggcaggggcaggacgcccgctgaggccacagagcttgtggctccgtctcagcagctcatctccctccactgcaggccctcagtggccaggctctgcaccactgcttcttgccccgtacccgggccagagccttgtgcagggtgtaccrgaagcctgctggcctcactcacgcagcttccgattctgtacctcatcctccacgtgcacactgagcaccagctgcacgccaggcactgctctaggctcgaggagrcagcagccgccaggagatggcatctgtgccctcatggtgataagacagcagggctggtctytgtccccggtgccaggcagagccaccgcctmgtctccaggatggtctgcccagaggcagcctccagcacagcagtcaaatgtgtccacgcgggcccaggtccccttgggtggctgtgctgctgtcacctgagtgcccttgggcaagacccctcaccacccacccccaaacccaggctcccttagcctgacctggtgctggtgactgtcagccgtaggcttttggccgtagtgctgggggctggaccaccttgtaggcctgcgatgcagtttgctgagtkcctgtgctggagagacccggatgagcctggctatagtccatgcaggaaagggcgactcagccccacacacttctcttcccacctcgggctgtccycaaggcagttgtgtccagcggctcctgcagttctcttgcgggtctgcctgggccttccagcaagccccaccagcccagggtcctcggggtcctgagcaggaargggtcagcagaggagggagcaggggccactgttgcggggctccatgggcaggcggctctggactactcastcctggttggagagtggtgacagccccggagtctctcactgcgtcccttcgtgagcaccrgggtccaggagccgtcttggtttgtttggctcctcccaggagcccgaatgtttgactttcacgagcacaacatcctgctggagaccctgagcaggaccgaagggaaacggcctgtgcctgcgtctggacctggctgaacttgcaggtgcccccacccgaggtcctggcagcckctgcacacaggccacgtccatcctctgcctcctgcttcagaggcagccagggcgggctgtggcgcttcccaggctctgatggargcaggtgtttctggacacaaaggagaagcagttgtttggccaaggggacagagaagccacatttcagcgaggtcatgtgagctactgacctctctgtgccccataagccccatgtgagctactgagcagatgccctctgtgccccataagactttgagtgcacgcacccgtgtttcacacacatgcargtcgcgcctgcaaaccctcataggctccacgcacactcagcgtggttgccgcggggctggctgtggtgtgcaccccgggtgctgctgaggccactcttgctcctcccctgcagagttcgaggagcccagggtgattgacctgtgggacctggcgcagtccgccaacctcacggacaaggagctggaggcgttccgggtaaggaaacacggccctctccttctagctctctcctgtggtgaagattctcttgcagtttccrggtaaggaaatgcagccctctcctccaagctckctctctcaagattstcgcagtttcttccttaaccactcrgtgaacctgcttgcgttttccttctcatctgcgtgggaactcgtgtttcaggggcggggccaggctctggagggaggggctttggttcttttgtccgtgttcacgtctgagcgtggccttggtgcgggtcctgtggatggtcaacagttggtcgggacccagccacagcctggggggaggggaccaaggacactaccgggatcgtttaggggtgtcaccacttsctgagatggaggcccagggagggaaggagaccacctcaggtggcaggggctcctggggcgtgtggagtgccagatcattctgagggtggagaaytcatcagctcggtgagcacccagcagggctgtgaggagtggggagtccakcgggggtcctgggtgggcagccttgagtatggtatccggccatgagttcacccagggtccctatagctggtgtctgttgggagggaggtgggtgtggtcctgccctcataggacttgggactttcctggccccaggaagggcccttagcacctcccccagaaaggggtcaggagcttccctctggggctggggcaccttagctggccgcaggcacgtgcatggggcttggcaggtggggccacatggagggccctgggtctggagcgtggggtcaaggcagggcagggcrcctacaggagcagggacagagctgcagtccagcagcagtggagcccaggcaggctgggggcagggtgcagaggcagccaccacagaagcacagcccctggacatggggtctggctgggaacgagctggaggccccctagattcggggggcgggggtgccatttgcagagacagggaaggggtcggcttagggctgccaaggaggcgcgggctgggacccgttgctagtgtgatggcctcccagctgccgccccctcattgcccatgtcaccgcaaggcctgtcctgccccgggtatggcgccgtccyttggcgtccttgcagttcacccgggaccacaagatggcgtggcgagcacgggragggaacactcacctatggaaaccttgttccaggaggagctcaagcacttcgaagccaaaatcgagaagcacaaccactaccagaagcagctggagattgcgcacgagaagctgaggcacgcagagagyrtgggcgayggcgagcgtgtgagccgcagccgcgagaagcacgccctgctggaggggcggaccaaggagctgggctacacggtgcgcacgggttccaggaccggggaggccrcagttcccctgcaggaaagatgaggccgcccacatgcagctcagggcttcctgtagatggggtgtgggccccacgctgytgtcttccctgtccgagttgaaccccagggccacaagtgtgtggggcactgaaggccacagcagccatgctaggggagccccccgggcttgtagtgcagtcccccgaccctcaggtgagagcgcaggccccggcgggccactgcctcgtcctcctgtgaccaggatggggcgtgacctggatacccacagccagcccatgagtcagggcactctccagcctttgagacaggcgagcctccttccccacagcccctgggatgtgaggggaggaggggcagagcccaggagaagctgaagccagcgcacagccttgccacagaggcacagaaaaccctggaagctcatgccaagttctttctggagggagctggggctcaggagccccatctgtgccttttaaactttgaactgcaggcatgtgttaccgattcaaaaatagsaaaggcctaaaaaataaatgaaggtagaagttctgataggagagggtggtgcgggtctgcctggcagaatgtgcaggagagcagccygtggcccttgcccgtgggcaggagctcaggtccagggtgagcaccaccatgtggggtttgcagggcgctcccgcgagacgcggggatggaatgctagcgtgcacctagcttcacctgaccacggcaaagctcggtgttggttaagaaagccgtgtggcactgcmtgaggcacccgcaccgttggggcagaggtcagggccgctgagagaagggaccttcggtgagttattcaccctgagccacgggcttctatgtggagagggaggtggcgcccacgagcagggttttgtgagaatctggggagagctacagtgaccccagcccaggctgggctgacgcagcacctgctsccactggggtggtatctgtggggatgctctgggctgttgtgatgtgaggagctggaggtccctctccttccctcccaggccctgaggaggaaggcgcctttcccagagctctgtcccagtctctctggtcattgcttttaaaaataacactgtggggctgggcacagtggctyacacctgtaatcccagcactttgggaggctgaggtgggtggatcatctgagctcaggagttcgagaccagcctgggcaacatggtagaaccccatctctaccaaaagtagaaaaaattagccgggcgtggcggtgggcacctgtagtcctaagtacatgggaggctgagrtgggaggatcacttgagcctgggaggcagaggttgcagtgagctgagatcatgccactgcactccagcctgggtgacagagcgagaccctttcagtaagtaaataaataacaccatgggcctatcacagagaccctgagctttccacttcagcatgaactgctcctggctggtggctcttagcgttctttggtgggattttctagttagyactgagctgcttttgtgatttgagcatttctggatgggtgtggaattggaaagtcagatgtgcagggcttgcgccttttccttttggatcgcgcgtctcctgacatgaggctgagctcacagagctggcctcgaggcgcgctgtccccagctgatgagacgtttctgtccacaggtgaagaagcatctgcaggacctgtccggcaggatctccagagctcggcacaacgaactctgaaggcryyggggrgcccagcccggcagggaagaggccagcgtgaaggacctgggctcttggccgtggcatttccgtggacagcccgccrtcagggtggctggggctggcacgggtgtcgaggcaggaaggattgtttctggtgactgcagccgctgccgtcgygacacagggcttggtggtggtagcatttgggtctkagatcggcccagctctgactgaaggggcttggcttccactcagcatcagcgtggcagtcaccaccccagtgaggacctcgatgtccagctgctgtcaggtytgatagtcctctgctaaaacaacacgatttacataaaaaatcttacacatctgccaccggaaataccatgcacagagtccttaaaaaatagagtgcagtatttaaaccacccgcttgttggctggtcactaagtgtcctggtggctggggccggagccagtgctcktgaagggrtcgcgtcatagccagcttcccctctgggccctgtgggtctttgcagccaacctccttttcccgtgagacggcccggcctgatttaaagccaagagcgcttgagttgagtttgaggggaagatgtggagcgtgtggttctgtgkacagtcagagactgtggcctgggggcagcgtctttcaactctcacctctgcagctcagggacctcgggagacctcaccaaacctgcagggcctccgtgtccctaagtgtgctgtgtaaatgccccatctcatgggggagagacagccacggaggccttcctctgaccatagctgatggactggcggttgctcaggtccggctccgagaatgttccygtgtctgagcctggaagaggctcgggtcyggctccrggcgtggttcccttcccgtgtctgagcctggaagaggctcgggtccggctccgrgcgtggttcccttcccgtgtctgagyctggaagaggctcgggtccggctccgagcgtggttcccttcccgtgtctgagcctggaagaggctcgggtccggctccgagcgtggttcccttcccgtgtctgagcctggaagaggctcgggtccggctctgggcgtggttcccttcccgtgtctgagcctggaagaggctcgggtccggctctgggcgtggttcccgtgtctgagcctggaagaggctcgggtccgggtccagctccgagcgtggttcccgtgtttgaacctggaagaggctccaccaggcgtattgtgttttgactgcagctggatcttggcttgactgttgagatctgccaaacatccgctaagctatcatttctgagaaaggtcaaggctagaggcagcatgtcgggagttggcgcatcagggttggaagggccccagggtacagcatgtgggtgcctgttcctttgtggacttgtgtgtgtgtggctggtggggcggggggtggattctgsttcttttttttcccattatcctgagagccttaaggtactcagtgtgttggtgagactcagccctgtcatctagcagaagcgtgttccttttcattgctgtatagtattccattgcatgactgtcctgtgctctgattttaatgcactttattgtgggtggatatttgagttgcttcctttctggggtaataacactcacttggaaatagctgtggtgaacactcgtgtgggggtgggggtgggggccaactctaggagcacctaatggatcttacgaagcgtgttgtccaagtatagagatgattccaaagtggttggactgtgtttctttctcccagctgggtggaaggagaacactagtggattgctgagacttggtgctcggtatttttaattatggacagcctggctggcgttttgtggtgtctaattgcggagtagcgtgtcttactgtataatggcctcttttgtatgtgggagaccatggtgttgaggggaggcagttacacaaaaagcccagataccgagtgttagttccatgggtgtggctggtcatggtgcgcactcacgaaggatgtaggtgatgccctccactccgcagagccagtcccacaggggtacccattctgactcctaccaccgcagctccctacctcccgcctgccatgggttccacgtgcatggctctgggcagtctgtgtctttgcgtgcgtctgtgtatgtctgcgtgtatctgcttacattcgctcagcatctgagattcacccaggcttttgcgtggatcagcggcagactcctgattgccgcgtggcggcctgttgtgtgggtgtgtgccgcgtgtgtatccagtccctactcaggagtgtacgtttccagtgtgggttgcagtcaggatccatttctcccttaactttcagattatttgctgcataggcttttttctcctaatttggcgcctttgtcagaaatcaactgacctacctgtgtgggtctgtttctgtttgtccttacgctcttgccattgccacactttagacaaggtcttgctctgtccctcaggctggagtgcagtagcgtgatctcagctcactgcacccttgacctcccatactccagcaatcccctcgcctcagtctcctgagtagtagctgcgaccacaggcgtgtgtcaccacacccggctgattttattttttttatttttattttttttgtagagacggggttttactatgttgcccaggcaggtcttgatctgggctcaagtgatgctcctgtctcagcctcccaaactactgggattacaggttgtaggtgtgagccatggtgcccggccgccacactgtcttggctacagttgggtttataataaaccctgaatcgaggtgatgtgcattttccaactcttctttttaaagattcttgtggctgtttatgtccttggtgtttccatatatgttttacaatcagtgtctcaatttctaccaaaaaaacatgccttctggaatttcaatagcaattcccttgaacgcatttttgaataccttttctgaatgtcttgaatacatgttgggaagaatcggtgtcttaacagtctccagtgtccacgcgttgactgccgtgtgtgactccagtcggcgtctcaacagtctccagtgtccacgcgttgactgccgtgtgtgactccagtcggcgtctcagcagtctccagtgtccacgcgttgactgccgtgtgtgactccagtcggcgtctcagcagtctccggtgtccacgcgttgactgccgtgtgtgactccagtcggcgtctcagcagtctccggtgtccacgcgttgactgccgtgtgtgactccagtcggcgtctcaacagtctccggtgtccacgcgttgactgccgtgtgtgactccagtcggcgtctcagcagtctccggtgtccacgcgttgactgccgtgtgtgactccagtcggcgtctcaacagtctccggtgtccacgcgttgactgccgtgtgtgactccagtcggcgtctcaacagtctccggtgtccatgcgttgactgccatgtatgactccaggtattgagttcatcttcaacttctcccaacaatgaactggagttttctgtgcatgtgtctggcatgttttcctttagatctagtcctaggtgttcgatatgctattgaggactgtgtatttttatttcatttgtcacctgtgcgtggtgctttaatcctgtgccctaaactcccgccttggccatggcggtgtttctgtggactcgtggggtttccgtgtgcacacgcgtgtcctctgtctgacagtggctttgcttccccttgtcagtctgtgcctcggcttctcactgcactggcgaggtgagccggcgctcgctaatcttattcccagtctcggtgaacatgggctcagtctctcccggctcagtgttgggtttgcactggtgcacttacaggcggaagagcttcctcatttgctgagggcttttcctgaatccgtgttgaatgtggtcagctgcctttcctgcacctagtgagatgctcatgaggtcacttccttaccgcattactgtagtgaattacgctgactttcatatgccaagatgacctggcatttccaggtaagtccctgtggccatggtgcattggccttttctctgcatggccagatgagatttgctcataccgggctaaggacctcctgtgtaggaatgctcttgagggacactgggcttggatgttcattgtcttgtcatgtgatgtgtctgtcatggtttgatattgcattaagtgggcctcctgaaacaagttctgccatagtttgtataggattggcattatttgtttcatagagatgtgatgggtgaggccatctatgcctgccattttctttttgcttaggtttttcattaagaacttgatttttaaaaatagacatgaggcctggcatggtggctcacgcttgtaatcccagcactttgggaggccaacgtggatggatcacctgaggtcaggagtttgagaccaacctagtcaacatggtgaaaccccgtctccattaaaaatataaaaattagcagggtgtggtggtgcatgcctgtaatcccagctactctggaggctgaggcaggagaatcacttgaactcaggaggtggaggttgcagtgagctgagatcacaccactgcactccagcctgggcaacagagcgaggctctgtctcaaaaaaaaagacatgaggcttttggattttctgtttcttcctttgtcatttttttaaagataggtttgtcgcagaatttcatctaagttatcaaaacaatttacataaatcattcacagtatcctctgtgcagtgatgtccattctcattcctgctctgggccatttgtgttttcttttccccctgatcagactagctaagagtttatcatttttacagatattttccccaaagaaacctacttttgggtccattgattttttttttctattgttttctttttcattgacttttgctcttttcttatgaatttcctttcttctacctattttgtgttcaatttgctgtccttgttttaggttcttttgatagaggcttagatcattgatgaagaatatgaaagaatgggataatacagttaaaaacttggtctacttatgcccattagagaaaacattcttaagcacgcatggaatcttttaaaaatggacgaggtactaggacccaaagcaaatgtcagtaattcgcagatgataatgtaatgtataaatatatgatatgtaggtaaataatacaaatcacattctttggccagagtgcaattgaggaggaaatcagtaacaaaaagacaattaaatccatttgattcttttgttttmgttttgtagtaacttgcacttccctggtgccagaggcatgacacctttttgtctgctcttggccatttgggtggcgtctttgggaagggcctacttaattcttttgcctatttaaaaaactgggtcttggaaatcttgtctttttttttgagtcaggatctttctcgcacaggcttggagtgcagtggtgcgatcatagctcactgcaacctcaaactcctgggctcaagcgagcctcccacctcggtcttctgagtagctgggactacaggcatgcatcactatgctctgctaatttaaagaaaaggttttttttatagagactgggtctcgctgtgttgcccaggctggtctcggagtcctggtctcaagtgattcacctgcctccacctcgcggagtgccaggattacaggtggcgggagccgccacacccagcctggtcttagcgttattcccaggtctaggtgtgagtccttcctcagatatgtgttgtgaataatttccgatcctctggcttgctattttactttcttaatggttatcttttggaaagcaaaggtttccagtttgatgaaatctaatttttattttttatttttccgttctagtggtctttctattttctcatcaaattgagactttggggaaactacacagcagcaaaccaggatatatcctcttaaaaacagctcgagccggccgggtgcggtggctcatgcctggaatcccagcactttgggaggtggaggtgggcggatcacgtgaggtcaggagtttgagaccagcctggccaacatggtgaaaccccatctctactaaaaataaaaaattagccaggcatggtggcaggcacctgtaatcccagctacttgggaggctgaggcaggagaatggcttgaacctgggaggcagaggttgcagtgagccgagatcgcgccattgcactccggcctggggacaagagcaagacttcgcctcaaaaaaaaaaaaaaacccagcttgagccaagtgtgggtggctcccgcctggaatcccagcactttgggaggctgaggcgggcagatcacttgaggccaggagtttgagaccagcctggccaacatcacaaaatcccatctctactaaaaatacaaaaattaaccaggagtggtggcagcatctgcctataatcccagctactcgggagcctaaggcacgagaatcacttgaagctgggagacagagtttgcagtgagccaaaatcgtgccattgctctccagcatggataacagagcaagactctgtctcaaaaaaaaaaagcttgaaaatttaaaaatatctcaataattatgagatgcagtgattttttttttacttccctaagctgggtttccaggtatctctaggttcagctcctccggggctggaagtacatgaagggcagcattgcccaccttgaccagagcaggctcggagcagggcagtggaagagctggtcccagctcagcccagcctgctgggtcagcatccatctgaaaggtcatctctacccaggaacttgatggcttccagctccaccctaacagaaacctccccagcatcttgccgagttgtaatccagggtggtggtatagacggtcttggggtagctggtatagacggtctt

SEQ ID NO: 17681 - DNA, 333811 bp, Homo sapiens
  misc_feature (1)...(333811): n = A,T,C or G, or insertion/deletion polymorphism (see Tables 1-2)
gctggtttcgaactcctgacctcaagtgatcctcctgctgcggcctcccaaagtactgggttgacaggcgtgagccactgcacccaggcaattattgctattttatatacatacatgtgctatatattaatatttgattggttgatgctatggtgaatgtgatttaaaaaaaaaaaatttagaggcccgaaagagaacagtgcaaagttagtttcctctggctctctctctttatcctctttgccttcccagaggcctccactattggcagatgcttgaatcttcctctagagatgttctgttctttttttttttttttttttgagacagagtttcgctgttgtctcccaggctggagtgcagttgtgtgatctcggctcactgaaacctccacctcataggttcaaacgataatcctgccttagcctctgagtagctgggattacaggcacgtgccatcaacccagctaatttttgcatttttagtacagatggggtttcaccatgttggccaggctgttcttgaactcctgacctcaggtgatccacccaccttggcctcccaaagtgctaggattagaggcatgaggctggccatgtttttcgttttgatgtttttgtttttgttttgtgacggaatctcgctctgttgcccaggctggagtgcagtggcgcgatctcagctcactgcaagctcagcctcccgggttcacaccattctcctgcctcagcctcccaagtagctgggactacaggcgcccaccaccacgcccggctaattttttgtatttttagtagagattgggtttcaccatgttagccaggattgtctggatctcctgaccttgtgatccgcccgcctcgtcctcccaaagtgctgggattacaagtgtgagccactgcacccggccytttttttttttttttttttttttttgagacgaagtctcgctctattgcccaggctggagtgcagtggcgccatctcagctcactgcaggctccgccttctgggttcacgccattctcctgcctcagcctcctgagtagctgggattacaggcgcccaccaccatgcctggctaattttgtgtgtatatatatatgtatatatatatattttttagtagagacggggtttcaccgtgttagccaggatggtctcagtctcgtgacctgcccacctcggcctcctgattgctgggattataggtgtgagccaccgcgcctggctttttttgttttttttttgagatggagtttcacgcttgttgcccaggctggagttcaatggcgtgatttcggctcaacgcaacctccgcctcttgggttcaagccattctccttcctcagccgccctagtagctgggattacaggtatgcactaccacgcccagctaattttttttttttttttttttttgagacggagtcttgctcagtcacccaggctggagtgcagtggtgcgatctcggctcactgcaagctccgcctcctgggttcacaccattctcctgcctcagcctcccaagtagctgggactacgggtgcatgccaccacgcctgactaatttttttttgtatttttagtagagacggggtttcaccatgttagccaggatggcctcgatctcctgacctcgtgatctgcccaccttggcctcccaaagtacaggtgtgagtcactgcacccggccaattttcattattttctagtttttattatttctgttttcacccgtgaattatttagaagtacgtgtaagtatccaaacacatatctcttgaattattattattattattttgagacggaatttcactctgtcacccaggctggagtgtagtggcacgatcttggctcactgcaacctctgccttctgggttcaagtgattctcatgcctcagccttctgagcagctgggattacaggcgtgtgtcaccatgcccagctaatttttgtatttttagtagagacggggttttaccatgttggccaggctggtctcaaactcctgacctcaggtgatccgcccgcctcaccctcccaacttgctgaaattacaggggtgagccaccacggccagccacttgaattacttttaatcatgttgacttttaatttaatgctgttatagttgaaaatcatggtctgtatgatagtgattccttattaatcactgtatttgctgtatttgctagttctaatacatagttacttttttaaattattctgtttgtgctggaaaataatgttttctctgggtttaggtggaaggctcaggacctcattaattgtgttcttaaatccttctgtgtttccgtggttttattgcttttttggtgcttaatctgtcaatttctgagtgttatttaaaatgtcctactatgaatgtgtctttttcctgtcttccttaaaaagtttgttttgctttacatatttcaagagtgctgggtagaatacaggttgaaattattattaagtctttaagtcttggcgtatcattcctgttactgcacggaccccatctgtggtcgtgcctttctcctgaagggcgttgttttctgtttgtttagctatgggagctccctcccattcttttttttgcacatctgcacatccttttaattttgatttctttgtgttagtctgtttaggtgttcttatgcagtatatatagaggtagactttacgtggttttaattgagagtctgctttttttcttttttctttttcctttttttttttttttttttttttggtggcaaggcctctctctgtcactcaggctggagtgcagtggtgcgaaaacagctcactgcagcctcgacctcctgggctcaagtgattctcccagcttagcctcctgagtagctgggattacagctgcacgccaacagtcctggatgattttttttttttttttaaattttttgtagggatgggtccctactgtgttgcccaggctgatcttgaactccggcgcccaagcaatcctaccaccttggcctctccaagtgctggcattacaggtgtgagccaccatgcccaggcgagagtctgcatcttaatggtgaaatcaatcctcatcacttactgtaatggttaatatatgtggggtaatttctgctaccatgcaggtcaaaaatcaagcgttgctgttaacccagatcccttcttgaaccccttctagtcattaccctcttgcagcaagttcacacttgccggctgctcctagtcctcactcttactgttctttgttagttatatcacctaagcatctacccacaaatactgtagtacagttttcctggtgttttgaattttacagaaatgtaatcgtactgtgtgttattttatgtcttacttattttgctcagcattatgtttgagagtcataaatcttgtttctctattttcattgctagatgccatcctcctttgtgaacatgttgcattttagttgtttccaaatcttgctgattgtggagcacacatgacattctgttgtctataaatagaaggaattgctgagccataggtggtttatatacttgactgattccatgttaagatcagtagcatgtttttaaatgaaaactattttccaaaaacaagaatggtttagtaagtagggccggacacggtggctcacgcctgtaatcccagcactttgggaggccaagatgggcggatcacctgaggtcaggagttcgagaccagcctggccaacatggcgaaacctcgtctctactgaaaatacaaaattagcccgtcatggtggcacatgcctgtaatcccagctactggggaggctgaggcaggagaatcacttgaacctaggaggtggaggttgcagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggccggtcttgaaatactgacctcgtgatccacccacctctgtctcccaaagtgttgggattataggcgtgagccaccgcatccggcctaacaaacctctttaatatctgaatgatagaacaaagctggtttcttatatctgcctctgtgtggaacctgttgtgataggttgttctgattgaagtatttgaagaaatattttattggcttttttagagaattgtggatatttttctttgatgctgtaccaaaccatgacaagttagtttctcaagggttaggtgtagtgtagaagctaaaaccaatcagtggcttttccctacactgttacgtgaaagtccattggtctgtcttgtcctctgaatggatatcttgcccatgcgtggcttgtaacatcacatgttggttatttgtaaagtattggtttactaaggtagacagattttcctgatattaatacttttcatcattatttttaaaaaatcatatttgttacaaaaaaatcatatttgttaataccaccactgatctcatcagaaagttctttaaatgttgagttttcaagcccacagtggcaggtgaaagttttccagagttctaatttttgctcagaaaaattatgattatgagaaaagctcagattttattggtcacaaatagtgccaaattgccttgaagtgacggactcattttgttcattttggaaaatatctgacaaatatccaagtccaaataaccatagtttggcccatcagtcactttttgaagtaaaattgacatttcacaggtgaagggccattcatctcacaatgcacagtgagattcctcgaggcggactcttcctggggcgtgccggagaaataaatgctctgtgtatacttcccacttcgtcacgcagaatattcagaagacttgtgctcaggggttgagatttatgcaaaataattatttttattgcatcaaggacattcttaagtggaactggcttttttcccgcctcacagctctgaagtgtgtggcagtgaagaatgcagcagccactagcatgctttgctcctgctgtcttcgtccttgcattggtgtttcactcttttccccaccattgtttttttccctgtcagtgtgaatgtcagcacagtgaaaaaggcagaggacattttggtacaaatttgaaaatagttttgactcgtgggcctgctgaagggtgttagggtgaaaatcctattttgctagccattagtagttaaccacagatttcttgaaacttgctcaactttttaatatctgtctgctgatacatatttaacataggtgtcaaccagatttgtttttagtatttggaaaataatgctttcccttctaattcttcattatagctttaacactgaaatttgtcagagaacttagttaattatcaatgatatgttcaggttggcaactaggcttatagcatggccttaccctcgctgcggctctaggctatgctggaccatctgaatggggtcctcggaccacactttgagaaccacagctctgttgggttgtctttttcttattgacttgtgggatttctttatatacactcagtagcagctctttattggttgtatgtgttgcagatattgcctgtttcttttttgtctgtttttcactatgtgatggtgtcgctttatgaacacagattcttttctttttttaaccttgagatgctaccagggcagccactcaccacagcccctgctggggtgtgaatgtgcaccacgcacttcacgtccgggtgtgcagcataaattgcagagtgtaaggtgaagccggcctgattcactcccagattagtgcttccacgatctactatatctccttgtagattgatcttaacctgaaaataaaaaaataaaaatttaaaataccaagaggacttcatttttcttttctgttttcgagacggtcggtctcgcccagtatggagtgcagtggtgcaatcctgattctctgcagccttcacctcctgtgttcaagcaacccttctgcctcagtctcctgagtagctgggactacaggtgcgcaccaccatgcctggctaatttttttatttttaatatagacggggttttgccatgttgctcaggctggtctcaaactcctgggctcaatcagtctccctctgtcgccctggctggacctcagatgatctgcctgccacggcctcccaaagtgctgggattacaggagtgagccactgcacccagccaaatatgataatgagccaggggtagtgggaagcatatttagatcatgggcgggtcagcaatatgcccatgggctttgccaccagagtcctgtgtcctggtgtgcctcggcacactgtttgccataggctttgaggagagtgttggttggtcttaataacattctatctcgggcccagaggtagcccactgaaggagaaattcagagaagagaggtgggatggctgagacatttttgcatagacctgcaaggggacaggcctgactaaacaaatcttgctccttaatagtcaggaccaagcctgtgttgaacttagcaatttggtttcagctaatcatcgatctctctctttaaaataatgttgttaatttgaatttcaccttttttttttttttttgagacagagtctcactctgtcgcccaggctggagtgcagtggtgccatcttggctcactgcaagctctgcctcccgggttcacgccattctcctgcctcagcctcccgagtagctgggactacaggcatccaccaccacggctggctaattttttttgtatttttcatagaggtggggtttcatcgtgttagccagaacggtcccagtcttgtgaccttgtgatccacccrcctcggccttccaaagtgctgggattacagatctgagccaccgtgcctggctgaatttcaccattttaaaaatatttcactttaaaccaccttgagtttttacattatatgaaggctaaaagacatattatgttgcattttaacatttgcatatgtttaacaaaaatagttttagtctggtgggagatacggtgaggggatggcactttggggtaattgttttttctttaaagggccctgaactcaagcatcctgtcataaagaagactactcggcaagtagtcttaagtttctatctatttttctgttttcaaggctgttttagactccattttgattatgggcattagcagttgtctttattctcatatatcatattattaaaatgtaagttgcattttacactaaggaactgggttctccaatagttattatgcccatagattaatcaaggcatatagtcccaacttaagccatttaagagtttgctggcgtaggccaccgtgcacggcggcctaggccgatcacgcctgtaatcccggcactttgggaggccgaggcgggtggatcatgaggtcaggagatcgagaccatcctggctaacacggtgaaaccccgtctctactaaaaatataaaaaatcagctgggtgtggtgttgtgcatctgtagtcccagctactcaggaggctgaggcaggagaatccctctaacccgggaggctgaggtttcagtgagctgagatggcgctacagcactccagcctaatgacagagcgagactccgtcttaaaaaaaaaaaaagagtttgctggctgggcgcagtggctcactcctgtaatcccagcattttgggaggccgaggcagatgggtcacctgaggtcaggagattgagaccagcctggccaacatgatgaaaccccatctctactaaaaatacaaaaattagttgggcttggttgcgggtgcctgtaatcccagctactcaggaggctgaggcaggagaatcgcttgaaccagagagttggaggttgcagtgagccgagatcacgccactaaactccagcctggcgacagagcgagactctgtctcaaaaacaaaacaaaacaaaaaaaactcgctggtatttgtcattatcttgaattgttacccaatggttactacgcccatagatcaatcaaggcatatagtcccaacttaaaccagccatttaagagtttgctagtattggtccttaccttgaatgcttgccctgttgggttttaggtcatattagaaacgtacagatttctttgcagtgaacttcatgaaagtagttgctaatgtaatttgttggaactactcaaaattgccagattgacttgagttagccttacagaaagataagctgagtggtgatctttggcttttttcctttagcataatgcttttgagagtcatctctgttgttgcatgtagcaatagttaattccttttatttctgggtaataatccattgtatggataaaccacaatttgtttatccattcatcaatagagagacgtttgtattttccagtttgggctgttatgagtagagctactaggaacatttgagtatcagtctttttttttttgagatggagtttcgctcttgtcacccaggctggagtgcaatggcgcgatctcggctcaccgcagcctccgcctcccaagttcaagcgattctcctgcctcagtctcccaagtagctgagattacaggcatgcaccaccacgcccagctagttgtgtatttttagtagagacagggtttctccatgttggtcaggctggtctcaaacttacaacctcaggtgatccactcgcctccgcctcccaaagtgctgggattacaggcatgagccaccgtgcccggccgagtatcagtcttttaagtggatgcaatttacttctctttgataaacacctgggagtggaattgctgagtcctatagggtaagtgcttatactgttctgcagccacgtatgagaggtccagttgatctttatctttgccaagtgctggatattggcagtctttacttacagccattctagtggtttgtagtgttatccttcattatggttttaatctgcattttctatttatttatttatttatttatttgagacagagtctcactgtgtcacccaggctggagtgcagtggctcaatctcggctcactgcagcctccacctcccaggttcaagcagytctcttgtctcagcctcccatgtagctgggactacaggcgccagccaccatgcatagttaattttttttttgtatttttagtggaaacggggtttcaccatgttggtcagtctggtcttgaactcccgacctcaggtgatccacccgcctcagcctaccaaagtgctgggattacaggcgtgagccaccacgcccggcttaatctgcattttcttaacgacttgttgagcatcttttcatgtacctattttccatttgtatctctttggaaaagtggctgttcagatcttctgctcatttttattgagttgtcttaatgagttgtgagatatttttatataatctcaatacaagccctttattagacaggcttcacaaacattttctctcagcgtgtgactggcattttcattatacagcactgtcctctgaagagcaaaagatttatattttgatcaaatccattttttttttttttttgagacagtctctcgctcttttgtccaggccggagtgcagtggcactatctcggctcactgcaagctccgcctcccgggttcacaccattctcctgcctcagcctcccaagtagctgggactacaggcgcccaccaccatgcccggctaattttttgtatttttagtagagacaggatttcaccgtgttagccaggatggtctcgttctcctgacctcgtgttccgtctgtctcggcctcccaaagtgctgggattacaggcgtgagccaccgcgcccggctccaatttgtgtttctaaatgattttgtgcctttgtgttccatgtaagaaatctttgctactcaaggttataaagattttttgccctggccgggccgtggctcacgcctgtaatcctagcactttgggaggctgagacgggtgggtcacgaggtcaggaatttgagaccagcctgaccaacatggagtaaccctgtctttactaaaaatacaaaaattagccgagacggtggcgtgcacctgtaatcctagctactcgggaggctgaggcaggagaatcacttgaacccaggaggtggaggttgcagtgagccgagattgcaccactgtactccagcctgggtgacagagtgagactccatctcaaaacaacaaacaaacaaaaaagttttttttgcttgtttgtttttttctgtcttaatagttttagcatatacatttaggtctatgagccaccttgaatgaagcttttatctgttgtaagggttaagagtcatctttttttgcatactgatatccagttgttcagaactatttattgaaaagacaattttatctcattgaattaccttgggacctttgtcaaaaatcagttggttctgtatgtatggatctattattggatgctgtgtcccactttacatatattcctattcctttgccagtaccatactatcctgattcttgaagctatttatagtaagtcatgaaattacatagatgtctaccaactttcttctttttcaaaagtggtttggatatattagatcctttgcattgctatgtaaactttagagccaacttgtcagtttctacagaaaagcctgttgggattttaactggcattgtgttgactctatagatcagtttgggggagaattgaaaccttaacaatattgagtcttcaagtctatgaatatggtataactcttcatttatttagatcatttaagtttattttcagcattgttttgtagtcagtatattaaaaactttagtagtcagtatattaaaaactttccagacaggcacagtggctcatacctgtaatccagcactttgggagttctacgcaggtggattgcttgaggccaggagtttaagaccagtttgggcaacatagtgagatcctggttttacaaaaaataaatacattttcccaaagtattttatattttcttgctattttaaatatactctaaaaagtttcaatatttgtttattgctagtacatagaaattcagctttttttttttttttttggatattggccatgtgtactgtaaaaactcatttattagttctatgggccttttggtaggtttctttttttttttttgagacagagttttgctctttgcccaggccggagtgcagtggcgcgatgtcggctcaccacaacctctgcctcctgggttcaagcaattatcctgcctcagcctcccgagtagctgggattacagtcatgtgcccccatgcctggctaattttgtatttttagtatagagacgggtttctccatgttggtcaggctggtctcgaactcccgacctcgggtgatccgcatgccttggcctcccaaagtgctgggattacaggcatgagccaccatacctggcctttttttttttttctttttctttttttttgagacagagtctcgctttgtagcccaggctggagtgtagtggcacaatcttggctcactgcaacctctgtctcctgggtcccggttcaagcaattctcttgcctctcagcttccctagtagctgggattacaggtgcgtaccaccatgcccagctaatttttgtatttttagtagagacggggtttcaccatgttgaccaggctggtgttgaactcctggcctcgtgatccatgtgcgtcggcctcccaaagtgctgggattacaggcctgagccaccgcacccggccttccttaaaattttctatgtagatgatcatgtcgtctacaaataatgtgtttcttcctttgcaatctgtgtatcttcattttttcttgcccaattccactgactagtttttccaatgtgagattgaataggagtggtgtgagtaggcatcctcttgctcatgatcttaggggaaagcatttggtctttcttcatgtagtatagatcagattgaggaaatttacttatatttttagtttgctaagaattatcattatgaatagatactgaattttgtcatactctctacatctgttaagatgataacagagttttccttttttagttaatgaaataaattttggtgattttcaaaatgttggaaaaccttgcattcctgggataactcacatttggttgtgatrtattatccttttgctaggttgctggattggatttactaatgttttgttaaggatttttgtgtctatgttcatgaaggatattagtctataaatttcttgtctcacatctttgtgtggttttgatgttaggctaatacttcattataaaatgagctaggatgtattttctctttgattttccggaaaggaaaagtttgtgtaaaattggcattatttctaccttaagtgtttggcagaattcaccagtaaagctgtcttggtctgaagttgccttattgggaagattttgaactacaagttcaattcatttgatggaggttatctgtttctttgttagtgaactgtgctagtttttgtctttaaggaaatttgcccattttatattaaatgttgtgacataaagttgttcagaatatttattacctttttaatttccataggatctctagtgattgcttccctcctctttttattcctgataccagttttttgagttttgtctttttttcccctaagactggctagataatttaactgatcttttcaaagaaccacattttgttttaattgcttttccattttcttttttgttaatttttctctttattaatttcattcctctacttattttgtatttatttattttttttaagagcagtcaaacaaagcagtgggagtcaagaaggaacaaagaaatctgtactggttgtgaacagttagttatcaacagcactgcatttgtaccagcctgtttgttatcaacagccttgcatttgtaccagcttgttttggtttcttaaggtggaagtttacatcattttatttgagacctttcttcttttctaatttgtttaattctatacatttcttttaaaatttgcaccaatcacacaggatctataaatctctgtctaagcattcctttagctgcatcccacaaattctggtatgtttttcattctactcaaaatattttataattgcctttattatgatttgttcattgacccatgttttgttcagaagtatgtttttattttattttattttatttttatttttgagacggagcctcactctgtcaccaggctggagtgcagtggtgcgatctcggctcactgcaacctctgcctcccgggttcaagcaattctcctgcctcagtctcccaagtagctgggactacaggcgtgcgccaccacgcccaggtaatttttgtattttttgtagagacagggtttcaccatgttggccaggatggtcttgatctcctgacctcgtgatctgccgtcctcggcctccgaaagtgctgggattacaggcaagagccaccatgcccggcctattttatttttttagacagagtctcagtctgtgcccaggctggaatgtagtggcgcgatctcagctcactgcaacctctgcccgctctggttcaagcgattctcctgcctcagccttctgagtagctgggattacacatgcacgccaccatgcccggctaatgtttgtattttagtagagacagtgttgcccaggctggtctcgaactcctgagcttgcgcaatccgcccgcctcagcctcccaaagtgcttgggttaaggcttgagccaccgcgcccggccgaaacttctaaatgtaactatggattggtatatttatttcaatttctactttaggtattttgagctctgttgttatttaccatttagcactgttatttctaattgttgaattaatgccaccaccatcatcatcagcatcagcatctccctctttgttgttactaatccttgttgtgaagcaaactttgtcttatactgagagccacctagccttttttcattagtgtgtacatggaatatggcttcccaacctttctttttaacctgtctttatcatctcttgtagcttaggagctcttgcctttttaaagtctagtctgaccttctctgctaataattgtagtatttacactctttccatttaatgtaattagtgatctgtttgggtttaaacataccatcttgcattttttctcctgtttttcccatctgttatttgttactcttcttttaaatgaattgaattttttttttttgaaacagggtctcactctgttgcccaggctggagtgcagtggcgagtgatctctgctcactgcaagctccaccttccaggttcacgccattctcccacctcagcctcccaagtagctgggaccacaggcacccaccaccacacccagctaattttgtttttggatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtgtggtggcacaatcatggttcattgtcattgcagctttgacctcccgggctcaagtgatcctcccaccccagcctctcaagtagctgggactataggcaccaggcctagctaattttgtttatattttacagaggcaaggtctcactgtgttgcccacgctggtctcaaagcaatcctcctgtcttggcctccccaaagtgctgaaacacaggtgtgagccactgtgccaagcctaaccttttttttttttctttttttttttttttttaataatagaagggccgggtgcagtggctcacgcctgtagtggtgccatctcagctcactgcaacctctgcctcccgagttcaagcaattctcctgcctcagcctcccaagtagctgggattacaggtgcccaccaccgcacctggctaatttttgtatttttagtagaggcggggtttcacattcttggccaggctgatctcgatctcctgacctcgtgatccacctgcttcgccttccaaaagtgctgggattacaggcatgagccaccgcgtctggcctatgaatattttaaactctttcattttgtctcctgttgaccttactacctgtatttctttttctttgttttataattttttagctatagcttccacttttcagcctctactctcaaagaatagtataccacttcacatgtagtgtaagtaccttacagtagtatacttggagcgccaccatttctggtgctaatgtagtcgtgtgtttttcttacatgtattatacacctcagcatacattgtcattttttccctttctttaaatagcgaattatcttttaaaaagaccttataaataagttcttgacccacatctttatcatgtgtggtgctctccattcctttgtgtagatccacattttcatttggtattattttccctgtctcaagaactgcctttaacatttcctgtaggccarggtagcttctgtttgaaatcttttttgcctttgttttaaaaagatatttctgtttggaatttgaggttgttggtcatttctttcgtggcctctccagtttgtgatgagaaacacgttgtcgtccttatctttgctcctgcatatgtaaggtgactcgttttcctctctgtgcttctgagatttgcactttgtcactggttttcagcagtttgactgtgatgggcctcagcgtgctttgctttgtgtttagtgtgctttgggttaattgagcttgcagtgagtgtgggcttacatagtgtgaatttatagtttcctcaaatttagaaatatttcaagtatttcttcacgtagtcccctttttttctgggatgttagacatcttgagtttgtcctacaaatgctttgtccattttttcagtcttctctgtgcttcattttggatttatttatttatttatttatttagagacagtcttgccctgtcgcccaggctggagtgcgatggtgcgatctcggctcactacaacctctgcctcctgggttcaagtgattctcctgcctcagcatcctgagtagcggggattataggtgcccgccaccatgcccggctttttttttttttttttttttgagacgaagttttgctcttgttgcccaggctgaagtgcaatggtgtgatctcgtctcactgcaacctcctcctcctgggttcaagtgattctcctgccccagcctcctgagtagctgggattacaggcgtgtgccatcacacctggctaattttgtatttttagtagggacaaggttgctccatgttggtcaggctggtctcgagctcctgacctcaggtgatctgcccaccctcggcctcccaaagtgttgcgattacaggtgtgagccactgcgcctggccaatttttgtatttttttgtagaggtggggtttcaccatgttggtcagactggtctcgaactcctgacctcaggtgatccacctgccttggcctcccaaaatgctgggattataggcgtgagccatcgcgtctgggctggattatttttattgcctgtgttcaggtttattggtattctgatctgcttaatctgccaagtgtgtttagtgtatttttttcttttatgtcttatttctcagctctggaagtttcatttggtttatttatttattgacatcttcagtttctcttcccatcgtgtttatttttcctctgtttcttgaacatatggagtttctttataattgccaatttcagattcttgacagttgtatcatctctatttttggggagatctgtttctttttttcttttttatttttttgagacggagtcctcagtgtgtcacccaggctggactgcagtggtgtaatctcggctcactgcaacctccgcctcctgggttcaaacgattctcctgcttcagcctcctgagtagctgggattacaggcacgtgccaccatgctaatttttgtatttttgtatttttagtagagctaaaaatactaatttttgtatttttagtagaggtggggtaatttttgtatttttagtagagatggggtttcctcatgttggccaggctgctctcgaattcctgacctcaggtggtcccgcccgcctctgcctcccaaagtgctgggataataggcgtgagccaccgtggctggactggggaatttctttctttctttcttttattgttttgagacaatgtctctctctgtcacccaggctggagtgcagtggcacgatctagtctcactgcaacctcccctccccttcctcggttcaaacaattctcctgcctcaacctctcgagtggctgggattgcaggcttgtgcctccatgcctggctacattttgtatttttagtagagttgggattttgccatcttggtgaggctggtctcgaacacctgacctcaagtgatccactcgcctcatcctctgaaagtgctgggattacaagcgtgagccactgcacctggcctgggggatctgtttctattgattggcttttcctccttcttaggagtcattgtcctgcttttggtttcgttactggatgctggacattgtgaattttacattgttaattgctggattttgttatttttcttttaaattgtgttagacttgggtgaaacatgactgaggttaaatctgtatatgatgagtgctataatgggacacatttaaggatttaatatgtagtcatcatgtaccctattttaagacttactttcatgtcttgtctccaggaaatgttgctttcccaagttcttgattgcttttctgagtgtactgcgttccagccatgatgataggcactgatgtaccatagtgagcaagtagataggttctggctctcatgaaccatgaattccagtgttgaagacacataaaaaaacaagaacacagtagaacaccaggatttcagatagcagtttaatagaggagattaactggggtgtttaggttgatgggtaagctagagctcaggagatgggcaccgcgctcataatcagaacaaacacatttttaacataaagaataattagcaagtggcagggtgtgtggctcatgcctgtaatccagcactctgggaggctgaggcaggcgggatcgcctgaggtcaggagttgggagaccagccttgtcaacgtggtgtaaccccgtctctactaaaaatacaaaaattagccaggggtggtggtgggctcccgtaatcccagctactcaggagaatcgtttgaacccaggaggcggagtttgcagtgagccgatatcacagcattgcactccagcctgggcaagaagactgcaactccgtctcaaaaaaaaaaaaaaaaaaaaagtaattaacaagtagcgacaggtcagccacccagatccgtgaagtgaatgctaaagaatatggccggggcagatttagggagcagccactaacgggagcttagggaggggactcaagaaaggaacaaacttggaagaggccctgacatggagggggtgtcattatgccccactgggtagcagagaggctccctgaggtcctgcaggctgggactgagtgctggagagtgcgtgcctctcagtcccccacacaccactgatgaggagctgcctcagggtaagagcaagatgagaaaagcacaggaacctggagggagaccccttcttcttcaccgtccctgtagtaccctccacccataggaccacacattgtacctacctgctggcagaggagaaatgtttacagggtgcagctccttcattgtaagtgtggcgaagaagggtggatttggagttgagaggcaaaaaaattaattgactcaaccagcctccctcagtaggtgatctttttgctgaggcctgatgggacagtattctacagtctaccagaagccaatcagaggctcactgactaagggtacgaggcaaagggagcaagggcagtgacttaaaagcagaactttgacctgagcaaccttgaaagctgtggtaagaaatacggtgtttgctcctaagtgaagtggaggagaacagaggttttatgtagggagctctgtgatctcactctgctgctgcttggagaatggatgattagtacatacggaaataggtgtgccactagagagagccagtgcagctgtgcaggcaagaggtaggtgatgatggcttagactgggttggaagcagcggaggaagaatgggtggattgtggaggtgcttaggattgaggtggagtggacaactttgctgttagatgggcgtgggatggaggagagcgtgaacctcgcttgttgaagggaacggactcgcttagggaacagcctcttctaccactgccctctccttgccctaccatgcctcttcagtcagaactccatggccttccagccacttttggtattggaataaccacattttcaggtactcaggtccagtctacataaaaacctaaatgtggcttagtgtggtggctcacgcctgtaatcccagcactttgggaaatgaaggtgggcggatcacttgagctcaggagtttgagaccagcctgagcaacatggcgaagccctgtgtctaccaaaaatacgaaaaattaagccaggtgtggtggcgcatgcctttggtcccagctactcaggaggctgaggtgagacgattgcttgagcctgggaggcggaggttgcagtgagctgagattgcaccactgcactccagcctgggtgatagagcgagaccctgtctccaaaaaaaaaaaaaaaaaaaaaaaaaaaacctaaatgtctcatctaattaattcaaagcctcttcccctcatgttaagtgatggcaggagtccccaagggcagagggcggtggtgtatgtcctgcttccttatgcctgtcctgttcctccaggatggagaaggggcactggagcggagacttgggggtctttgttctctgctgggttgtctaggttctttttggcccactagcgctaggcctgtggtcctaatgggtggcccagtggttgctggctctttcttgttggtggcgggggtgctgctttagcatgctcaggctgctgcaacaaaatgccatgggctaagctgcttgtaaacagcggacatttatatcttatagtctggagggctggaaggtctaagatcaaggtgctggcagattggtgcctgggaagggccaagctttggttcatagctggtgccctctctctgtcctcgtgcggtggaaggatgtggcagctctctggggccttctttataaaaggacactaattccattcacgaagactccgacctcatgacctaatcaccacctaaaggccctacttcctgatacattaccttaggggttaaaatttcaacttatgaacgggggcgggcgggggcacaaacattcagaacagagcaaaacattcagacctttgggcacttctgagaccttggtagggacttcgtgctggactgtctagtggaaactgtgtgacacaaccagcctgcccccaaccccctaccactgctgtcccgcactctgccccccttccctcatggtgtaattctggggtctgcttccccagcaggacctatttggggtgggattctttcaggatgacacaagctcttaccctcctgtgtgctggcggcagctgagctgggtcccctgctgtcttttttttttgagacggagtcttgctttgtcaccaggctggagtgcggtggcgcgatctcggctcactgcaagctctgccttcgggttcaagcaattctcctgcctcagcctcccgagtagctgggactacaggcgagcgccaccacacccagctaatttttgtgcttttttagtagagacagggtttcaccatgttggccagaagggtctcgatctcttgacctcgtgatctgcccgccttggcctcccaaagtgctgggattacaggcgtgagccaccgcgcctggccggtcccctgctgtcttaatcctctgcccacttagcaacgctcaggcttttctgctgcagggtcttacctgcaaggcctgcaccagtgtctgtgtgacccaactccacagcacctgccacaggcccttgggagtttccttgtgcttggctcagcagcakactggggtagtgcaagcatctgaacagaccttgccaagtccagcccagggtgagccccaggctccttgccacaggccaccacccgtctctctgggggcttgtctcagtggcttcatgcttgactgggggaggggttggtgaggagagcacacttttccttgtggggaccagagtgggaatagtgcaatactcaagacttaggtgaattcctttctggaagtctctcttgtgactgtatttcttttcctcatgctgtgggggtcagggggaygcaatgattatggagctggcagcccctgtcatgagcctggggaaggctctctagcaccctgcatcaccctgtgggcaccctcagctctgagacctgagccctgagcccctgttcscaaggagcagagtccttctcagggcctcttctagaaggagccttggtgccgatggaagggtaactgagcgggaggaggaacctagggttgtgttgtgttctctagttgttgttggtgaaatccttttggcgtgggacataggaaggtctttgcccaatgttctctctctctttttttttttgagacaaagtctcggtctgtttctcaggctggagtgcggtggcgcgatctcggctcactgcaacctcagcctcccgagtagttgagattacaggcgtgccccaccatgcctggctaatttttgtgtatttagaagagacggatttcaccgtgtgggtcaggctggtcttgaactcctgacctcaggtgatccgcctgcctcggcctcccaaagtgctgggattataggcgtgagccactgcccccggccaagtgttctctttcttaagcctccttgttcctcagagcaggcagtgcaggctatgggattccccaggacggagaggcctctgccccggctgcttgatgcaaggctcagagaggccactaggtttctaccatgtgctgtctcaggcaaccgtgggcatatcactttccagaggtgcccactgaggtggtcattgtgtgtgctgattaggacagtgggagtaaaactgttcctttttaaatttaatataaattaatttttaaactttttaaaaaaatttatatagagatgaggtcttgctgtgttacccaggctggtctcaaacgtctgggctcaagtggtcctcccatctcggcttcccaaaatggtrggattacaggcgtgaaccgccatgcccagccraattgtttcctttttgtatgtatgtgtgtgtctgtgtgacaatgtctctgtcacccagacaggagtgcagtggggcatgatcacggctgactatagcctcaacttcccaggctcaagtgatcctgtcayctcagcctcctgggtagctgggactacaggcgggcaccaacacgcccggcctattttttgtatttcttgtagcagtggtgtttcaccatgttgcccagcgatccacccacctcagactcccaaagtgctgagattacaagtgtgagccactgtatctggccaagatagtttcttttcaatgtttaggttttacagttttttaaaaggcatttttcctgaacagttaataaaaaattgatgccgtgaacattttaacataactggtctattctgttctctttttaaaacagagccaagattttcttcttcactcctcgcttggtggctcccagccagaggccggcagtggtgggaggctcgctctgggtgcacagacgctgccttcagacaccgcatgctcgtgcgaggcctgcagtgagcgcaggtatgtgacgtgtgtgccacgttgctcacacctgtccayartgacatgcagacctgcatattggagctggacggagwaactgggctaatgtgacagacagcaacaagagtaaggcagttgcttcgctattgagagaaagaaccatatgagtaagacaaaaactgttgctcttgaggaactggcactaggaagcatcctcagaacaagagaaggagtccttaaataatcagaatctaagagcagcctcagtgaatgagaggagcgatgggggagagcctgactggctgcttctcagtggctgaggggagagccctggagctcatctttttttttttttttttttttttttgagacagggtctggctctgtcccccaggccggagggcagtggcgtgatctccgctcaccacaacctccgccttccaggctcaagtgatcctcccacctcagtcccggtatctgggactacaggcgcgcaccaccatgtcgggctaatttttgtatattttatagagatggggcttcgccatgttgcccaggctggtctcaaactcctggactcaaacgattagcccrtcttcacctcccagagtgctgggattacaggcatgagccaccatgcccagcccaggagcacatctaaaaatgctctgtgctctggctcaggaaggaatgcatgtagccaagtgggggccaaagggtgggggcaaagctgcccattaagtaccttggaggtgaaggccaggtcagcagtggggatgtgggtaccctaattgtggacattagccacagatgctcctgtcatctgtgcagtggctaagatcttacgcagagtgcaccctaggagctgtgctggggatgccatcacccccctgcactgacagcagcctgattgccggctcctgggagctgggcaaggtgcaagagcctgggaggtcctctgaggacagtgtgctaggtgaggaagggcagcagattgtggtgactttctaaccttcctgtgttgtctcacagagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggtacatactgccctttcctgttgtggccccatgcaaacccctgccctccctgctgcacttggagccactcctttcaggatgggctttccttacagtgctcagctgggtttgcttagcctttggtgcctgtcaagactgcagcagatgaactggcaaaagtgagccccctaggtcaaacgtcttgaatttttctgattttgatgaaacgctattgcctgtataattacacaagaaatgtttctgtcacttgtttgtgtgaagactgataataataccttcctttttgagtccccctgtgccagggatgatgcagagtacttttacaagcactcttgcctttatcaacccaaggagaaaggccgagttagcccatttatgaagtgaaaaaatgggggctctgtgaggttgggtagcttgtgtatgtgcctgtggttcatgaggccaagacagctgaggcgtgcctggccgtgtggctgtttctcatgatgccgcagccgttcttcagcagataccttatgctcagtaaccacacagaatttgaggtggccataatttttattcttccttatagtttgatgtaactttttttttttttttttttgagatggagtcttgctctgtcagccaggctgtagtccaatggcgtgatcttggctcactgcaacccctgcctcccgcattcaagctgttcttatgtctcagcctccagagtagctgggattacaggtgcccaccactgtgcccggctaatttttgtatttttaatagagatggggtttcaccatgttggtcaggttggtctctaacataatccacctgccttgacctcccaaagtgctgggattacaggcgtgagccactgcgtccggcaacataacatatttttatgttttttgaaatgtttcaaatgaaagcaacttatttgagatggccatttcatgggttgattctcatttgggtttctttctcacattttgaatgcagcacatttgggaggcttttttttttttttttttttcagatggagtctcactctgtcgcccaggctgatgtgcagtggtgtaatctcagctcactgcaacctctgctgcctgagttcaagtgattctcctgcctcagcctcctgagtagctgggattacaggcgcctgccactgtgcccagctaattttttttttttttttgagacgatgtctcgctctgtcgcccaggctggagtgcagtggcgcaatctgggctcactgcaagctctgcctcctgggttcacgccgttctcctgcctcagcctgccgagtagctgggactacaggcacccactaccacgcccagctaattttttgtatttttagtagagatggggtttcaccatgttagccaggatggtcttgatctcctgacgttgtgatctgcccgcctcggcctcccaaagtgctgagattacaggtgtgagccaccacacccggctgcgcccagctaatttttgtatttttagtagagacagggttcatcatcttggccaggctggccttgaactcctgaccttgtgatccacctgcctcagcctcccaaagtgttgggattacaggcgtgagccaccgcgccccgccgggagttttataaactgatgtttgctgtgcagtagattctttcctggaggcagggatagtgattagccatagattaggttaactcattgaattcagccaagtattttcagggtttgacctgtgagccactggtattgcatgaggtccctctctgtggtatgtgcttttattagaagttaggtttccagccaagcrtggtggctcacacctgtaatcccagcacttcgggaggattgcttgggcccaagagttcaagactagcctgggcaacatagtgacttgtctctacacaaaataaaaaaaattagccaggtgtgatgaagcacacttgtggtcccggttgcttgggaggctgaggcaggaggagctcttaagcccaggagttcggtgctgcactgagctaggatcgctccactgcacaccagcctgggcaacagagtaaaatccaaagaaaaacacaaaaaaacaacaaagttaggtttcctagtgagtattaggaaaaaatgtataaccttcacgtcaaacccatgacttcacagcttattaacattgcaacttcagtactttagagtagcagccagtgtgtagttgatgtgcccgcatctgttgaatgtgtgtgtgagttagcgaatgagcttcctagcttcttcagcatattgctgtctctctctttttttttttttttttgagacggagtctcgctctgtcacccagggtggagtgcagtggcgcagtcttggctcactgcaagctccgcctggcgggttcatgccattctcctgcctcagcctcgcgagtagctgggactacaggcgcctgacaccatgcccggctaattttttgtatttttagtagagacagggtttcaccgtgttagccaggatggtctcaatctcgcctcccaaagtgctgggattataggcgtgagccactgcaccctgccccgctgccttctttttatataacttaaaaaaaaatctgtttgcaaaagtatcacatggttatttccttaaatttataaaatacagaaatagacaaaaaaaaaaaagagayctaagtccgacatgctaagagaacagtgacgtgggtgtccagtctrcttctaagtttggttgtctctgtcaaaatttgaccttctgtggctttattttaatagatgaaatgcattctgtttcagaggacagttttttatactagtagttgaaatgacagttgtcatgctcaaaaaattaatgtctgtctgaaatatactaaccataataggaatcccatccatctacactatttttttaatccacattttccataaggcttcacatgttccattgcaagattttacttggcacttgtcttttatagcctaggtaatatggcaatttaaaaatagaacaggtgacaactttcttttcttttgacataatatggtatgtaggtgaaaggatttactatgtaaaatccaggagctgtagtttaatacattttacaactcatttctgttagagtgatgaactcaaactgstttctcctggtgatgggttatggacgaatttttattattacatcagtggttttaggtttccatctagaggctcctggattaaaatacaattaaatttaaccatagcaatgccagtactgtagaatacgttttaaaatgtgcattatcggccgggtgcggtggctcacgcctgtaagtcccagtactttgagaggccaaggcgggcggatcacaaggtcaggagatcgggaccatcctggctaacrtggtgaaaccccgtctctactaaaaatacaaaaaattagccgggcgtggtggcgggcacctgtagtcccagctattcgggaggctgaggcaggagaactgtgtgaacccaggaggtggagcttgcagtgagccgagatcacaccattgcactccagcctgggcgacagagtgagactccatctcaaaaaaaaaaaaaaaatgtggattatcatacacatttgtgtcaaaaataatggattatcccaaagtttggcctgaaattcatgaaaatgctcattgcatttgtggcttagtcatgttgcatgtattttttttttcctactcttcagcctacaaattttattttacacacctttattgcttttttggtgggataattgttaaaaaaaaaagataaactgtgtctaaagtttcctcttttgataagcctaatacaaacccatttggattgtacactgaacttctagaaagaaggaaagagcaggctgccgcagatctgcagccaggtggcacctctcctgggatcagtgctttttacttgttaacatataagcctttaaaagagttgtccccagcctcgtgtctgagcatgttgtctggggccagctgctgagaagtggtagcgtgctcttccagctgtgtgagtttacgcaagtcacccaacctgtgtgggccaaaatgtcccctctgtaaagcaggcactgaacccacacacagcgaactgaattagtgcacgtgcacggacagtgctgtacagagaaagctcaataaatgtcacttgctgttccctagtgacactctgtgccccggattccccatccattaggtggggtgattgtgcttctcacaggtggttatgaggaaggtgactgtgtggtcatctagaggtggccacctgtggaagggcttcagaaaagatgctcactgacatcagagcacccatgggccctggtgggcaggccctggtgaccctcttctctgtgcaggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggtaagagagaaaacgtgtttttctttctgtttggatgagctgaagagaagcatgtggcaagaggaagcttctcacgcatgtgtgccgacctcgctgtcacacccccacacactgtgataggcccctcttctctacgggagaggacctgtttcctctcctctttgtctttcctctggactttgccactggataaaagcattgggtggattgataagcaggtgacacctcatggtagtactgtttggaggaccttgaggcccagggaacgaggcatgggggcagtgtgaggggagcactgatgtgtgcctttataaggagacagagaaatctccggtgtcttacttaggttgttcattctttcgttgctgtagacagagctggtattaggtgaaatgcccatgaagagcatgaaggctgtagagaacagcttgtttaccgcccagtggcgttcattcattcatgcaggcatgcatgcactcagcaagccagcactgagttaaggatctgcttgcagtctcaagacaggccctatcaccatccttgccaatggggatctgacagtcctaacaaaagagacacacagatgggtccggttgcctcaaaagaggaatcactacattgggtggaaggagcatggtatagaaatatggttacaagtaggctgcggtcaatcctcaacagcctcagtgcccccacgctttggaaggagaccagagacaagccctcaaagcttccttgactgttactaatagtctatggagtttttcatcacttaaactttattattaaataatacttaactgtatttgggtgctagttttgggtgctttctttcttttaataaagaaaaggaatttatttctcatggttaggaaggctgagaagtctaagtttgaggggccacatctggtgagagctttcttgcaggtggggacttggactctgaacagagtccaaaggtggtacagggcatcacatggcgagagggctgagcatcagttttgggtgctttcttagtggtaaacctacattttgaaacaaatacagtaagcattggccttggtctttatctgattctcaagttgatggaccctcttagaaaaatttacatacagcccgggtgtggtggctcatacctgtaatcctcgcactttgggaagccaaagtgggaggatcacttgagcccaggagcttgagactagcctaggcaacatggggagaccccacctataccaaaaaaatttaaaattaaattaaccaggcgtgatgacgcatgctactcaagaggctgtgaggcaagaggatcatttgagctcagggttgaggctgtggtgagccagtgtactccagcttgggaatagagtgagatcctatctcaaaaagaaaagaaaaaattacatacatgtaattgtaagtcatttcagggggttcacagacttcctcaagcttcactgcgccaagccatggggaggtatctattctgagaagaggtagcgaggtgaatgggtagggtgaggggtgggggtggggcaggggggcagttatcctgtttcaaggtctgagtccactgggtagtgccaccaggcttccttctggtacctcgtccttcctctggcatctctcgcagcacagcctccccgtctctacctgagagtctgcctgcccttcagaggttcaaatccagagcccctcctctgtcttctacaagaacattggctcaggttaagaaggatgctctccagcccacctaaacctggtgcccagagagactctggtagtgaagacagcagctgttgctgctctccagaaaatgctggcgaggtctgcacctcctcagatagttactgtaggatactgttttatgaagctgacaaaaattaatttgaaccatatttattagagcaaattcctagcagttgacatagaaataatttcttgtggcttgaggccgggtgcggtggctcacgcctgtaattccagcactttgggaggccgaggcaggcagatcacctgaggtcaggagttcaagaccagcctggccaatatgatgaaaccccgtctctactaaaaataacaaaaattagccgggcatggtggcgggcgcctgtagtcccagctactcgggaggctgaggcaggagaatcacttgaacccgggaggcagaggttgcattgagccaagattgtgccagtgcactccagtctgggcaacagagcgagactctgtctcacacacaaaacaaaacaaaataaaaaagaaataatttcttgtggcttgaaaaaaatgcatacacccagaagctgtttgattagtgtcttttttcacttcctttacacatagaaatacccacattgatttctaggggtccagcagactagatacccttaactattccttcctccaagggaaacaactgaatttactagataataaaaaaataagccaggcgtggtggcttacggctataatcccagcactttgggaggccgaggtggttggatcacctgaggtcaggagttagagaccagcctggccaacgtgatgaaaccccgtctctactaaaaatgcaaaaaattagcctggcgtggtggcacgcgcctataatcccagctacttgggagrctgaggcaggagaattgcttgaacctgggaggtggaggttgcagtgagccgagatggggccgctgcactccagcctgggcaacaagagcaaaactccgtctcaaaaaaaagrtgaaatcttttaaagtgtatggctgagatggcatgaaagggagtaagtcgtagtggtgaaaaaccaattgaaagctggaatcctgagaaatacatgggcttgaaagtcagcatttgctgtgggtatttcttctgatcctgggagacaagagacaacctagcccaggatggggtctgcacataatgctgggactgtaagtgacgacactagtaaggttgaagtggaaactccgagcaccgaaagggacagcagggatctgcagctctcgtggccttggggtggagatgcagggagtacagcttcccagagacttggtagctgtcagccagctgccacatgagctggagtgtgaataaatgttggtgtggtatgaacagcccaagcctggaagttacttyacagtggtccaggrttgctggtaaagtcaggcagcatgcagatcacctctggaaaccttcaatctgacctcagagaattcgaatagataaaatccccccaaatgagcagctcacagtaaaaaaagtcataaaacacaaggttcatgacagcacagttaaaagccagcagaagcagtagacagaatcacataacaaagatatttaaattttcaaaaaagaatatagagtaactttgttaactgtgcttaaagaagctttgtaaaagtttgaaattgggagttaaggattaatactctaaagaatgataattcagatttgaaaaaatatcaaaactagaaacaaaaactttttttagagatgatagctgagaaattctcagaattactgaaaaatactagtgttcagcaaggaaacgtatcagatttcccaagtaagatgttgaaaaatccttctctggttatagtataatgacagctacagaacatcaaagaaaaagtgatctcaaacacaaaacacaggactttgttgaaaatggtctgtgagatgttataatgtgtaattctggattctgggtagagactacaatgaatctatgtactccttacccagatgcgcagttaatcagcattttgccactctgacttcattatgccttctttttcttccactttctcttccctctttttgatgcagtattttagtatgggtcccagacaatgtgctttttgtcttagaatattccaataagtgtctctaaaaatagtcatccattatcttctgtagccacagttccattgtcacatccatgaagactgacggtaatagtaatttcttaccgactaatgccagccartctctttttatggttgggttattccaatcaggacccaaaaatcttcacaaattcatagccacattattacactgccatccagtgatctatgcagcaccagcttaagataaactcggtgtctcagggcagtaattctcaacagttttggacttaggcccctttatacttaaaaatttaggaccccgaagtgtgcttttttatgcagacttacatcagtacttgctgtattgaaattcaaactgagaaaattttttaaatgcttattgtcattttaaaaatgtaaactctcattagattacataaattgcatattttaacatatattagagaatgtaacaaataatacacttttacattagataatgtaacataaattacatatgtaaaaataactattttccaaaataaaacattgttgcccaggctggagtgcagtggtgagatcttggctcactgaaacctctgcctccccagttcaagcgattctcctgccccagcctcccaaataactgggattacaggtgcctgccaccacatctggctaatttttttgtatttcttttagtagagatggggtttcaccatgttggccaggctggtctcgaactcctgacctcaggtgatctgcccgcctcggcctcccaaagttttgggattatgggcgtgagccagcgcaccyggccaacatatttcttaagaagagtgggtcactcacacctctccagatctctctgtaaaagcagtgggagtctcatctgcattcagtctgttgtcataggttgtctggttgaagttattgaagaaaattcaactttttacagataatgtagttggaaaaaggacgaatttttttttttttgagacggagtcttagttggaaaaaggaataatttgtctttttgtgttttttttgagacagagtctcactctgtctcaaaaaaaaatctcgctctgtctcgctgtgtccctcatgatctcggctcactgcaacctctgcttcctgggttcaagtgattctcctgcctcagcctcccgagtagctggaactacaggtgggtgccaccacgccaggctaattttttgtatttttagtagagtcggggtttcactgtgttagccaggatggtctcgatctcctgacctcgtgattcgcctgccttagcctcccaaagtgctggaattacagccstgagccaccgtgccctgccaggaagaatattttaatagcctcttcaaatcctgatagatcttctctgagagtacaccaacgcgggagagtttcttaatggttagttgcgatgtagagtctgaaactgtatcactgaacttaccctactctgttccgttaaaatccacaggctccagctcaccccatgaatggattctctacttatacatggtttgctagtgtcattcataggtcattttgcaaatattgattcactgagtatcttctggatgttgacagttttattaatataaaaaatgatatttgtttatatcagcactgatctcatcagaaagctctttaaatgtgtaggatctttcaagccaacagcagcaaatgcaaattttctaaagttttcttttttgcttgaaagcttagattttatgattagccacagattgtgtcacttgttttctttgaagcaacatgttaatttgctgtgcaaactctgccagctagttagctcttctgaacagcacccccattctacttgtttttgctgaactcactggatactcttggacatagaaaggtattctcagaaatgcaactttactggagaatgccctcacgtgaggtttattccacactgcctgggggatcaaacaggataatgagtcatattttttgtatttactttaaatattaaagtaaaattgggggagtgggcatggtggcccacacctgtaatcccagcactttgggaggccaaggtgggtggattacttgagcccaggagttcaagaccagcctgggcaacatggtgagatcccgtctctacagaagatacaaaaattagctgagcgtgatagtgtacacctgtagtcccagccactccggaggctgaggcaagaggattgcttgagcctgggaggcggaggttgcagtgagccaagattacaccactgcactccagcctgggcgacagagtgagaccctgtctcagtcaattgaccaatcactcaatatttttttaaaagaaatctaaaaaataaamtaaaattgtcactaggcttaagttatgcttctagtcatctaggaaacacctcaccaggctataatagtgaagtctaaattttcatcgacaaagacagaaagatctcaaatgtcccgttatttcagtctattgtaggaactacattctaaacatcttctcttccttctttcaaacccccaaaccttttttgtagtgggaagtgagaacagtttgcagagcctgcccttaggtcactgacaagcctttctgcctctagctcagcagttcttccataggcctcacctctcgtaggagctgtgaggacacatcctgcagagcccacccctgcatgccccggtccagttatttgagcccctctatgctggttccacgcctgtcgatggggcatgggcagggcactaccaggttcacagggaacttactggaggcattgaattcagcgctaaggacagtgcctggccatgctaggcactcaggtgttaacatgtgttccttaagtaaactccaagttgatttccggttgtgaagtgagtctgatatctgtttgtcttgcatgcctcacctagaggtgtaattttaggttttattaaaaatgccaaatatcttcataaattagccttcacccagtgaccattagcaactggcccagaaagccagacttgtgattccactcatagacaggcaggtggaaatggctatcccagaggtttccaagggaggccaggcaaagcctcagctcttccaggaggcccctccctcagctagttgccaacctggtctgatccaggtgctgcattcactctcatgtactctttgtcttgtagctgaatcgtaagtcaggtcactgcctactcttctgttccccgggaactcctggagagcagcggactattgtagcaggaggtagtcttcgtgtcctcgtacctggcacagggcctgggcagcatgggcttggcatttcacctgcttattattacaagcacatttgtgggttccagcctggggctgggtatcagttacctggccctggtctcctgccacgtgcatttttcctgtaccgagtgtgcttgctctgagataatgcttggtgtgaaacaggagtgatgatgtttcaatctgggaggcactggtgaaaacacgatgaggaaaagtactggaaatgttaacaaaacggaaggttttagattttctgcagatggcatagattcattgctgaatctctcaattcttgtgtttccaggtatgaaaacagagctgtatccagcaaggctggcacacagtggtctagcagtatcactggtgtgctctctccaaatgtgtttataggtgtttactttcaatcattataatcattataatttgttctctcagcccccataccaactagggttatyaggtgacataacagtgaaatctttgtgtcgttcatttgctaaggtctccatcaactcagcttggctatattgtaaacaggagcagacctctaaacccagtccctgtgagtgacccgactcaggagacgtggagtagccaagcatgatgaagtgcagcttccagagctggcggttgttgaagtcaggaacattcacccaaagatgtaacgtgatctgaacacaagtagtgtccgtgtagttgacagagggaagcatggattcacacacgcatggttgtagcaagacttattaaatgtgaacattacatttaggaaaggtaataatggcatcaacctcagtgatcttgtgttgggggcttgctgtacatctctgctgacatcactctctatgatgactgggacacttctaggttttcgtggtattatctaaagtaattgacaagtttgcctacatttattaggaagacaaaaaaccttaactctgatagggtcttgcaagtggagaaattgtgtgtattaattagaatggaaggtttctccaaataggtaagaaaattgttatcctttagcatcgagggacttgatgtatctaaactgtttgaactgtaagggctttcattacattttaaaagtataattgtgagaaatgactctcaaacgtgcagttactgctttgtctctgtgcacacctgtcaccctgtctttgcagcccttctaaacttgccattttagaggggagatgtgctgaaatccatgtccgtgtagtcagagttctgatgcactgtgtgccttgagacatacagggagcagcacttctcataagctgaacactctgggcctgtgaagagggatgtgtgcgtggtggggggaaatggggaggggggagggaatccctctgggaattttctagtctttagcaattcactacatcttctgtttatcttttactttttcttaaccaggaaaatgaacacttgaaaaagttccaagtgacgtgggaactgcataataaacacctgtttgaaaatctggtcttttcggagccacttcttcagagcaacttgcccgcactggtgtcacagatcaggtattttgccttaacccgtatgtgtctttgtggtgtgacagcacagtcttttctcctgactggtgtgcgtgtacccgagtaccactgagtatgaaagttcttgcaggaaaaataacagggcttaaagaaaaagatagtttgggccaaaagctcaaaacctgagaagcaatacaattaaacttttaaatgataagtcaatataaatgctactaagatttaacaccacaaattcctcatacagaaaagctacagtaaatatagcacttttccttgacaagacctatccttggccgggcagctgtggtgtggttcatgctatggctcttggacatgtaggggaaatggaggagggaagaggcccaggtctgagggtgcccaaggccctccggatacagcttggtgtttcccacacattccgttgctacccgaggctctgttgctctgtctcctggtgtagcgcatccatgtggcttcttcacgcttgggaagctggctgggttctatgctttcactgagaaaaaggggtgcagagtgcagcagtcactcactgagtatttgctcggggtcagagtgagaagatttaggctgggcatgtgtttgccctgtggtaccatgttcagttagaaggcatgttcctcctgatgtgacgttactcagcagaacgctgttccctgcactgagtcatgcatgagctaccacaggtctgcagtttggtgattttgttctttggtgttttattctatttaccacatgtgagcacattcccataatacagacccatcgtgacagcagccatctacatttgaccacgttaacctatacttaggggtgtggtggctcacgcctgtaattccaacactttgggaggccttaagcaggcggatcacctgaggtcaggagtttgagaccagccttgccaacatggtaaaaccccgtctctactaaaaatataaaaattagccgggcttggtggcacatacctgtgatcctggctacttgggagtctgaggcaagagaattgcttgaaccccagaggcagaggttgcagtgagccaagagtgcaccactgcactctagcctgggtgatagagcgagatgctgtctcgggggaaaaaaagtcgttagcttcacaaagcaagggaataaattgttgttctgttgactacaccagttattgctattttatttattttatttttgagacagtgtcttgctctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttcctcctgatgtgacgttactcagcagaacgctgttccctgcactgagtcatgcatgagctaccacaggtctgcagtttggtgattttgttctttggtgttttattctatttaccacatgtgagcacattcccataatacagacccatcgtgacagcagccatctacatttgaccacgttaacctatacttaggggtgtggtggctcacgcctgtaatcccagcactttgggaggccgaagcgggcagatcacctgaggtcagatcaagaccagccttgccaacatggtaaaaccccgtctctactaaaaatataaaaattagccgggcgtagtggcgcatgcctgtagtcccagctacttgggaggctgaggcagaagaatggcgtgaacccaggaggcggagtttgcagtgagctgaaatcgtgccactgcactccatcctggaccacagagcgagactccatctgaaaacaaaatacaaaaacaaacaaacaaaaagaatacgtgtattgacccagtctttgtttcctgtattcccaaattttatttgaggggtcctgaccatctccacttcataaccttacctctagagaaagcaattaggtaaaagagaattgaggacaaaaagatcagaagctacacgtgctggctcatgcctctagccccggctacttgggaggctgaggcaggaggattgcttaagcctaggagctggagaccagactgggtaacagcgagaccccatctcttaaaaaagaaaaaaaaagggccaggtgcggtggctcatgcctgtaatgccagcactttgggaggtcgaggcgggccaggtgcagtggctcatgcctgtaatgccagcactttgggaggtcgaggcgggcagatcatgaggtcaggagatcgaaaccatcctggctaacatggtgaaaccccgtctctactaaaaatacaaaaaaaaaaaaaaaaaattagctgggcatggtggcgggcacctgaagtcccagctacccgggaggctgaggcaggagaatggcgtgaacctgggagcggaggttgcagtgagccgagatcacgccactacactccagcctgggggacagagcgagactccatctcaaaaaaacacacaaaaaaatcagaacaaggtgttacggggcgtgtggccagctggcaggtgggctgcagacccttccagtgttccctgtgccctggcctgctccttagccattccttcccttctgtggccactgtgtatcaagattggaaagtccttactctgacccttgcagaagaaaaggcatcggaagagaattcacagtggtgaatctggaatgtggagtaggctttgtccctggttatgacgttcagattcatcaaaagcacttttcatgagaagayatgcatcttgggagaggggctctgaaaacaagattccagggaatctaccttaaaaaaaatattttactggtaagccagtgagttccgtcagcctgtcagactgtgggtgggtgactgaaaccggaagtgcatcataaaactcccatctttttttttttttttttggagacagagtcttgttctgtcgcccaggctggagtgcagtggtgagatcttggctcactgcaagctctgcctctcaggttcatgccattctcctgcctcagcctcccgagtagctgggactacaggcgcccgccaccacacccggctaatttttttttgtatttttagtagagacggggtttcaccgtgaaaactcccatctttttctgtgccctagttctggattttccgtttgctcattgggtatgatggtcagactccaaccatgagccacgtctctagtgtggatgctggatctcaagctgcagtctcacttctcacttttgggacccacaggcagttgagggagaaggataaacacagacagggacagaatgaggccaaccagcacgttccctgagcagcactgacgacgccaggacacgccatgcctttgtgctctgcagctgactcccttgtcagcctgagactaattcaagataawtcagatttgcattgctaatgtacagatacgcatttaacaattcataaaaattttgctactgattacatacaaacaccccttaaagcttctgcatcctatgaaatacatatggtacaattcacccacttaaaatgtacaattcaatgacttttgatatattwcattttttaaaaattatggtaaagtatatataacataaagcttaccattttaactagtgtatatttcaataacattaattatattcatagtgtttataaccattaccaccatgtactttaaaattttttcctcacccgaaacagtaactctacccattaaacagtaactctccattgtccccttcttttttccccatagcctttgaaagtctgtaatgggcagtttccttcccttgactccccaccattttttgtcttaaaatgtatctatgaaagaactaggccatctgtcctgggggtgctttggtctggatcctgcgtgggcgtgttcacagagcagtttggccacctccatcctctktcctgcctgagaattggtggtaggatctgaaggttctggacggctctgctcagatcccctggcaggccaaggcgtaggcggggggtgtttctatcagggggtgcatccctcaggcctgcttctctttgttgtgggtatcagtagcccaatgtgggcttcactttaaatatgtattaattaggctaataaaacttacccaaaccaatgttatttcattctctttatcaataataatgtttcacatacacattggtaacattacagtaagcatattttcatgctgctgtcttgtatttgcaagctcaatatttagatggaaacctgtttgctgagccattgatttaattcaaccctgtggatagtccctgtgactcttttgatcctagcacagctttgcttgcagggaagccctgtgcctgcagattgcttttcaattataccaacaaagatatccacaaaccccctcccccacccactttgctctcccttggctcaaaataatctgaattctataacttggaagagataaattcttacttccaggaggagcgggacaaggaacacatgacagggtataatgccgcatcccaacgttccaggtggagcaagtaggggcaggatggaattgggtagaagctggattctgtgtgaagaatggaaaccagtcacggaagagcaaggctggcagagaagaagtgggagaaaaactacttcacgggctgcagtgtggcagawccctggcgccactggagtccatgtcttaaggagttttgtctcctgaggggcagaaacagccttaggagaacagctttgatgttttgaagtagcctcaatccatgtgcgtcagtattgtttctttcctttgggcttccctaaatgactgcccagttacacctaacctctgctgccttccctggagagactgcaataggtgagtgcacagatggcttcagtagctgcraggttcccaggtgcgatttacctgagggtggagataggtcagaggagaagagggagtcattcctgcccatttcacccatgaaaagatcctaatttccacatagcttgtttattataaaatcattagattgtcattacaaataaaattatgaaaatayagaaaatcgtaaacaaagttaggttttataaataatttagtatttcttatacattttttccctatgtccactatacgtatttttaaacatgctgtagtcatatctttagttaccatgagcatatttccatttcaaaatatatatgtgtatatatacatgaatgtgtgtgtgtgtgtgtgtgtgtgtkaatgggtagacataattataaaattggtaacaagtatctggttaccaagtactgattctcctagatgtgccatgatgcatttggtagcttctagtgtttttatgtaaatagtgctgatccttaaccttgcgcagaatctttgtgctcttgatatattataaacatggtatttgattctaagccatccttgtcaagatgtctttattccacttattttggctcacactgatagacttaggtattaggaacatgaattttttctggtaataatctacatgtgtctccacaccactccccgtcctcctcctgaccccagcccccagccttctgtctcccaatcgccatcttgctcagtcttttcagaaatcgaggtgttttttctcactgtccacctgcatgtgtgtcttttgtttcccatttattttctcattttccatcttgccatctttctttttttttctttctttttttctttttttattgaggcatagtttcaccctgtctcccaggctggagtgcagtggcgcgatctcggctcaccccaacctctgcctcccaggttcaagcgattcttctgtctcascctcctgagtagctgggattacaggcatgtgccaccacacccagctaatttttgtattttttgtagagacagggtttctccatgttggccaggctggtcttgaactcccgacctcaggtgatcccctcgcctaggcctcccaaagtgctgggattacaggcgtgagccactgcacctgaccgccgtctttcttaatacaatataatatagtagacagaaaactgtaactatatttcttcaagtaaatcagattttgttttgctttatttgaaaaccagatctaaattttatgtctcattaagtgttttgttttctctgagccagttgtattttcaagagtaaaataactttgtattcccatatttatttttttatcatttttatttttatctattttaattttttctttgcaattccatatttggtaaactgaattgttaagtcatagtctttagagacatgttgttcagtgctcatttttttcttagaagctgttgtttctttgagcatctcctttttttttttttttttttttttttttgagacagattctcgctctgttgcccaggctggagtgcaatggtgtgatttcggctcactgcaacctccgcctcccgggttcaagcgattctcctgtctcagcctcctgagtagctggggctatgagtgcctgccaccacacccggctaatttttttgtatttttagtagagatggggtttcaccatattggtcatgctggtctcgatctcccgacctcaggtgatccacccacctcagtctcccaaagtgctaggattacaggtgtgagccactgtgcccagctgagcatctcctttttacaagtytgtcctgggtgccttgcatggggatctrttgatccctcacagctccctgctgtggtgcagagtggcaccctgttttccacgttgggaggcgagatgacaaagcaggatagtatcagcaggaagcacatttctgatctctgcttcagagcctttgggttctttcctttgttacaaggccttctctctcctaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcaggtgagtgccacccgggaccaccgcaccccgcgcacatcctcagacggccctgttgaaggcagcaccaagtcactagctttgtcctgagctgcaagccaggaattcccgactgaggyccagaggcgcatgtgggtagcccctgtgtgttagctgctggttttccggaagggatgggaaacctgttggcatcacagatggcttgggcctcctgggcctgaggtgtggtggcagcagttggtcaagttttccttggcctgggcacacctgctgtcactcacacgggctgtcaccaggctctgcaccccaggtaggaggtttttctttttttttgagatggagttttgctcttgttgcccaggctggagtgcaatggtgagatctgggctcaccccaacctccgcctcccgggttcaagtgattctcctgcctcagcctcccgagtagctgggattacaggcatgcaccaaccatgcctggctagttttgtatttttagtagagacggggtttctccatgttggtcaggctggtctcgaactcccgacctcaggtggtttccctgcctcagcctcccaaagtgttgggattacaggagtgagccaccacgcctggtccaggtaggaggttttttaagtccaggagctgtttactgagcactctgctgttgagagctcattgtccatctgtcctagtctagaagggagtgcagacacatgcacaggtggcaggtggctcaccaggtggaagacagaagagggagggcacctgctggaggtggatctgaagggagggcactcaggcagcccaagcctgtcagacagagcagggctttgagacggcgccccctccccccgcttcccacycctggcctgcctgctctcctaaagcagggttgggccaggaaggaattgagagcggccctggtttaaagatgacactagtgtgagcaagggtaaagaaggaatgactgagtttctcttttgcacttcggagactctctgtaggaaaatggaacctgggctctagcctaagacatgtgctggttccatgtctgccctggcatggtgagtgccatgtggatgccacctgtggctccttgtcagtgttccttgtcagtgctgtgagggactgggaagaaggaagggactagcatgtgcttgctccctccgagaattgtgtcattgatttcacagctacaggccgtgttttctgttgctgttctctactgcagccacagggactagagctacaaatggtctgttgtttggattttcgcgggttttctcttactccattcttctgcattctcagcctcccaaagtactgggattacatttgtgagccactgcgcctggcctgctggctttttttgaacctgcatcagcttcagtggagtaagttccaacttcgtcacatgcggaattctgtgctgttgagcttgtcttagggcaggtggccctgagactctcccatgactctgcgcctcttccttggctgctgtacgcacagcacgtcagggtgaggaggggcctcagagatcactttggtcctgggagactccctctgtgtcctgtgcctcatggtggggcctgagagagcagttgctgttttgtgttttcttcaaagtgggtgtattcctaattcatgtttttgtctgtttttgcaaccagagactttcctgctgtggcttgtcactgaccagcgacttcttagcctggactactgtgagagcagggtctggatgccaggtggggagggcagagtctcctgctgcagcagcacctcagcagccttcatctcgtgaggcctggagcatcccaggggctgcagctgtgccatgtgggggcagcacagcagagagggcgctgaaagctgcattcccctctgccatctgtgggtgcaccagcccattttcacaagtttgctgttctggtagagggagcaggagttgggggaagctaggacagtgggcattaaccttctccaggaagtgggcatcttcggcagaggctcttcagggctgtggccgtgcaggagggccagtagtgtgtccaggtcaccactccctgggatgttcttgacttgggtcccagggagaaccctgcacggcagtcaacaccagaatgtcccggatctgccccatgagtcttttccctccctacctgcaaaatgagataattatgttaggtgatgttttagtgttgtgtgagcttttaattccaaataagttttttctgtgttatttttaaaaagtaaaactggccaggtgcagtggctcacacctataatttcagcactttgggaggctaaggtgggaggatcacttgagcccaggagtttgagaccagcctgggcaacatagtgagaccttgtctctacaaaaaattaaaaaattagccaggctgggtgccgtgtgtttgtggttccggccactccagagagtgagtgggggaggatcacttaagaccaagagttagaggctgcagtgatctatgatggtgccactgcactgcagcctgggtgacagagtgagaccctgtctgaaaaaaaaaaaaaaaaagccaggcttagtggctcacacctgtattcctagcactttgggaggctgaggcaggtggattacttgagcccagaagtttgagatcagcctgggtgacatagatagaccttgtctctacaaaaatacaaaaattagcctgccatggtagtgtgcacttgtggtttcagctactcgggaggctgagatgggaggatcacttgagcctaggaggttgaggctgtggtgagctatgatcatgccaccacactccatcctgggcaacagtgagaccctatctcaaaaaatgaaaaaaatatataggcatagggacagtaaatagtccctgtgttggtattgcactgtgggctgctggttactgggtgccccacagagcaggggtccctaacccttgggtcacagaccagtactagtccatggcctgttaggaaccaggctgcacagcaggaggtgagtggccggtgagccagtgaagcctgtcagtgtttatagccactccctattgcttgcattaccgcctgaacttctcatgtccgatcagcagagacattagatcctcacagaagcatgaaccctattgtgaactgcgtgtgcaagggatctagattgtacgctcctcatgagaatctaatgcctgatgatctgtcactgtctcccatcacccctagatgggaccatctagttgaaggaaaacaagctcagggctcccactaattgtgcattgtggtgagttgtataattatttcattctatatgacagtgtaataataatagaaacaaagtgcacaataaatgtgatgagcttgaatcatcccagaaccatccccttgcctcacctggtctgtggaaaagttgtcttccatgaaatcggtccctggtcctaaaaaggttggggaccactgctctagagcacatcccatggcacccacgcagggtggtttattgagagcacagaaggagggaggagcatgagatctcaggccatcagtagacactgtgaaggaaagaccttgagaaggaaaacagaaggcgaggggccggctttcctgcccggctcactctcgtcaccggggctcaagggaacgaagcgcacctgctctggcctcacgggtgcggtaggggaagccaagaccaccctggctgggggcagagatgggagctcagggctctgaagcccagggagaggctgctgtgcagggcggggtttcaagactcccagagaggctgcttgtgggaagcacgtgaaaggctccttaatccaagagtgtctctgttgacgacatagtgccacctgctaagtctctgtcttgccaacatgagctgcagtcargttgtattgcattaggtcattgaaacctcccaagtgcataggacccygcctacctttaccaaggaccgcataaaaaaagaggagccccaagcaccttctgggtaggcatggatagccgcccayggtacactctaatggcagcaacggtatttgcctttggcccagagaacgctgtctcagggccctcctccacagtcttgttagtgtttgtagcagtaacagacgtgcagatggagaagctgagtgttggtgaatccactggagggtggcatcagacctggaggggtgtgtgtatcagtccattttcacactgctataaagaactacctgagaccgggcttgatactcacccctgtaatcccagcacttagggaggccaaggtgggcggatcacctgaggtcgggagttcaagaccagcctggccagcatggagaaaccccgtctctactaaaaatacaaaattagccgagcgtggtggcacatgcctgtaatctcacctactcaggaggctgaggcaggagagtcacttgaacctgggaggcagaggttggggtgagctgagatcatgccattgcactccagcctaggcaacaagagtgaaactctgtctcaaaaaaaaaccaataaaacaaaaaacctacctgattctgggtaatttataaagaacagagatttcattgattcacagttccgcatggctggggaggccttaggaaacttataatcatggcggaaggagaagaagaggcaaggcacgtcttacacagtggcaggagagagagagcaagaggggaaatgccacacttctgagccatcacatcttgtgagaactcgctatcatgagaacagcatgggggaaatccgcccccatgatcccatcacctcccaccaggttcctcccctgacatgtggggattacagtttgacatgagatttgggtggggacaaaggtgaaccatatcaatgtgacaggttgacatgacgtcacggcagacgtggaaggtcctgtaatcagggtgtggtagcagcctcgctgcctgtcctcaggacagctctgaccagactggatccccctggcagggaagcataagaggttgctggcctgagtcgtcaagaagtgaccattgtgaagcagacattcagctcgtcccagacagcccccaggaggagagtccagaccccgtgtagatgtgtgtgatcagaaagagtcccttgcaagggtcgttcgaaggcagagtgggctgtagtgtggagatgagttccccatgatagggaatgtggagaatagttggagaggtatttggactaggtgaccatgaggtctcatctcagatttcatttcagggacacatctgtccctgactggggctggtggcctctgtgcctggtattcattgtttmccagggatttgcagagtacccttcatgggaggcacttgtctgcaagtctaagtgcaaatcagccttgcctgtcaacaaagatgacttgggtgtgtcggtgcttcctgtcctggtgttgaacaggagacgctggcctattgcagagaagctttgagtctggaagcttttctgaatggaactcccacctccctttctcctgcatttggtgtttttcttctgtaggattgatgctgttcacttgatttatccctggtgtattagtccattcttgcattgctataaagaaatacctgagactggataatttataaagaaaagcagtttaattggctcacggttctgtggctgtgtaggaagcatggctgggaggcctcgggaaacttacaatcatggtggaaggtgaaggggaagccagcacatcttacgtggctggagtaggaggaaggggggtggggaggtgctacacacttttaaacaaccagatcttctgagcactcgctatcacgagaacagcaccttcggggaaatctgcccccatgatctgatcacctcccaccaggccccatctccaacaatggggattacagtttgacatgagatttgggcggggacacaaatctaagccatatcacctggctttcccttcatgtatcgatataagtttctgaggttgtgaataacttgtaaccttcaggtgacttcagaaaaatagtatagttagtgataacatagggaaaaagatgaaagagaaggaagatgaaccgttaccgagtgctgtgccaaaccccgtgtggctagagcctcactactgcttcctggtgttaccacatctgcagatgacaggaggctcccgagggtctcagccaggcaggcctgttggggtttaggtcagcggtgtcctacgtagcataacatcctgcccctaagagcctggggtgctgtccttagttccacatgtgatggaaatggcagataaagttctagtttcagagattcatttctccaattgaactgtaactaaacacaaaaatgcccttagggaaattcttttactaagactgaaaaatcctttgggaatagtaatttcttcaggtatctgtttcttgaaggtaaacatttattttgaaatattatatatggtattattgctgttgttctagggaaaatggtatatatgtaaaaataacacatacatgttctctctagggagaaaataacagtgtcacttaaaaagtaaagtgtatttctttaaaattgcatgttacattgcttttacaaagagaaaaccagtctcttcactaaagcaaccagaagatgctttttatttttatttatttttttttagacagagtctctctctgtcaccaggctggagtgcagtggtgtgatcttggctcactgcaacctctgcctcctgggttcaagcaattctcctgcctcagcctcccgagtagtagggactacaggcgcccgccaccacgcccggctaatttttgtatttgtagtagagacaaggtttcaccctgttggccaggatggtctagatctcttgacctcatcatccacccacctcagcctcccaaagtgctgggattacaggcgtgagccaccatgcccagccaggagatgcatttttattttcactgtcttgtgaagaaaccatgagaaacaatctgccactaatacaattgagggaaattgagccactttagtaacatccagagaataatagtcattctggaaccatgtatgcatgggtgggaggttgtggggagctgaaaacaacagaaatttatgctcacagttcttgaggccagaagttcagaatcagtatgtcagcagggctatgttcccctgaaggctttgggggcaactgcagtgacccctggagttcttggtttgtggccactccactctccactggagctgttttaatgcactatttaatttaaaacctttgaatgaacattggttgcttctaatcaataacattttagaaattttatactgattcaaaggctttaaaatgttgaatacgtgtaaaataattgagtctctgttcacaaataagtatgtatgtatgtggcaagagagttggtaggttttgtttgtttgtttgagatggagtcttactctctcaactaggcggtggtgtcatctcagctcactgcaacctctgcctgctgggctcaagcagccctcccacctcagcctccagagtagctgggatcacagcgcacaccaccatgcctggctaatttttttttttttttttttttttttgtatttttggtagagacggggtttcaccgtgttgcccaggctggaagtttgaaatcaattatttttatgtttgctgtctgaaattcattctttctctgttgtttgacacatacataagcctgcaggtacccaaatttgttccaaaaaaaaaaaaatttccctgaggctgtgaggagagagtcaaggaagaggtttttattgatgttatttatcaaacaactcttacactgtacactaagattttataataactgcagacatatacaatgaaaagggagaattggcaccaatattgaatcttcccatccaagaatatggtatgtcactcttttttaaggtttttaaaaatatattgtattatggttttatagtttgtaaatcttgacccattttgtgcctccatagtctgtagtttgaggggctgctatgaccggcatcttgagtggggaatgtgtgtttaaagcattcatgctggaaactgggaaaatggagatgccctgtgaccagtcatctcgccagatgccggcattaactcttgtagtttttgagttgagtcttgaatctgggagtctaggaaatcacggtatcttctacaaataatgataggtttatctcatcttttccagcatttgtcccctttttttggcttccactaggaccttcagaccagtgtgaataagagcattgatactggcacccttgtccagtcctggcttcgaggggctgctgtgagtgtttcaccatgaagtttgatgcttgccatacagacttttgatactttctagcaaattaaagaagtttacctttatttctagttgatttaggctatcatttaaaaaataaaacaggaagatgtcaaaattgatggtatgatttttcttatatcaatttctgtatgagttaagagtttaggttacctaattttgagacattcttgcgttcctgggatgaaaccctagtagatcatgatatgtcattctttattccattattaaatttattagctgatatttgatttaggacgtgtgtgtgtgtgcgtgtgcgcctgtgtgtgtgtgtstgtgtattcggacagctatataaaattatttttagagacagggtttcacactgctggccaggctggagtgcaatgacaagatattagttctctgcagcctcgaactcctgggctcaagctctcctcccacttcagcctcctgagtagctaggaccataggcacatgccagtgtgccagctaagttttggcttggtgcagtggctcacagctgtaatcccagcactttgggaggccaaagcagaaggatcgcttgagcccaggagtttgaggccaacctgggcaacatagggagaaccccatctctacaaggaaaaaaaaattagccaggtgtggtggtgtgtgcctgtggtcctagctacttgggaggctgaggtgggaggatcataggcccaggaggttgaggctacagtaagttgtgatcataccactgtagtccagccttggtgacagagcaagagaccttgtctcaaagataattttatttacaaacaaatgaaattttttgtagcggtgggggtcttgccttgttacctagactgttctcaaattcctggcctcaagtgatcctcctgctttggcctaccaaagtgctgggattacaggtgtgagccactgcatccagccaggacttttatatctatattctgaggtataattgagttgtcttggtctttgaggtcttacttgttttgtataaaggttgtgctagcttcatagaatgaattgagaaactctgtgtttttgcaattttcaggaatagtttaaattttctgtcccatgaagggtttgatagaacctaccgtaaaactttggggcctaattcatttttacagggaagaagaacaagaactatagatcttgtctgcctttttcatttatatgacatttattagtgtatttcaggtttccttctccctcgagtcagttttacaaatagaatttggctcaagaagttatccatatcgtttagtaaagggttgtaaactcacacctgcagggctagggaaagtcacggaaatggatgatacagggtagagcggccccagcgttcctgtggtgctcatggccgtcaccaccctcaccttgaaagtgccctcagttgggataggccctagtggagcctggggcatgggtagcgaaggccacacctgtgtgtgcgtgcgtgtgtcctcctgttctctgttaggggcagtccccacttgggtccaacagtcttcacagggccaccagagctgccaggttgtcaagagaagccagaaatctggattattaggtgaaatctcgaacacttttaaaaagaggtgaagtgcaagtcggacaaaatagcccatgagccccttgtttgtaactcttctttagatgttacaaagtatcaacttataaagagactttgtctcacagtttaaaaacaatcttctggccaggcgggcacagtggctcacgcttataatcccagcactttgggaggccgaggcaggtggatcacttgaggccaggagttccagaccagcctggccaacatggtgaaacaccgtctctagtaaaaatagaaaaatgagctgggcstggtggcgggcacctataatcccagctaactcaggaggctgaagcacaagaatcgcttgaacccaggaggcagaggttgcattgagccgagattgtgccactgcactccagcttgggtgatatagcgagactcagtctcaaaaacaaaacaaaacaatcttcatatgtacccatatcctttctcaatcctgatttttttttaatgttacctttttccccctttttcagccttgacagaagcttacagaaccgactttcggttttattaatcacatatgcttctctgtttcctcagtaatttctctttttgcctttaactcctaacttctttgttagttttgttttgctttgctttttaagtctcatatgcctgttaatagctcttcctttcctgtagtctgagctcttcgtgtggcaggaccgagttgccatcatcttgcttatttctaacacattcagggcacataatgggcattcagtaaatagtgaatgttcatccactgtattgacagatttagtcagaatatcttgatttctctttttactgtttattcatctctgtctttcatgtgagaaaagtacttgtgatgagtttgagtaaaataaagaaatacctgttaacatatttgtagtattgtatctttattctgtttgcagatgatgtttctctcatatatatcattttaagaaagtctcctcttgaaaatgtcttgtataattgtcgcaggtattaaagtttttcttttttttctgttttttacatccccttactagatgacaatgaaaamcaagcagcgcatgttaacagaagactgggagctttttaaacaaagaagattcattgaagaacaggtaagcttgtcaataagagaggcaattaaaggaagtagaaatctgtcctgacagcaaatgacttctctgcatgttgatgtgctttgttagaacagcattggaggaccacattggcatgttttgccagcgttaaaaactgttcaagatggtgtttttaatctcaagataaactaattttcacctatttccttatcttccatatacgcctcaagaaaaacccatgtgtattgagtggcctctctatcccacagcagctctgggtattttgcaaaggatattacctgagtccccacagtcccctatgaggcagatggtgccatctgcagtttacatatgaaggagggtgttagggtgaggttaaggatgttgcctgatgtcccagagctggaatgggggcccagcatccccagacagagcgctcagatctccagacattgccaggtgccatgccttcaacatggcagctggcagatctggactctcccttcctcatcttcctggcggtgcctcctccaggcaggcttgtgctccacctttgctggagctgttgggcagagcttgctagtgatgtcctgtatctggtctgggggcccttggcttcatctggaaacttggcttcccctgatctcccatccacgtgccacatcgactctcttcctgttctctgacacttctctccatctcctttacgaactccaacttcattggtctttctgcaaatattggtggttccctggccttgaccccatgcctgtctccacatttgcatgcccgtggtctcctctgggcaccacaggtatacagatggcaccagtgttgtggcatgcttacctcttccctttccccattctgcatgtgtccctgtgcttttgttgttgttgttgttttgagacaaagtctcactctgtcgtccaggctgaagtgcagtggcgtgaactcggctcactgcaacctctgcctcccgggttcaagcggtactcgtgtctcagcctcctgagtagctgggattacaggtgccagccaccacgcctggctaatttttgtatttttagtagagatggggtttcaccatgttggccaggctggtctcaaactcctgacctcaggtgatccgcctgcctctgcctcccaaggtgctgggattacaggcgtgagccacctttccyggccatcccgtccttttgagtggcccttccagctgccacctgtcccattgccagagtgggtccagagttccttctcctttgaaatgcagatgctcaccttgtctgttagaagttgaggtgccatttcctcaatagctccgaggccgaccccttgccctccacgtgccacttttcattcctacagctctgttctcagtaccttgcaagtaccaagcacatggcagacagggtaaaggccgggtttctgcatcaggtgtgtgctgtgagggcgcactgcagcatgtttgctgaagacaaaagcgattagggtctcctggtacccgagccctttgcagctcagcccccagcttgctgccgactccaggtctgctgcccctgtattcctggtcctgtcccgctgaggaagcagtgcccgtgaacatgatacatgtcagcagaattactgaaaaataatgagccatgtctcggggaagggtcttgcaagattaaagcattttaaaatttcctctagttaaccaataagaaagcagttactggcgagaacaacttcacagacaccatgaggcacrtgttatcrtcccggctgagcatgcccgactgccccaactgcaactacaggagaaggtaaggctgggttgtggtgtcagcacgactggcccattgraccttcactgggctgagtggaggcctagaaccgacccttagagagcatggtctagtcttgtgcattggttggcttggtaactgtccttaattcctgatcagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcrgggtcyggctccagctctcccatcacaattcagcagcaccccaggctcatcctcacagacagtggctcggcaccaactttgtaagttgtgactttgtaataaagtttccgaaatttaagtcgccccagtaatgagaaatacatacagtaatgtccacagaagtatgaacatcattattgtgcttttcatgacaagggaccctgaggtttttaatgcagcttttaaaacatgaaatcagtaaacccaaacttttaacactgtttatctgggaaaaaaaaaacatggtaaattaataaaggccagtaaagaaaaaacatgttggtatgcagagaagaagtgtctctaattccggcctcacatctcctcattctcctaaagggtgaccagtccgccgtctgtcctgtctccctgtcagcccagcactcatgcttgtttcatgtcttgctaagaactcaggtgatcgctttagcaagcagttgaaggtttctgtttttcatgttcccgcatgattagaagtacattgttgtgcagctgtcaccaattcacattgtagttggctgttcccagatttcttcagagttgtgaccctgtcatttggggaggcttcacatgctaatttccaaaagggttgcacttgatcatatgtagttgccaaagtcagcttaggtttagtttacgtgtatcgtagagcacacaggcatcatgttccatgtggaagtgtgcagtgggagagattgttgttcctgaccttggctatgcagcgtttctgggatttctctgaccaactgacttgtgttcattccttctgtctggatttctcatggtgactgacgttttccttcagtctttccattttcaatttgggcttgttctcagacaaaataattctgaaaggactggtttaaactcactgactctcttcatacaaagattgcaggctgctgtttattgccttagagacactgtgtactctccagggcacaagaaagagtgttgacatttttgcagctggctgttatccaacttcttactgaaacataaaaattaaacatatatagcctaatgaaaatttaagatggaaaatttcatccctgttcatttgtcacagctgctgatgtcagttatrgtctcttgtgtcacgtgtggtagtggaagaaattggctgtgggagcctttctccttgggccggaactgcccatcaccagttacggggagcctaggttctcgggacatctgggccttcagcagcttgtgatcaatgtcttccaaatgtaaactatgatttgaaaatctccagtgttatcttttcatttgtattgtctctttcttggtgccttttctaagttggttaaaaagaacaatgtgattgtagtcagtgtaccacacagtacttcctggatcttatgggttggatctttacggagctagggctggtgaagcctcctgctgtcacatggagcaaatggctgagttacttcactagaacctcagttttctcatctgtaaattgtgcctatggtcatcctcaggagtgtgtatgagcattggcccaggcagcgtcccaggtgcagtgggcctgcaggaagccctaggactctgcaccttgtgggtgctgtttgtacttacctctggtgagctccagactctagcacgttacttgtaatgtgttgaaaagacaccggaatttggtagtcctggacactcttcactcattctaggaagtgagatcacgacgagttcctagggttttgccttctggaggttgctgtgtgcccaggctgaagatggactcagtgcatgtttttgtggaccttggagcatcttattgcactgagcttaaatgtgccagctcttttaatgcaccagagctgcatcttaagtggtctctgtaggctaaagccttgaaatctgtttaaaattaatttcaggccgggtgcagtggctgatgcctgtaatcccagcactttgggaggccgaggcgggcggatcacgaggtcaggggattgagactatcctggctaacacagtgaaaccccatctctactaaaaatacaaaaaatcagccgggcgtggtggcrggtgcttgtagtcccagctactcgggaggctgaggcaggggaatggcgtgaacctggggggtggagcttgcagtgagccgagattgtgccactgtactccagcctgggagacagagcaagacactgcctcaaaaaaataataaaataaaataaaattaatttcagtaaatttttcatttgcctgttgcttagatgtcttgctaaagctgatatttaattacgatcatgagtgaccaggccatgactggccttaaagcaaaaaaaattagtcttctgttacataagtgcctttaaagttttgttcaactgactatttctgaaaatttcagccctaagttgaaaaagcaaacactaaacagctaaggtttaaaaagcaaacactaaacacctaaggttgccatcggtacccctttaattttaatcacaaattgtgttgtcttgggagtagcagagagactagttttataccagcgctcttcaggtcaaatggaaacgttaatcagtctggttaaatttttgtagtttccttaatatttctacttttggaggtttttctgtttgttttttgttttttactcttccaaatggcacaaatgttaatcttccaagcatttttctcatgttgaggttactaagaaatgttagtggtaggaatgatacttaactaatactctttgtaaatgaaagccgtgatctgtccaggaaatatctgtgcttagtggctggtttactcattgtctttcacaattgaatgacctcacagtgaccatctctgcttgtgtcagttgtagtgatgatgaagatgttgcaccattgtcagccaaatttgctgatatttatccattgagtaattatgatgataccgaggtggtggccaacatgaatggaatccacagygaattgaatggtggcggggaaaacatggccctgaaggatgaggtatggacatggcttcttcgtagcaacaataaatgacataaaatgatggtctgacattttaatattttatattactctgttttgaaaagtgcaaattacaaaagattgtctttaaagtctcctcagataagcagtaccagcagtagttcctcagaagctgatgatgaagaagcggacggcgagagtagtggggagcccccaggggccccgaaggaagatggagtgctgggaagcaggagccccaggacagaggagrgcaaagcagacagtccacccccatcctacccaacacagcaggtaggactttgcttgctgttttgccaaggatctctttttctgtgtgtattttctctaaacatgagcattactgaatacaaaattattttgtttcccataatttctgaaggttagaactgaagagagtcaaggcatacttacaatctccatttgaatcttgtttttcttgctcgaatatcaatcttgatttcgcawcaccccatagcagctctgtggaggccttttttgtctgtatagaagcaaagagaggagttaaaaaaaaatagtggaatattaaaatttcaggaaaggtttgtttttcctgttcattatctgttcttctgttagccaaaggtgagggtaccttattagctttttttctcagaatttcataaatagatgcttaaacaagtttttggccgggcgcagtggctcacgcctgtaatcccagcactttgggaggccaaggtgggtggatcagttgaggccaggaatccaagaccaggctggccaacatggcaaaaccccgtctctactaaaaatacaaaaattagctgggcatggtggtgggcacctataatcccagctacttgggaggctgaggcacaagaattgcttgaacctgggaggcagaggttgcagtgagccaagattgcgccactgcacttcagcctgggcgacaaagcaagactctgtttaaaaaataataataacaacaataataataagcagtctttaaatgaaagaacaaatgaaggtcaaagtgcttggctgatttattttattaggtaatataaatgtaacactcagatggtaaaggtgatgttgaaaggtctatctgggaagtctgaccacatctccttaccagttttttcttctacgtataatgtttttgatgtcttatccaagaaaactttgcctaacacaaaactgttttcttttagaagatttataattttagttcttagattctgtttgactcagcatttagttattgtgaggtgaggatataaattcaccttttctgcatatatagatatccaattgtttcagtacggtttgtcagaagtaccctattgaattgccttggccatttattgaaaatttattgaaaatcaatggactgtaaatgtaagagtttatatttggacattccattctgttcatttgatctctgtgtctgtccttacacccatagtgcatttgacaattgctttatggtaagtttaggaaaatgggatagggtcttccctccagcttggtacacctttctctctctcttttttctttctttttttttttttttttttttttttttgagatggagtctccctctgtcacccaggctggagtgcagtggcgcgatctcgcctcactgcaacctctgcctttcgggttcaagcaattctgcctcagcctcccaagtatctgggactacaggtgcacgccaccacgcccggctaattttttgtatttttagtagagacggggtttcactatattggccaggctggtctcgaactcctgaccttgtgatccgcccgtgttggcctcccaaagtcctgggattacaagcgtgagccactgcacccggctggtacacccttttcaaaatcgtttatgctgctcaaagttctttgcattcccatataaattttaggatctacttgtcaactacaaaacgcctccttggatcttgagggattgcatcgaattcttgaatatatatttagaattctccagtgaaatcctctggatgtggttgtggtcttttatttgtgggatgatatagatcaatttagggagaatgcaatcctaacaaaattgagtcttctaatctgtgaatatgctttatctttccatttatttaagtcatctttaatttttctcagtagttctaaaaaaattccagtctttgtgtctggaatatataagtattatgtgttttcattcacagtaaaaggtattttctaattttgatttccaattgatcattggtaatacatagaaatacaattgatttttttatattggtcttgtgttctgcagctttactaaacttgtttattctagtagggttggttctagtaggtccttttgctgttgttttggtagattactttggattttctatatacaagatcatgttgtctgcaaataaagttttagttcttcctttccaatctggatgcaatgcttttaatcttcccttccctttcccttctcttttctttttctttccttcctttcttctttttaagaaacagaatctcactctgtcacccaggctggagtgcactgctgcagtcatggctcactgcagcctcaaacagctgggctcaagcagtcttgctgcctcagcctcccaggtagctaggactacaggtgtattacaactacaggcatgcgccaccacgcccagctttaaaaaaaaactttctgtagagagagggtctcactatgttgcccaggctggtcttgaacttctggcctcaagccatcctcccatttcagcctcccaaagttttaggagtataggtgtgaggcaccatacccagtctggatgcttttaatttcartttctttttctttttttttgagacggagtctcgctctgttgcccaggctggtgtgcagtggtgctatctcggctcacggcaagctctgcctcccaggttcatgccattctcctgactcagcctcccgagtgcttttaattccttactcttgccttattgagctagctggaaactcagtacagaatagaattgttgcaagcagatatctttgccttgttcccaatcttagggggaaagcatttaatctttgaccactctttaaatgtgatatcaagtataggtttttcatagatgccctttattgggttaaggaaattctattctactcctaatttcttgagttttttcatgatttgaatattgaattgtattgaatattgaattgttcagtttttcaaatgtcttttctgcatgtgttgcgatcttgtggttttcgttttttattttgttaccgtggtgtgtcacatcagttgatttaaggatattaaatcaacctgtgttcctgggataamtcccacttggcggtggtatataatccttttcatgtgttcctgagttggtttgctaatattttgttaggatttttgcatctgtgttaatactaataaaatatattggtctgtagtttcctatctttgtgatgtmtttgtctgactttggtatcagagtaatactggcttcataggatgagttaggaaatgtttttttcacttatgttttctgaaggagtttgtttaagattgagatttattaaatatttgatagaattcaccagcaaaatcctgtaggcctggtctctttttgtgggaagatctgtaattactaattcaagtttcatttgcttgtaataggtcttttcaaatttcctatttcttactgagtgaatttcaataatttttgtctttgtaggaatttactcatttaaattgtctaatgtgttggcataaagttattctatactgttataatcctttttaattctgcagtgcctgcagtgatgctaattcttgatttgggtaattttatcttccttttaacggcttcagtcacttgggctaaagatttgtcaatttctctgttttcgtttctgtgtcattggtttccattctgaaattgattatttctttctatgttctttgggttttgcttgctcttccttttctagtttgttgaaacaaaagcttagatgactgattttagagcttccaaatttattgagacttgttgatggcctaacatatagtttacctagatcctgttctatgtgtacttgaaaataatttgaactttgttcttgttgtgtggagtgttcaagaaatgaaagtttgatcaaattggttgatggcattcttcaagtcttctgtattgtcttggtctatccaggctaccatgtaaggacagtaaccccattcctgagagtagagccttccaaagtccttatcgcctaataccatcactttggaggttaggctatcaacatatgaattttggaggggcacagatactcagatcatagtatatattcttactgattatctgtctggtggttttatcggttactgagagaggcatattgaagccttcaagtttaactgttggattatttccttctcctttcaattcttccttgttttggttcatgcatttgggggtgatgttattgaattattgttatagctcccctgatatattgccccttttatcattatgaaatgtttgactactggtgtttcttaacgtccgttttatttgttagtatagccactccaccttcttgggttactgtgtacatgtattttttcatccttttactttcagtttctttgtgtctttgaatctaaaatttgtctaacatcttttagttgggccttgcatttttatcctgtatatgtcagtatctgcctttttaaatattaaacaaaaattttagtgtactattttaattcttctgttgattctttttttaattttcttagtggctgctgtagggttacagtatgcatctcttgtgaatgtcgttataaaaaataaaaagaaacaaaaattaaaatacaatatgtatctctttttttcttagagacagggtcttgctctgttacacaagctggagtggggtggcatcatcatgcctcactgcaacctcaagctcctgggctcaagcagtcttcctgcctcagcctccttagtaagctgggactataggcatgtgccgccatgaccggctaagttttttaattttagtagagacaaggtctccctgtgttgcccaagtttgtctcaaactcctggccttcagtgattctcccgccaggaaatcccaaagtgctaagattacacttaaccagtgtacccagccacaatatgcatcttttttttttttttttttgatacagagtctcgctctgtcacccaggctggagtgcagtggcgcaatcttggctcactgcaacctctgcttcccaggttcaagtgattctcctgcctcagcctcccaagtagctgggattacagatgcgcaccaccacgcccatctaatttttgtatttttagtagagacaatgttttgccactttggccaggctggtctcgaactggcctcaagtgatccacctacctcagcctcccaaagtgctgagattacaggtgtgagccaccacgcccgcccacaatatgcatcttaatttatcacaatctactccagattactactgacttaattccagtaaaatatacaaactttgctccgcaggagctccatttccttctttctcctttgtactattattgtcctatatataattacatttgtatatgttacaaaccaataatatgttttaattactgctttatacagctttataatttctagagcaaataaaagagaaaaatgtatttatacagtgcctgcctgcctgccttcttttctttcttttccttttcctctctctctctttctctctctctctctttctcttttccttttccttttcttttcctttttcttttcctttttttgagacagagtcacactctgttgtccaggctagagtgcagtggcacaattttggctcacttcaacctccacctcccaggttcaagcagttctcctgcctcagccacctgagtagctgggatcacaggcaagcaccatggcacccggctaatttttgtatttttggtggagatgacatttcgccatgttggccaggctggtctcaaactcctgacttcaggtgacctacccgccttggcctcccaaagtgctgggattacaggcatgagctaccacgcctggcctgtatttatacagtgttttctatttgctagctggctagtcatttctggcattcttcattttaaattctgccgaatttaagttaccgtcttgtttttaccttcctttaatatgtcttacaggaccagtttgctagcagttaattctctttttgtgtaaatgtctttattttgccttcattttaaaaaatagaccaggcatgggggtgtctcacgcccagcactttgggaggcagaggcgggcagatcacctgaggtcaggagttcgagaccagcctagccaacgtggtgaaaccccatctcttctaaaaatacaaaaattagccaggcgtgctatcatgtgcttgtcatcccagctacttgggaggctgaggcatgagaattgcttgaacccgggaggcagaggttgcagtgagacaagatcgcgccattgcgctccagcctaggcgagaagtgagactccgtctcaacaataaataaataaataataaatagagtggttgtttttaggaatagctttagactcacagcaaagttgagtgagagctacagagacaccctatacccagggtccccacacacagccttcccactatcaaattccacaccagagtgttactcttgttacagtcatcagctgtcagactgttagaacaagcagtcagttctcctggcagcctggctttctcaagaaggtgttttagtagggtctggggtcatcctagggacttggcctttggctgcaggaagccttaggtggtcattgtgtgccagagttctgcagctctcagtatctctttgtttttatccatcttaaggttcactgagcttcttggatctgtagaccagtgtttctcatcacatttgggaagtggagtgtccaggtgttatttggatgctcttccccctttcctctgggacttggttctgcacatgctggagtgctggctgctctcccacaggcctctgagcgtctgcatactttcccctcatctcttctctctcttcctagatcagttccattgctcttcttcaagttcacagatgatttttctgccattttaagtttgcttttgagcccctttagtgaaattttggtttagctattgtactcttcacctatagaatttatattttactgtttttttgtttctctttttttgtagtaattccctatatgttgaatctttattttcatattttcctttaattctctgaacatgttataacagctgctttgacatctttgtgtgctaatttagtatctgaactcactcctgttaaccgtttgactatttatttcctgcatgtgggtcacacttttttttttccagacaaggtcttgctctgccacccaggctgaagtgcagtggcatgattacagctcactggagcctcgagcctggacctcctgggctcaaacaatcctcccacctcagccccccaagtacttgggactacaggcacacaccaccatgcctggatagtttttgtactttttgtagagacagggttttgccatgttgcccagactaggcttgaactcttgggctcaagtgatcttcccacctctgcctcccaaagtgttgggattacaggtgtgagccactgcgcccagcctaggtcatacttctctttaatctttgcttgtctcataattttttgttgaaaattggacattttaaataatgtgataattttgcattatcattttttcccttgagggtcctttgttgtcttttgtttgtttccttgtttttgttatttcctgggcttcagttgcaggacctgtatctcccacattatgtggctgtgggtgtctcagcttacttcttctcttctcctttttagtttggcttctagaggtctgccctttgtccacctggctgattggccagctgatgatttgggcagaggttgcccatgcaccttgaatccacaggggctccattgttggctgtggggtgaatgcgctcagcactcagccagttctcaagtcagctgtgttggccccttcctccagcccgtgaggtgtcctcagtgcatgcactgtgctctcctggtcagccagcgagttgtggacagcttaagaagcccttccgtggcgctctcatttccagggttctctctgttagatttctgtctcctttgccactcaccccagttgggacctcagtctcaagggaacagagctgcaggcttccctattcattcccttctaagttcactgcttttactgcttcaccctctgcctgaccaggctgctgtttttggtagcagggttggtttgcgctgacatccctgcagtcacagaactcctgtgcccactgccgaccgagtcaggggtggagtacaggtgcaggaaatggaaagagtcccagacaagaaagccagacttgctgttcttccttgaagttctagctgatttgcatgaataaatgtgtcgcggtattttccttgggctgatttccagagcctcagaatggttgcctttgacaattgtgttcagttttacatttgccctgagggaaaggagccactgacctcttcactccaccgtaaccggaagtcgcgtctctgctttgttttggagaatccatgtgtgactacttagaagcagtgtgagcccagtggagcacagccatcccctctctactctgtcgtcttcactagttcccttgtccctgctcacatgtgggaagagagattttctgcataggcataggattcagaaccagtggctctacctgagtctgtctgtggaatgaggtacacctttcttctctgtgcgtcttcttcagtctcagtctcttggggtccctcgttttccttgcatggaaggccctggtcaactcagggtgtcaggaaaagcccacttacctttgtatttgctttgtaactacttggcagaatgtgactgactttaattcataccatttattgtttcactaaataggtatgttttttttctttcctcttaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggtaagtcagggcaaaaagggtctgaaagctcactcttcactgagatcctacaggagtacatagtcaaacaaagaaatctgtgaattagcaacttgcataggatagcatctgctctggataggaaggtctccaagtgtttcctttcaccataatctcttaagcactgtaattktgaacctttacagttgtaacaatcattaaaaacaactgtgaaggtcatagttcttttattcagaattaaatagaacagaaggatttttcaggtgctatttctaacaggttaaacctagggaatatttccacaggagaccagtaatctacttgtgatcttccagggcttgctcttcttcttaatttgataggtaaaataatgtgaatacaacatgagtcctctaacactggctggactctacagggtctaaaatgtctatgctgctttagcatttagaaatacacgagcctaaataaaggaagagccctaagtgtgatgccacagaaaactataacgccctgcaggtgatggagcactggggaggggagggtacagaaaggagaagctgccagaaacccagtgtgaagagcccattcaggaagtggagtgaggatgtagaaataagttgatttttatgcatttcttcccagagaacctcatgtgtatacttagtatcttagactttacagtgaaattcttaggctggtttctttctttggaccttagatagctttgcctctctagttattttgagcttaactttaccagaatgactcaccgtaattctgattgttttcttttttttctttgtaccagttattcttgtccaaaggtagctctaatcagtcaaaaatataatttatttcaaaccctaatttattatttaaaacattgcttttgagctggaacagaaagggaggaggacatgacatggaatgattttttccagaccacagtttttccaaacacatgtgtgttttctcccctctaggggtcactgtgaagtggggtacatgtagcccataagtgaggtttgttgtctctttgctagggagaggcgtaggtggaagattaacagacacaggtttagaatagagtgtaataagtttgccacatctattgtaattacttggcacaaccatccaaattcatgcttaaattttgttagattgaatattgctcagtttgaacttttaatgatgtcttaataatagaatgctttttaataacatttttcaggtatgtagtcagaaccaggctatcttcatggtccgcctggtttgtagcctgattttctctgggtgtaaagtgaggaaggtttccactccctgctgtagcctgaagagagctctattacctagttccaagaaaagataatattctgttagatgtttttgctgctggaagctattcaagaattagttccgaaaaataagtaagatagtaaaattgattattactaaagactgtggggcccctttggttaaaaattgattattttcccgggcttttggccttttcttaggaaattagagatctatatatgggtaaaagaagaaaaacatgttttaggagcatcatttgtatctaatatctgttctcttgatacctgttaaactttaatcatatagaaagatttgaatagaaaagcaaatatggagtcaagccatatacggtagaggtatagaaacttagaaatttataactaaacgttatttctaccacttcagcaaactgaagactattcactgattcatttaaaatatgtggtggccattattatgtggaaacataagatacaattatcaaaatacttcatttgcatctggtatgaaaatgttcgtttctgtaaacaaacttgaattgtcacttaccaggtcttacaagattagtttgtgttatttgacttagtttggcttagttggatgctgttgaccacatctgtgcctaaatgcataatgcgttagcagccctgaaggggtctcctggtccaccagtgagttgtggacagcttaagaagcaaatgagctatatcagaattgcacaaatttcagtgacattggaggaagtttcttagagataatcaacagcaggattgttgggcaagaagttctgaatgtagggagcagaaggtgggtgctgaacgtggagggggccttgtgtactgtgtctgccatcacttttgcattgttggggccttggggagtttctgctgtgctggggtcacagtttttgccttttggcacattatgtcattgtagttgtaattcttataattcatattttaggctttgtgggtaaatatttagtacctaaaaagtttagcatgggtactatgaaaaatttattttctggctggttgtggtagctcacgcctgtaatcccagtgctttgggaggctgacgtgagaggattgattgagcctgggagctcaagaccagagcaacatagtaaaaccctgtctctaccaaaaaaaaaaaaaaaaaaattcttgaaattaaaaagacttgaagactaatttctgttttcaagtgtctccataccagtgacataccgaatttatatatggagtataagttatttgaaagttcaaagtattgctgagaaaaatacagtaatgaaatactacataaaataaaaactgtaagtgccagagaatttaatttccaaatatttggggatctcccaactatctttttgttactgatttctactttaattccattgtgatctaaaagcatgcagtgtataatctctggttttttgagtttattaaggtatgttttatggcccagaatttggtctgtcttggtgaatgttccgtgtgagcttcagaggaatatgtgttctgccgttgttcagtgaagtggtcttcagatgctcattatgtccaattgattgatggtgctcttgagttctgtcagtcagcaactatgttttgactgattctctgcctgctggatctgttcatttctgattgcgtgcccttgaagacttccattgattcatcggtttctccttgcacagttctatcagcttttgccctacaaagtttgatactctgttattagcggcacacacattgagaattgttacgtcgtcttggagaattgaccctttttcattatgtaatgctccttactaccactggtaacttcccttgctctaaagtctgctctgcctgaaattaatatagctcctctagctttcttttggttagtgctagcatggtatatcttccttcattgcttactttttgaaaagatttattatagtaaaatatgcactaacataaaatttacaatcttaaccatttttaagtgtagaattcagtggtattaaatacgttgataatgttgtgcagccatcatccgtctccataactcttttcatcttgtaaagctggaggtttttacctgttaaacaataactccacttctcccagccctgggcatccattattctactttgtctctgtgattgtgactactctaagtacctcatgtacatggaattgtacagtatttctctttttgtgactggcttatttcacttagcataatgtcctcagcgtttattcatgttgtcgcatattgcagaatctccttcctttttaaggctaaataatactcatcatatggctgtaccctattttgtgtctccatcagtgaacacgtgttgtttccatacattagctactatgaacagtgctgctgtaaacatgagtgtacaaatatttcaggaccctgctttcagttgtttggggtgtgtacccggaagtggaattgctagatcatatggtaattgtatttttaatttttggaggaactgccaccgtttcctacagtggctgcaccattttacattcccaccaacagtgcacaagggtttcagtttctccacatcctcattracacttgttattttctgttttgcttttttaatagtaaccatcctcaaggatgtaaggtggtatcccattgtagggctttttgtcttgtgtaaatgaccacagatacattgtagttttgatttgcatttccttagtgtttagtgatgttgggcatcttttcattgttcattgactattcgtatatcttctttggagaaacatctmttcaagtcctttgctcgtttttgaatcaggtttgttgttgttgcattttagttctctttctattctggatattagtcctttatcagatatatgatttgcaagtattttctcccattctgtgggttgcctttttactctgtcgatagtgtctgttgacgcacaacatttaaaaatttttcagccaggcacggtggctcacgcctgtaattccagcactttggaaggccgaggcaggcggatcacgaggtcaggaggtcgagaccatcctggctaacacagtgaaaccccgtctctactaaaaataaaaaaattagccgggtgtggtggcgggcacctgtagtctcagctactcgggaggctgaggcaggaaaatggcgtgaacccggaaggtggagcttgcagtgagccgagatcacgtcactgcactccagcttgggcgacagagcaagattccgtctcaaaaaaaaaaaaattttcatgcagtccaatttgtctattctttgttgcctgtgcctttggcgttacatccaataaatcwttgccagatccagtgttgtgaagcttttgctctctgttctctcctaagagttttgttctttccttacatttaggttggtaatccattttttagttcatttttatatatggtgttaggtaagggtccaacttcattcttttgcatgtggatattcagttgtaccagtaccatttgttaaaaagactgcccttttcctgttgaaggatcttgccatccttgtcaaaaatcatttgaccatatatctgaagttccagttttgggctttctgttctgttccattggtctgtatgtcatgctgataccacacagttttgattgctatatctttgcagtaagttttgaaatcaggaagtgtgagtccaccaggtttggtgggtttttttgttgttttgttttgttttgttttgtttttgttttttttgtagagattgtttgggttggccgggcacggtggcttacacttgtaatcccagcactttgggaggctgaggcgggcggatcacgaggtcaggagatcgagaccatccttggctaatacagtgaaaccctgtctctactaaaaatacaaaaaattagccgggcgtggtggcacgtgcctgtagtcccagttactcgggaggctgaggcaggagaatcacttgaacccgggaggcggagattgcagtgagccaagatcgcgccattgcactccagcctgggcaacaagagggaaacactgtctcaaaaaaaaaaaaaaaaagattgtttgggttattcaggatcccgtgagattctatatgaatttagggtggatttttctatttcttcaaaatacatcattggcattttgatggggactgcataactgcattgaatctgtagatcactttgggcagtatgtacattctaacagtattgtcttctaatcaacaaatatggtatgtgttttcatttatttatgtttttttaatttcttagagcagtgttttgtagtgtgtgtttgtttgtttgtttgtttgagacagagtctccctctgttacccaggctggaatgcagtggcatgatcccgctcactgcaacctccacctcctggtttcaaacgattctcctgcctcagcctcccgtacaggcacgtgccaccacgctcagctaattttttgtattttaatagagatggggtttcactgtgttagccaggatggtcccaatctcctgaactcatgatctgcctgccttggcctcccaaagtggtgggattacaggcgtgagccaccgcgcctggcctgttttgtagtttttatgatacaactcttccacttctttggttaattcccgttggtgttttgttttggttttggwggttttttttttttttttttttgagacagaatctcactttgtcgcctacgctggagtgcagtggcatgatcttggctcactgcaccctccaccacccaggttcaagcgatactcctgcctcagcctcctgagtagctgggattacaggcatgcgcctccatgcctggctaattgttgtatttttagtagagacggggtttcaccatgttggccaggctggtctcgaactcctgacctcaagtgatccgcccgcctcggcttcccaaagtgctgggattacaggcatgagccactgtgcccagccctaaattattatttttgatgctgtcgtgaatggaattgttttcataatttccttttccaactgaccattgttagtgtatagacatgcagctgatttttgagtgttgattttgtatcttcctacttygctgaattcatctattctaacagactgtttttgtggaatctttggagttctctacattgtaaaatcatatcatctacaaacagagataattttacttcttcctttccagtttagatgccttttatttctttttcttgcctgtttgctccggctgaaatttctaatactgtgttgaagagaagtgatgaaagcaggcatccttgccttgttcctgttatttaaggaaaagctttcattcgttcaccattgtttgctgtgggtttttcatatatggcttttattatgttttggtagttttccttctattcctagtttgttgggtgtttttgtaatgaatgggtgttgaatttgtcacatgctttttctgcaccagttgtgatgatctttggctttttccagtctgttaatgtggcatattaacattgattactttttatacatagaattatccttgcattctgggaatgagtcccacttggtcatggtgtatgaatcttttaatatgctgctgaattcaggttgctagtattttgttgaggatgtttgcatgaatgttcacaagcgatactcgtttgtagttttctttcttttttttttttttttttttttttgagacagagttttgctcattacccaggctgagtgcagtggtgtgatcttggctcactgcaacctctgcctcccgggttcatgtgattctcctgcctcagcctccagagtagctgggattacaggcatgcaccacgaggcccggctaattttgtatttttagtagagacagggtttctacatgttggtcagctggtctcgaactcccgacctcaggtgatccacccgcctcggtctcccaaagtgttgggattacaggtgtgagccaccgcgcccgaccctgtagtttttcttacagtgtctttggctttggtatggggatatgctcaggacatgagttagaaagtgttccctcctcttcagttttttggaaactttgagaaagattggtattaattctttaaatatttggtagaattgactagtgaagccatcaggtttggggcttttctttattgggtgatttttttttttttctttgagacggagtcttgctctgtcacccaggctggaatgcagtggcacaatctccactcactgcaacctccgcctctcagattctaagcgattccctggcctcagcctccaaagtaactggaactacaggcacatgccaccacacccagctaatttttgtatttttagtagagacggggttttgccatgttggccaggctggtctcaaactcctgacctcaggttatccacccatcttggcctcccagagtgctgggattacaggcgtgagccactgcgcccagcctattgggtggtttttgattaccagttcaatctccttactagttacaggtctgttcagacttttctatttctttatgatttcgtcttgataggttttgtgtttctaaaaattttttcatttcatctgttttatccagtgtgttggtgtacagttgttcgtaatactttcttttttctttgaaacggcatctcactctgtcacccaggcaggagtacaatgacatgatcatagctcattgcagcctcaaactcctgggctcaagcattcctcctcccttggccccccaatagctgggattacaggcatgtgccaccactcccagctaattttttttttattgttttggactcttccagagagaagacagggtctcactatgttacccagtctggactgaaactcctgggctaaagcagtcctactacctcagcctcccaaagtgctgggattataggcatgagttaccaagcccagccaatacttacttacttttttttttgagacggagtcttgctttgtcacctaggctgaagtgcaatggcaccatcttggctcactgcaacctctgcctcccaggttcaagagattctcctgcctcagcctcccatatagttgggattacaggcgcccaccaccatgcccggctaatttttgtatttttggtagagatggggtttcaccatgttggtcaggctggtctcgaacccctgacctcaggtgatccacccacctggacctcccaaagtgctgggattacaggcgtgagctacagcgcygagcccagccagtactttcttataataccttttatgtttttttcttaattttaatttaattttctgctttttagagataygcttgctctgttgcccaggctggagtgcagtagcacgatcatagctcactggagcctcgaacgcttgagctcaaatgattctcctgtgttagcctcccaagtagctatgattacaggtgtgcgccaccactcccagccccttttatttctgtgtaatcaataataatgtccccactttcatttctgattatagtaatttgagtcttttttttttcttactccatctcactaaagttttgtcagttttgtttctcttttcaaagaactatattttggtttcattgattttttttttcccctattgtttttctrttctctatttcattgatcattaatctctgctctaaattacctttcttctgctagctttgggtttagattgttctttttctaattcattaagatgtgaagttagggagggttttttgtttcattttatttgttgttgttattgagacaaagcttactcagttgcccagcctggagtgtrgtggtgcgatcttgggtcactgcaacctcgacctcctgggctcaagcaatcctcctgacccatagtctcgtagcttggactacaggtgtgtgccaccatgcccagctatctatctgtctgtctatgtatttatttacgtagggacggaggtctcaccatgttgcccaggttggtctcaaactcctgggctcaagcagtcctcctgcctcagcctcccaaggtgctggaattacaggcatgagccaccacgcctatcctagttaggttgctgatagagatctttcttgttttttgatgtgtttgtagctatacattttgctcttagtgcttgctttcactgcgtcccgtaagtttcagtatgttatgtttttgttttcatttgtctctaagtattttctgcttttctttgtaatttctttattgatccattggttgtttccatccctttacttttaacttctcagggtttttttttttttggtttttttttttttttgagacagagtcttcctcggtcgcccaggctggagtgcagtgatgcgatctcggctcactgcaagctccacctcctgagttcacaccattctcctgcctcagcctcccaagtagctgggactacaggtgcccaccaccatgcccggctaattttttgtatatttagtaaagacagggtttcaccatgttagccaggatggtctcgatctcctgaccttgtgatccgcccacctcagcctcgcaaagtgctgggattacaggcgcgagccaccttctcagggtttcatatgtaaagcaggtttcttgtagacatgtatagttgtgtttgtttgtttttttatttttagagatggactcttgctatgttacccaagctgaacttgaactcctagcctcaagcagtcctcccaccttggcctcctgagtagctgggactataggcacatgccaccatgcttgttgttttttgatgtactctgataatctttgtcttttcattggtgtatttgactattcacatttaaagtgattttttgatgtatttagattaatatcagccatgtttgtaattgtttcctattcattatgagtctttttctgccttctctacttttaattaagcgttttatggttttatctcctctgttagtatatcaattttatttatcttttttaaaatttctgcagttgccctggagtttacaatatacattttgaactaatctgagtcctttttcaactaactaatgtaaaaaaggtaacatttaacagattactcccgacccttccctattccctgtgacattgctgtcattattttcacttatccacatgtttatcacccagtacagtgwtgatgattactttcaacagttatcttttagatgaataataataagaagaagatattttactttgtctttattccttctctagtattcttcctttctttatgtagatccacgtttctgaccttctatctgaaggaaatcttttgacatttcttgcagggcaggtctgctggtgatgagctccctcagtttttgtttgtctgaggaagtctttatttctccttcacttttgaaggataatttggctggacacataattctaggttggtggtttttttctttgaacactttagaactgtttaacttccctctgtccttgctggcatggtttctgatttctgacaagatgtcctctggaattcttttcgaattcttttccctgttcttctgtaggtccacttgcccccacccagctgctttcaagattttctcttttttttttttttgttttttgttttttgagacagagtcttgctcagccgcccaggctggagtgcagtggcgcyatctcggctctctgtaaccactgtctcccaggttcaagtgatgctcctgtctcagcctcccaggtagctgggattacaggctcccgccatcatgcccggctaatttttgtattttaatagagatgaggtttcaccatgttggccaggctggtcttgaacccctgacctcaggtgatcgcctgccttggcctcccatagtgctgagattacaggcatgagccatggcacctggccaagattttctctttttctttggtattctgcaggttgaatagaatatgtcttcatgtagctttgggggtatttattccacttgatgttctctgaattctttggatctgtgctgtcagttgttaatttggagactttttagctattactacttcaactgtttctctagtctctccttccagcattccacttaccaggtgttatatctttcgaaactgtcccacaggttttggatgttttgttctattggggatattgtttctgtttttgtttttaattcttgtttctctttgccttgcagtatgggaagtttctgctgacatatcttgcagctccctgactctttccttggccgtgtcgtctcctgatgagtccatcactgatagtcttcgtttctcttagattgtttttattgccagcatttcttcccatctctctgctcacacggcccccttgttcttgcatgctgtctactttttccattagagcctttggcctaccaatcattttcaatttcctgtatgataattgccatccatgttatctccatgttcctgcaaccattcagttgtctctctcagcctctggtgagattgttgttagaccttcttctgttctgcattcctaacactctcttgcatgtttctcatctccttttctcccagttccatgttctgagaacttttttgggatcagtcctccagttaagtgattctgtagtggtgcctagcctgccacttaagtcctgattctgactatatttattatttataagttttaatttactttttttttccaaagatacttagtagctctttatattctcttgttccttgttttttttttctttctttaagcatttcacacatagttaytctgtgtttgaatgaaaccttgagcatccagattcgttttctgctgatatcacctgtgatgtattatttccttttgcggatggagtatattaggaggttatgttttgctcagcttactctgtgagaaccacagccctccatagyggatgcttccctgtgagggttggcgtctgctgatgcgagagctgcctgagacctgggctcctcttgagggcctccagactgctgcccccacacgtcactgtggcgatggtgtacggctgttccttcccctcacctccacctcgcttctctcatgacctcctgatacttcttttcatcctttgcctttgtcgatagcagttggttaccaaagtgttcagtgtcatttctctcagatctagagctaagtagcccctcttacctagcaaggcccagaccaggggggaagaacggccttcaagagaagagcaaagccgagcaggtgcggctgcattttgctgctccttccacgtggcctaggagtaggaagttaacgactacagggcctgaatctataccggaacccaaggcatgtgactttgaatcctgggtctttttcatccaacacggaggatgtactgtgaaacagttggtgtactaagaaacggcctagaagtgaagacagggatgtctctaagtctccactgagaactttgcagtggagcatttgcagtggccactgggttctggccctcaggagttcagtgtatcaagtggagcctggtgacgtggtgtaaggggaggaccgggtgccaagtagccttggtcccttgttagcttcgagggccagggtgtatctttacactccctctctgggttactttgagacttaagtaaaaccactggaaacgcatttaatacagttaaaatatgattcarttaaatatagtttaaagtataagtgcagatttagattgggcaggtaaagctatgtggataatagggtcataaataggttgcaatatggggatcacattgtgatcttcgacctgcatgttcttttagagctgagattcagctcttccagcctgaaaactggcacagccaaagcaaagatggtccttcgcctctttaccaatctctgggagaaataccaaaaaacctgttaagcagaaatacagagagtctgtcatcttaaccttttcgttactggggatacaactggaactcatttttgctcggatgcttagtgttgggaacctctcacgtgtgggcctcatgactcagtctgcggctcttgctcctcatgtcttgcacccatgttccatgtccgagtgggtgtgggtggtagaggacaggcgagtcaccyagctcctggataaactcagtgtgtgcgcagtggaaagcagtttgttgtgtttgcatatttgtgtcagagctttcatttaaagcaacagttttccttttctatggattacttcttttgtctcaaagtggataaaaatgcaaaacttctgctagttgaagctttgtgggtttgtataacgagtgaaattggtgttctgattcaatagcgtagtccacgttctgagagagttactttacagttatatcattggtggacttataaagtcatggtccaaaaatggtctaggtgacagacacctattttttcctgaaagaaatccataagctattgaggtcagtaggcatcttctgcaaaagcattaaagaaaatacaactttttttgttactgatccctgttacttttgtccctacaactgggcttccgtttttgagtgtgtggggttctgaatagtgtgtaaatcaaatgcgtagaatcattgccgtatgtttccaatattacagttatatagatgcattcccttattcctctaagctagacactgttcagcaaacacttattgaacacccaatatgtgccaggccctgtgctagactctaggaagacaaaaatcggttagtcttggcccctcttttcaaagagttcacagtctaaagagaagacaaaaacataatcaaaatatcaaaatgttgtgacttacagatgctaggcagaaaagtaacaccgaagagagaaaattttaaatgagcccacgggtggttttgcagaggaggtgatgctgatgaaatagggttttgaagcataagcaagagctctctgaacacacatgggtggtggagcccaggctctcagccaggcttttcaaacctgaaaccaaacaactcatgrtcgtgtcttgaggagtccaggaggcacttaacgtagcttcagagccctgagagtgcttctagtcatggtttaccagctgggcsggcacaatgggactgctgctcaaagctagcagtttggcatctgtcacgggcttctgccttttacaagaaggtcctcaagaccaagaagtcttctacttgttactttttgtcaattacttctcagcaaagcagctcttagcttatcgctgctttgtagaaatgggtatctattgaaatacgtttttttattttcctggctcttgtcccatggggctcccttaccaaaacratgacttcaggccctttactgtatcctgggtggcccgtctggacctgtttattcctgctgttgagtcctgagtgtctgctctaccctcctctccccctttgccttcctgggcctgttccaggtcagtggactcgctgagctgtccagcagcccagaggggagtgcttcctctctgctccgaagcactgtggaagaagggcaaggtggaaaggtttggtcggttggtcaggtgttttgtgtccagggactctatgtctatataagtagtctctatatagtagtctctaagactattgtcctagaaaatcaaagcagtgcaccatcacactcactgaatacttactatgggccaggcagtgtgctcaactcttaccatacccctggaggtaggtatttccagattacagatgagaaaactaaagcacaaaaagattgagtgatttgcctgaggtcacacagctagcaaaagggagagctggcatccgagctcgccagactccagagcccaaaggccaagacgtgggactagagttcagatctagctgtcacctgaccgtgcctcctcatagtggagccagcagtggtagctcctggactagatgtgcagtcccagctttcatcttgatagctccagaattcctcctttccttgccacsttcactgccattgcttcatcctttctcatcccctgactaacctactcgtcctccttccgccttctggttcatcmacagcattgccacaaattgatctttccacaaagctgaccaaatcatctcactctgctgtttaaatccctctgtgactccccagccccttcagaacaaagtggtacaaagttgtctttggcctggctgctgcccacactcaacctggagcctgtcagggtgtagcactgtcatccctgtacgtgcgccatccctttgctcctaacctcttcctgtcctccctctgccccagccaggccagcaggattctgccgaaccatcgcccattcttaagaaccctccagggaaccctcccrcttgagtttaaagaattcactactcatttctgcatcccagaggatgtgatgaccaggttgcccataactgggcacttctcctctccagcagacagaagtcctgctgagggagaaccgtatgtctgcccagcattagcaaggactgggggagaagggccaggacccagatgtcccacctcatcctagagcgcatataatttggggaaaggcagacatcaaaccaacaggctacaagtaggtctcgaattataactgtggtaagtgctaagagggaaaatgacggattttagtgtgttcagtgggaaggctcgccttggtcttgggtgttggttcctgggaggtgacagcaaaggcaacgccggcttctctgaggaagcgatctttaggccgaggcctgcaggatgagtgcgagtgtggtarcgagctgaggcttgcacattctagagcatggacacagcacaagcagaacttagggccaagaaggtgaataggcgtgtgccggccaaggggaggcctgtgtgtccagggctttggtgagcaggaagggtggaggtggtgggcccagctcccttggaactttgcaggccagagccttgggaagccattgctgcatcctgagcaggggagtgacatgctcgaatttacattcaacaaagatcactctggctgtagtggggagaaggactgggaagagttcgtggtgcaaatgtgcaggctgttgcactgcgccactgtgagaacatggtgctcaggatctcctaaggaggtcagcagccagggcctgttgcctggatagtggctgaggcagagggaggacccaagggggccccagcctgtgcaggagcagccagatggctagtggctcaataaatgcatggatgttggctagccagctggccagaccctgctcaccttcccttggtgccttcaacaatggtctgccccacagggcccagggcggggcttgccaatgaggcagctcctttgagaacgccctggtctttagagcacagtatacaaatttctctaggtcattagatttgtgctgtaccttgcctgggtataagaggtcagtgtaagggttttatccattttcatcagtgattccaaagttgacttattagtgatgatcattaaaatgcttgctgagattaagccgtagaaacagatcttacgacgcacatggcacactcacatgtgacccagtaggaatgtgagaagttactgagttgtctaaagtttgttcagatatactcctcaaggcatcggttgcttttcatatctacatctggttgaaatttgacctgtcgtgtacagtctcataaatcaagtccatgttttgtgagatgtgctccccctgggctgagctcagctcatggcgagcacatcccatgaggctcataatgaattgtctgtctgtagtttaactacttacctaggtaaacagaatattaattttgatatgtgattagaaaatttttttttgtaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctggtaaggaatttgttaaaactttcttgaagttttaaaataacctgagtagactgacatctttgccgtagtctcccgtggaagccctggcgcagctgtagccagctgctgctccaccacctctgtctccagtgggaggcccctcggggctgtcatcctactccatcctctcgcatctgccaccagtcggtcccactgtgtgacagagcggagcaagactctggctccatggctgcccgtcagcccggtgagccacatgggcgtggcctcagcgctgctgagggtctcgtgaccacggtcgggtgcccggccttcaattctcgagcagtggtgacagccagacctcagcccccccggtgcacaggggcaggaagaaagtgccacagttgacttaaatctgtgactcacactccttcctctggttactgcattggcgccacgtggcatctctcccctttactagctccttactccccagctgcctcagccactgaggcccagccgttacttcagtcacagggtcaggggcacctgaaaaggggctggtacctactcctcatctctgtcttcctgcggccagagctcctggcagccccacacccagcccctgcatgtgccagaacagcaggctagacttgacatcctgatctgtgcttaggaaggatttctagctgtgtgaccttgggcaagttgcttggcctctctgagcctcagtttcttcatcttcttaggatgggagtaatagtaccaacctcagaaagtaattttaagactttacgtaactttggaaagcacctagcacaggaattggcacatagtaggtgctcaatacaattttttcttagattaaaagctagttgacttagtgtcatcccagtgggatcctgacttcagtagcacccccagtatcaagtgttcagtcatcagcatgtcttttagggtttagctaagtatgattgctgtcagaagccttaattttcctgttcttctttgaagggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtaaggyttgaaggctcactggccctyggggwctgcaggaaggctgggcttactgacttctcgtctttgtaactcatctttgtaactgccttttacttggcctagccagaggcgtaagtgtaattaactgcccaaaaatgctcacacacagagagctgatcccctaggactttgattagaattttagctgttgtgctagattcctctggggcttcgctgcactgtcttgcttttgtctctgtttctgttcttctgtgatttgagttagggtctcactcttgttcgcccaggctggagtgcagcagtgcagtctcagctcattacagcctctgcctcttgggttcaagcgattctccyacctcagcctcccaagtagctgggactataggtgcccaccaccacgcacggctaatttctgtattttttggtagagacggggtttcaccattttggccaggctaggaggtcattgctttctgagcatgtggcaagatttctcagaagctgctttaggaaaatgctgagcagatgtgagctgacagggctgcctgtcacccagcctagggtacagcccctggctgtcacttagggggcccaaaagcaataatgtgatcagagaccaatggcaactcagtagctggctcgaggaggcctcactagccaaagctgggacagattgagcattaaaaggaatgaggaggctgagtgtggtagctcccagcactttgggaggctgagaggggagggttgcttaagcctgggagtttgagactagcctgggcaacatagtgagaccccgtctctaaaaaaaaaaaaaaagttaaaaaaacaggaagtttgactatagcatacaaataaagtcaagaatccataaggattgggatgctcaaacagagcagtagggtgggaagctccttcttctaaaagcacacctcctctaaatgtgtaagaaggataagagtggcaagtcagcatgctgcgcccccagggtaacagctggtgcaagtatgcagcattcatggaggttaacaagggatatcagtttggggaatggagtatttctactgttcaaaagcagcacccatagggtactgacagattacagcaggatgatgggcgcttgtgttaatcaattctcacactgctatgaagaaatacccaagactggatgatttataaaggaaagagttttaattgastcacagttccacatggctagggaggcttcaggaaatttacaatcatggtggaaagcacctcttcacgggggagagaacgagtrcacggcgaagggggaagccccttataaaaccatcagctctcgtgagaactcactcactatcactagaacagcatgggggaaaccatccccacgcttcagttgtttccactgggtcccttccaccacatggggggattatgggaacaaaattcaagatgagatttgtgtggggacacaaccaaaccctatcactgggtaccgacagattacaaaggaatggtgggtgccagactctggaggaacctagcagacagtgccatgcacaccaccatgaaacagagagacactgggtgcatcccattgccacaaactcagaaggatccaacgtaatatttgcaggatttgtgcccagaacattttatccaaatctaccaagacaagacaaatccaaattggcagacaggtrgcctattaaaaatgttaagtcttgtgaaaagagaaaagggttggaagaggctgggttagtgggaaagctataatggacatgtgaaggaaattggaaaatggaatatgggttataccttagatgagagtatcctgtcagtgttaaatgccagtgaggtgatcatggtattcagcaaaatgtcaaaaaaagagagagggagggagggagggaaagaaagaaaagaaaagagaggagagagaagggaggaaatttttaagtaaaaagctcggtacagtggctcacacctgtagtcccagcactttaggtggccctggtgagaggattgcttgagcccaggggttcaggaccagcctggacaacatagtgagacactgtctcttagaaaaasgtgattttttttttttctttgagacggagtcttgctccgtcacccaggctgctggagtgcagtggtgcgatctgtgatcctcctgcatcagcctcccgcgtagctgggactacaggtatgtgccaccacgcccagctaattttttgtatttctagtagagatgcggtttcactgtgttagtcaggctggtctcgatctcctgacctcatgatccaccagcctcggcctcccaaagtgctgggattacaggcatgagccaccacgcccggccaagaaattttttttaaaaaaccaaactgtcgatgttctgaggagttcataccgaagtgttcagaggtgagtgyaacttgcagacgttcggctaaaaagtgtgtgtgcctgtaagaaataaagtttataaatatgacagaatattaggtcgtgaagatgaagcaaggtgaaggatgaatgggtactctttgtgtgttctttcagattttctacaggtttgaacatttttgaaacaaacttggcagtgactctcgcctctctaaatgcaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcaggtgagccaagtcctgactggggacgtgggagcactttggaaaatgggtgttatgcctcactaacacagctacagaaactcccctgggaccatgcagtggaaaagtctagtgaaatgccgagggaatgcagggatgtccccagcagaggccatgggtagaggggggctcccatctcagcctgtagttttgcagagggaagagcaggggccgtgggccgccatggataggtgggccaactacgcctaaacactgacagcatcgggggtgtgcattgttttttactcattgtataagttgtatttgttatacctagggtggaatcagaggaaaatgaatgaaatgtgtatatagtaaaaacacaatacaacaaacactcaacaggtgtgtttttttgttttttgttttttttctctgagacagagtctcactctgtcgcccaggctgaagtgcagtagtgcgatctcagctcactgcaacctccacctcctgggttcaagcgattcttctgcctcagcctcccaagtagtgagactacaggcatacgccaccatgyctggctaatttttgtatttttagtagagatggggtttcaccatgttggccaggctgatctcgaactcctgacctcaagatccaccttcctyggcctcccagagtgctgggagtacagacgtgagccactgcacctggccagactttctttttaagacaaattctgttacctttgaactcgcctgtttgaagctataccccttttcgaagccccttagtatggaagctgtggtggcaggggcagtctcagaaggagtcattggagagactacgtgttcctgttcagtggcgctctgtgagcactttgagggaccgcctgcatgcatgcgcacacgccatgtctcccacgtgagcccyttgctgcttgtgtatgactccctagtaaccctgggactatgcaccctctgcgctgcctcttgtctgtgaaatgggcaggacagtgggtggtcatgtgcaacaatgtgagtcattgcctcccgggccggccacttgctgatgagcttgtatgcggttttgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcggggtgagtgcatgaggtcagcgcatcatgatgtgggaagtgtgcaacacacgggctcctttgcagaaattctgtactaggttgaattcggggtatattccacttctagggtatatccattgtaaagaaacaaagaaaaatatatgcccaaagatttagccataatgattttttttcttcattttttactttgtggtttttaaggtaactggtaaatcagcagtgaggtattcctactgaatacccattggtaggaggttgttaaccatggtgtatccatatggtggaacattgtagccagcgacagcagcgttgtgtgtgtgcagttgggtttctcttgtttgaatacagagggcgttggtacacacacatacttgtccatctttccagagctgtgatttaatttatacaaccaattatcacccactgtttaagagggatgggtgacaggaatagcaggggcttatagttgttctttttctgctttagctctgtttgcatttcctaaaatgttcacatgtttttatagcaagaaatttggcagtaggattcagggctttttttggcaccaaaaaggaaacccacaaatggatggaaagatactacagacacatttattgacatgaaaagatattcacaccatgttaaataacaggtagaggccaagcatagtggcttatgcctgtaatagcagcactttgggaggctaagggagsatctcttgagcccaggaattgaagaccagcttgggcgacacaggagaccctgtctctacaaaagataaagaaaattagctgagtgtgacagcacacccctgcttgagctcaggaggtcaaggctgcagtgagctatgatcgcaccactgcactccaacctgggtgacagagcaagaccttgtctcaaaaataaataaataaataaataaataaaatacattaatcaggatttgtaattgtttccttttcagtttaaaaaatccacttatgtgcatagctatacatgctttatcaggtttttcatgaatatgtaaaatttgagagtaggtatcaaaatgccacttttgggtgacttgctgataggtttttctctttttctgctggttgttgtatttccttatttttcacaacaaatatatactacttgagtaataaaacagtttatttttggaggtgtggtctgaaatttattatattcaaaatttttaaaacttaagcataactttgttgtttttctcagcctccagctgcaccaacaagtagaaattatgcagaaatgagggaaaagcttcgcttacggctgaccaagaggaaagaggagcaacctaaaaaaatggaccagatctcagaaarggaaagcgtcgttgaccatcggagggtrgaggatttgttgcagtttataaatagctccgaaaccaaaccagtgagcagcacgcgtgcagcgaagcgagcaaggcataagcaaaggaaggcaagtgacagttctcagcacctggaggcgccaggtctgagggcatttgaaggtgccgtgccacgccagtctctaggcagggctgagccacaggaggtcggkgctctgacgtgtgttcacttgcccacaactttgttctgagagccagcctgtctctggtggcctgaactggagactggtaaaaaacttaactttgtgttttcgggaaattacttccccttttgtagaatgggtttgttcttgtgctggccatcatgagggcagcagcagacactccagctttatctgctggagaaccttcttttcgaagaaaggagccgtcaactgtagagatgatagaagaaaggcccaggtgggcttttggggcctgtgggttcagaagtgtctttgatatgagactggggcggggcacttggcacagggaagtcttctggactcaggtctgagcatgtcccccatgctgctcttgtcccactgctgttccagatgaagaccagcacatggcattgattagaggggaggaaaataagtcttcatgggaagacatgagcagttccctccttaccagagggcatggtgtgtcacaaaaagcaaatgtcaaatacaaaaaacgttagccagtcatggtggtgtacgcctgtagtcccagctactcaggaggctcaggtgggaggatcacttgaacctcagaggtggaggttgcagtgagccgagattatgccactgccctccagcctgggtgacagagtgagactgtctcaaaaaaaaagacaacttttttctcttggaggattgtctaaatgcccctatgctggagcagttccaaagagccttctggtttcagctccctaaaagtgtcaggctccaagaaccagacctcagtgagcagatgtgggctgcatgcagagggaacttgtaggttcctggggttctgacagtaggacagtggtcttgggaagaggccaggtttctgtctgcagcatggtcaggcaaaaaggtgaggaagaggacgatcccacagtggaccagagggtgggcccgatgtcctgtgttgttacttgtatcttagctgttgtgattgttctaccctcaagagctctgctcatacctcgcagtcctacagtagatttagactgactattgggcctgattgggaggctttgggggagaagccttgtcccgtgccccagaagactagagactgctggagtgcagagaacacagtgtgtcctccattcaggagcgtccagcatcggggtacccacgatggtccaaggccctgagacstcccattgggattcactggaggcctctgggacgccttcctgagttttsagggtactctccaccccaggctcttgccctctgaccttgcaggtggtctgaatccagacttgaggcccagctgaaccttagaggctgatgtcataggccctgcccagcacccagtcccacctcgagggaccacctcctggtgctttctacgctgcacccattttacagagcagctcacagatgtgtgttgaggctcactggctggctggttgttgaagggacagcaatagttgacctatggactctgtcccgtagcaggtccaaaccgggggcctgtgctggggcagccgttctgctggagaccagggcacctgccyttacatgcttgttatttgtccatatattgacaaggcacgtgtgctggatttagatcagctctgagaggatgccaactggccagtgtgtgccagcgagtgtcctgatggagttggtctctcctctgctcccgtgcaggcccacagctcactctagacactggactscaggacccatccacgaggtggctgctgggtgctgctcctgacatacacatggagaaggatgttaaataatttttacttgaattgtcaaatgaaatttttaataacataccattgttaaatttttatcataatttttaagtttttcaaaagacaagtcaatttgcctgtttaaaatattgtgaaaaataatttacacttggggagtacttttctatttctctaggagaaatgcttttggcagagtttctcataagccccagcatttctaaaggttggtggtgggtggagccgtgctcctaacactgatgactctcatctgctttctgaacacaaagaacagtttccatttgtgcccctggagtttgtgtgcatcactactcaaatgctgtctttacttgggatgaaaattaattttccatcaagttggacagtgagtcatttgctctgtcacatctgtcacactagtgaaaatatatggcacttctgtttatctgctagggtgggaagaaggaatttctagttctttactacacattgctttttgtggtgccatcacagctcattgcagcctcaacctcctggcttcaagcgattctcaaacctcagcttcccaaatagctgggaccacagtcgtgcgccctcacatccagctaattttgatactttttgtagagacggggttttgccatgttgcccaggctgctctygaactcctaggatcacaggtgtgagccactgcaccagcctggtacacatttcttacattccctgttcaagtgaatgcattagccttcgcctggaaaggtgggtttgctcagagttctggcggcacgtgtacagcctcagtactgcccgggcagtctgtggtattggttacatcatccactcggccaggcggcatgatgccctgccgcacctgtgagggggtagctgactccctggatgtgtgctttgcagctgckttgtccttggttactgtgtttagtaccaggtcaaaggctatcgggaattttttgttaactaccacccccccccccacacacacacacacaaataagtaagcatatactttagtaaatagatgaagtttaacaatcctgcagagtaagagaattggaggtgggtgtgtgttaagttttgatttattacagcctcttcagagtttatgttccatatgtgattygtttttgaaattatcttagtttttctgtatgacttaatttttagcactcactgtagtcttaaattgccttctttttgcattggcagctggaggagaaagctcgcctagaagcagaggccagggcccgggagcacctgcacctccaggaggagcagaggcggcgggaggaggaggaggatgaggaagaagaggaggatygtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaarcatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacrtcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattggtaaatacagaatagcgggaaggtatttctgagcgatgcctggttttccatgtgtgatgtgctagtataggaaaacactgggtttggcatgctctcgccatgtggcctccctcctgtagaaaagagcgtagaggggccaggcatggtggctcacacctgtaatcccagcactttgtgaggccagggtgggcagatcaccagaggttaagagttcgagaccagcttggccaacatgctgaaaccctgtctctactaaaaataacaaaaaaaaattagctgggcttggtggtgcacctgtaatcctagctactcggggaggctgaggcaggagaatcgcttgaacccaggaggcagagattgcagtgagccaagatcatgccgttgcactccagcgtgggtgacagagagactccatctcaaaaaatayatatagagagagagaggatttctaccccctccagttccccaactttagttccccaacatcagtatttcccatgtttgcttcgttattctctctctccctctctctcttrtttttctggacagaaggagagtcacttcatacatgatacccctttaacctaaaatacttccatgtatatttcctcaagataaagacacttataaaaccacagtacagtgatcaaaatgaagaagttgacactgatccaatgctattctctaattgtagaccttactcatgtttctccaattgtccttttaacatcctttatagcaaaaaaaaaaaaaaaaagctcttgttgtttctcctgacatgggatccaatccaggatcccatgtcgtatytctttaatttcctttccttkggatcggtttctctgtttttcatgacctttacttttttgaagagtgcagcgcatttattttttagaggatcccttggtcagggtgcatgccccatgtcttcccagtcaggttcagataccatgttttggcggcaacaccactgatgtggccagtccctgttggtatatcccaccaggaagtgggtgacggtgtctgtcccatcactggggatgggaactctgatcctsggttgagctggtctgcccattttcactacggtcaagttaatatttctcctttgctaattagtaagtgtcttatggggaaatgagtatcctgtttttattgaacattcaccgactagttgtagcatccattaatgattcttgccggaaatgtttattactgtgttgtcatatggtgatttttttttttttttgagatggagtttcgctcttgttgtccaggctggagtgcagtggcacgatctcagctcaccacaacctccgcttcccgggttcaagcgattctcctgcctcagcctctcaagtagctgggattacaggcatgcaccaccacacccggctaattttgtgtagtagagatgggatttcaccttgttggtcaggctggtctcaaactcccgacctcagttgatccgcctgcctcagcctcccaaagtgctgggattacaggcgtgagctgccacccctggcccaaatggtgaattttctaatattattctttctatatttgttacttgccattcaactgtaggaagagctttccaacctcatgtgtttttttcattcacttagttatatcaggatagatccacgaagttttacttgatgctatagatgagaatcttttacgaacactctttatgttgctgttttgattgtctgagattcggtcagtgggagccccctcggaatggctttttccttagaccatttgatgcrgccctaccagcctttaagcattttatactttgtgtcatggttcgatgctccgggctcatctcgtgtcttctctctcccagccctgaaccagccatttctccaaggagccctcctctttcttcaacagtggtgttcagaaacccagacctggacactgccatatggcattgcttttaggccctctcagtcagcagagcaggaggagtgggggtgtgagcatgtgcacacgagcgcctgccacctacacacactaattgctatgtacaagccgtgagttcccacagatatcccagccccactcctgtgctacagtgagcgttctcccttccccgtccacctttgtaactccttagacagtaagaacctggaccccatcatccatggtgcctttactgacttgctgagtcctacaacacaggtaaagggttcagaagtccctgcccttacccgatggaaaactccgggcatgctttcggtatttgttcagttctttttgtctttagcctcagggtgtggtgattacactgaatttacaaatgacttaaattagttcttttcacctttagtacaattacgttattgattgaaaacacacctgattgcgtttttccatttgtgttccatttgttttctcccctacccagttcctctttttttttaatctgttcccacccactccctgtaggtaactaatcagtttcttatttgcttttcttttttacataaaaggtagtgtattatagacataatagtgacttctgggttcttttctacttcatatattctgggaatcactgcacatcagttcgtagagattgtcctcattctttctgcagcgacacggtactccatttaaagtgtacgatgatttctgcagtcactcttctttgtgcgagcgtttaggttgtttctaatgctttggttttttgtttttgtttctgttttaaggtggagtctcactctgtcatctaggctggagtgcaatggcgcaatctcggctcactgcatcctccaccccccaggttgaagcaattctcccacctcagcctcccaagtagctgaaattacaggcacgtgccaccatacccagctaatttttgtatttttaatagagatgaggtttcaccatgttggccagattggccttgaactcctgaccttaagtgacctgcccaccttggcctcccaaagtgctgggattacaggtgtgagccaccgtgcccggactcaatgctttgttttaatcattacacccagtgctacagtaagtacttgtgtgcatatgtgtttccatattgtttggaggtgtttccttggagcactttcccagaagggagagggctgggtcaaaaggtaagtgtgttcccggtgtggtggctcacgcctgtaatcccaacactttkggaagctgaggcaggaggattacctgaggccgggaatttaagaccagcctgggcaatatagcaagaccccatctctactaaaaaaaaaaaaaaaagccacttatctgggcatggtggtgcacgcctgtagtcccagctacttgggaggctgaggcaggagaatcgctggagcccaggagtttgaggctgcggtgtgtcatgattgcaccactgcactccagcctgggtgacagagtgagaccctgtctcttaaaatttaaagcagccgggcatggtggctcacgcctgttatcccaacatgttgggaggccgagggaggcggatcacgaggtcaggagatggagaccatgctggccaacatgaaaccccgtctctactaaaaatacaaaaatcagttgggcgtggtggcacacgcctataatcccagctactcgggaggttgaggcaggataattgcttgaactggggaggtggaggttgcagtgagccgagatcacaccactgccctccagcctggcaacagagtgagactccatctcaaaaaaaaaaaaaaaaaattaaggctgggcatggtggctcacatccataatcccagcattttgagaggccaagacaggcagatcacttgaggtcagaagttcgaggccagcctgaccaacatgtggaaccctgtctctactaaaaatacaaaaattagtcgggtgtggtggcactcacctatagtctcagctactggagacaccgatgcaggaggatcacctgagcctgggaggcggaggttgcagtgagtcaagatcacgccactgcattccagtctgggcaacagagcaagaccctatctgaaaaaaaaawaaaataaaaatttttaaaaaggtaagtgctttcatagtttttttgctagctacgtccaagttctccaaaccctccagtcagcccacccaccagcagcatctgagtgcctgtttggccacagccttgcttatagagtagttgtcaggctttttaactgttgccaatccgttagctacagtaagccctcagtgtagttttcatttgcatttttctcctctaattacaatgaggtcaatatattattaagggctatttctttttgtgtgtatgaattttctattcatacctatttctcatttcttactaggtttttggtcttttcccttttgtatttaagaattttgtttttgtttttgagacggaatcttgctctgtcgcccaggctggagtgcagtggcgcgatctcggctcactgcaagctccgcctccgggggtcacgccattctcctgcttcaacctcctgagtagctgggattacaggtgcccactaccacgcccggctaatttttatatctttagtagagacggggtttcaccgtgttagccgggatggtctcaatctcctgacctcacaatccgcctgtcttggcctcccaaagtgctgggattacaggcatgagccaccgcacccagccaagaatttttttatatggtagggacattagccttttactcatgcagtatgctgcagacattctctcccagttcataagttgtcttttgactttgtrtatgcttttcagtcaggtggaaatgttcttccttttatgcggtcagcttcttgattttttattgcctctggattttgaataattgttagaaagctttacgctaacattgtgattaaagaggaacacacccatgctgccttccagtgtttgtgtagtttctttttttttcatttatatccctaatatgtttggaaatttttcttctctgtggtgtgaaatatggatccaatttctctttttccaaatggttagcgagtggtcccagcacattattattatttattcttttttttgggaagtggggtatagggtcttgctctgtcacccaggctagagtgtggtggtgcggtcatagctcactgcagcctggaactcctgggctcaagtgattctcccgcctcagcctcctgagtagctgggactacaggcacgtgccaccatgctggctaatttttttttttttagtagaaacagggtcttgctacattgccttagctggctataactcctgggctaaagcagtcctcctgcctcagcctcccacagtgctgggatyacagacgtgagctaccatgcccggccttagcaccagttattagaaagttcatcctggaccaggtgtgagggtgatggctcatgcctgtgatcccagcactttgggaggccaaagcaggaggatcattcgagcccaggagtttgagactagcctgggcaacatagtgagaccccatctctacagatattttttttaaaatagcagggcatggtggtgcacaccagtagtctcagccacttggaaggctgaggcaggaggatcacttgagcccaggtgtttgagattacaatgagctataattgtgccattgcactctagactggtctataatgagaccttgtttctacaaaaacaaaaataaataaataaaatcatcttgtcccagtgattcaagatgccacctttgtcctacaataaatttctttctttctttyttttttttttttttttttgagacagagtttcactcttgttgcccaggctggagtacaatggcatgatctcagctcactgcaacccctgcctcctgggttcaagcgattctcctgcctctgcctcccaagtagctgggattacagccatgcaccaccacacccggctaattttrtatttttagtagagacagggtttctccttgttggtcaggctggtctcaaactcccaatctcaggtgatctgcccaccttggcctcccaaagtcctgggattacaggcgtgagccaccgttcccgtcctgtcctacagtaaatttcaatatgcacttgggtctgtttctggaatttctcttcctttcctctctgtttacttgtgtcattattgcatttagttagttatttttagaggctctacatgttgtaatatctcgtagggctgttctctcctcatagcttttccagctcagtatttcccaggctatttcatgtttgtagttctatatgaactttagcatcaatgtgcctggctccatttaaaaaaagcttgttggggccgggctcacacctgtaatcccagcactttgggaggcctgggcaggcggatcacctgaggtcaggagttcgagatcagcctggccaacatggtgaaacaccatctctactaaagataaaaaaaattagccaggtgtggtggcgagcgcctgtggtcccagctgctcgggaggctgagatgggagaattgcttgaacccaggagccagaggttgcagtgagccaaggttgctccactgcgctccagccgaggcaacagagtgagactctgtctccccccacaaaaaaaaaagttgttggtatctttgtcaggattccattacacttatacattaatttagggagaattgatgtctttatgatattgatcattccttccaagaacaagggatgtttttccatttgttcaagtttactttcaggtcattcaggaatattttaaattttctcttaaatatttttcacatttcttactgagtgtatttctcagcatttaatcaccattgtttttaatttaaatgggatcttctccaccattatattttataattctgaactatccaatacagtagccattagttatatgtcattatcgagcacttgaaatgtggccagtccaaattgagaagtgttataagtgtaaaatatatactggattttgaaaacctagtgtaaataaaagaatgcaaaatatctcagtataatttttaatattggttacatgtttaaatcataatattttggatatattaaatatattactgcaattaatttcacccgtttctttaaaaaaaattttttttaatgtggctgttagaagaatcttttgtgtgtggctcagactcagatttcagattatatttcttatttttttttttttttttgaggcagagtctcactccatcacccaggctggagtgcagtggcgcaatctcggctcactgcaacctctgcctcactgcggactttatttcccaggttcaattccacctcctgggttcaagcagttctcatgccccaccctcccgagtagctggaattacaggtgccgcaccagcacactcaactaatttttgtatttttagtagagaccaggttttactatgttggccaggctagtctcgaactcctgacttcaagtgatcctcctgccttagcctcccaaagtgctgggattacaggcgtgagccactgtgcccagcctcagattgtatttctattggatagtgctgccctaactggttatttatttgtgtatgaaagctattgatttttgtttgtttgtttgtttatttcgagatggagtttcgctcttgttgcccagtctggggtacaatggtgcaatcttggctcactgcaaccttcgcctcccaggttcaagcgattgtgctgcctcagcctcccaagtagttggaattacaggcaagcaaaaccatgcccagctaattttttgtatttagtagagatagagtttcaccatgttggtcaagttggtctacaactcctgacctcaggtgatccacccatctcggcctcccaaaatgctggaattacaggcgtgagccaccacgcccggctgtatgttaactttatttttttattttttattttttttaatttttatctattttttgagatggagtttcattcttgtcgcccaggctggagtgcagtggcgcgatcttggatcactgcagcctacgccttctgggttcaagcgattttcctgcctcggcctcccaagtagctgggattacaggcgcacaccaccatgcccagctagtttttgtatttttggtagaggtggggtttcaccatgttggctaggctggtctcgaactccagacctcaagtgatctgccctccttggcctcccaaagtgctggaattaacaggtgtgagccccctcgccctgcctgtatgttaactttatatattttactttactgaattttattgtttgagtcttactgttgattctctggggttttccaggcattctattatatatgtgtacaaatagagaaagttttacttctactttttcaattcttacgcctctaattgttgkcttttacttaactgcatcttttctgatcttaacagaaatgtctctggtgtttccacattaagtaagatgttggctttagggttaaggtttatatattataagataattatttaaaattagccacattaaaaaaatttaatgttaaaaaaaaatccagcgattcctcatctcttgagtgtttttcattaggaatgggtgttatgggtgttaaacttcaaaggttttctagcatctgtggagataaccatgatgtttctccttagatgtattaatacgatgttttacattatttgatttttaagtattgaactgaacttsaattcctggaataaagctcacttgattatggtatatccttttgttttggaatctgtttacattatttaatatatttacatctatattatttttaggagagatgggtctgtgacttccgtttttgttctgtctgtattagctttgagtatcaatattatacttgcctcataaaaagaattaggaagtttttggctgggcacggtggctcatgcctataatcccagcattttggaaagccgaggaggggtgcggatcacgaggtcaggcgttcgagacaagcctggccaacatggtgaaaccccgtctctactaaaaatacaaaaatttgccaggcgtagtaacacgcacctgtaatctcagctactcragaggctgaggcaggagaatagcttgaacccgggaggtggaggttgcagtgagccgagaacacgccactgcactccagcctgggacagagagactccacctcaaaaacaaaacaaaacaaaacaaaacacaggaaattttcttgttttttacattttcagtgatctggaacaattcacattgggaccatccaggctttaaaggtttgatagaaatccctttgcaagccccctggacctggtgtgttttctgtggtccttgctagcagtcttctctcctctctggaaattattctatctctagtgaggttaattttggtaaaccatctttctgtagtaaattattcttttcaactagattttcaaatttatttgcatagatgtctgcaaggtagtctagtcatagttttaaatttctttgcaatgattattttcgcctgtcatttcttagtttgtgtatttttcctttctccctattttgcttaagttaatagtttatgtattttgttagttttttaaaatcatctgagtttattatttaggtttactgttcttcttttgtttttttttttttttctttttttttttttttgagacagagtctcgctctgtcccccaggctggagtgcagtggcgtgttctcggctcactgcagcctccacctcccgggttcaagctattctcctgcctcagcctcccgagtagctgagattataggcgcgtgttactacgcctggctaatttttgtatatttagtagagatggggtttcaccatgttagccaggatggtctccatctcctgacctcatgatccacccgccttggcctcccaaagtgctgggattacaggtgggagccactgtgcctagcttactgtttttctttacctcctttctttcttttttattttttattttaagacagagtctcactcatgttgcccaggctggagtgcagtggcacactcacagctcactgcaacctcaacttccctgggctcgggtgatcctccccactcaccttctcaagtaggtggtaccacaggtgggcaccaccacactcggctaattttttygtagtttttgtaggaacagcattttgccagattgtccaggctggtctcaaactcctggtctcaagccatctgcccacctaggcctcccaaagtgctaggattacaggcatgaaccaccgtgcccagcctaccttgttaatttctgctttcgtctttattttctttctgtgctttcttttttttttttttttttgagacagagtctcgctctttcgcccaggctggagtgcagtggtgtgatcttggctcactgcaaactccgcctcccgggttcatgccattctcctgactcagcctcccaagtagctgggactacaggcgcycrccacywcgcccggctaattttttgtattttttagtagagacggggtttcaccrtgttagccaggatggtctcgatctcctgaccttgtgatccacccaccttggcctcccaaagtgctgggattacaggcgtgagccaccacgcccggccactgtgctttcttttgttttactttcttggggttttttctaactttttaatttagaaattcagttcattttgttttttcttccatttttattgataaaagtgttcagcacgtggaactttcctctsatctttttcttaacaatatcccatggaatctgatagataatttttccttttttgtttgtttgtttgtttgttttgtttttgagatggagtctctctctgtcgcccagattggagtgcagtggcatgatctcggctcactgccacctctgcctcctgggttcaagcaattctcctgtctcagcctcccgagtagctgggattacaggcatgcaccaccacgcctggctaatttttgtatttttagtagcgacggagtttcaccatcttggccaggctggtcttgaactcctgacctcaggtgatccacccgcctctgcctcccaaagtgctgggattactggcgtgagccaccacgccgagcctccattattttttttaaagaaattctgggctgggcgctatggctcatgcctgtaatcccagcactttgggaggccgaggcgggcagatcacttgaggtcaggagttcggaaaccctgtatctactaaaaatacaaaaattagctggacgtggtggcacgtgcctgtagtcccagctactgtggaggctgaggcagaagaatcgcttgaatttgggaggcaaaggttgtggtgagctgagatggtgctgctgcactccagcctgggagacagagcgagactccatctccaaaaaaaagaaattatgtaatttccatgcgtcttttttctttcactcgatagtgtaataggcagcttttaaatttccaagaggagaaactttgttgttgttaataatttacaggtttttttcattgtgatcagagaatattgcttttgttttgcaaaacctattgatactttctgaggcccagtgtatgtcagcttttgtaactcctccatgtgtacttgatagaagtgtattttcttgggtcttggtatagagttcactgtgtgtgtgtgtatatatatgtacgtatgtatttacatatggagatacatatatgtatacacctccatgatacattaattctgttgtttagtcttctgtatatccttaytttgtgtcctcatggcctgtcttctgtggcttattattaatatgtttctgtgttttcttgcatctcctgtttccgtgttgtttggtgcacattcctgttatatatttttagttacttgtggctttttgtgttgagaagcggccacsttctggtcgtgctttgtgcctgcggcctaagtcctgctctgtctgcgttgtgactgctgcccctgctctccttcggcccatttgcctgacgagacagccttgtccttggccctttgtttccagcctttttctgagtgccttggttttaggackttctcttgtgtgaagcaaacctgaggcttgctttgtgagccaaattgaaaatcttcttttcagtcagttaagcccattcacacttagtgatataactatgtggttggtctcaaccctgtcattattttataatttctgtattttctatttactgttttgytttttgggtttttttaaaatgtgttgtggggttttttgcttttttatttaaaaaaaaaattgtggggctgggcgtggtggctcatgcctgtaatcccagcactttgggaggctgaggcaggcagatcacctgaggtcaagagttcaagaccagcctggccaagatggtgaaaccccatctctactaaaaaatacaaaaattagcccaggtgtggtggtgcatacctgtagtcctagctacttgggaggctgaggcaggagaattgcttgaacctgggaggtggaggttgcagcgagctgagattgtgccactgcactccagcctgggcgacagagctagactctgcttcaaaaaaaaaaaaaaaaaattgtccaggtgctgtggctcacgcctgtaatctcagcactttgggaggccgaggggggcagatcatgaggtcaagagatcaagaccatcctggccaacatggtgaaaaccctgtctctactaaaaatacaaaagttagccaggcgtggtggcgcgcacctgtagtcccagctactcgggaggctgaggcaggagaattgcttgaacccaggaggtggaggttgcagtgagctgagatcgtgccactgcactccagcctggcaatagagcgagactccttatcagaaaasaaaaaaaaattggggtattaggaaaatgggtgcttttttcctagtgcattcctatagacttgcataccccactcatgctccttgggcctgggttccctgtgtaccccctcgtggcctgctgtgttggcattagggggtcctctgacacccactcattgcctccacagcaggcagtgagtgaattccattctttgtgttttctctttcctgtctccctgtctctcctcttcccattttttgttggtggtgtttctgctctgtcagaacacacggtattcttaggtacacaatttactacaacagggctcccgcttgcctctgctgagtgttcccaggtgtcttcaggttggtgaagctcatcctcaggcagtggccttgagtagggccacagaattctctgagttctggagaagtaaactttgacctgttgtgttgtcaatgaacagatagtttggttggatataaaatccttggatcaactgatttctcctgtttaatatagtgtggttgttgtaaaaaaattttttcctgataccaaattggttaaagttgtgtttcctgtttttcttacaccaagattttatagactgattattctagttctagtcaggaaaagagartattagaaatctattatgacagcacttccagcagacatgccagctctttttcctcctcaagttggagctcttttcttctagaacttcttgtgggcggctgctgacatcatgctttcttagatcttcactttttgtacatctgtaaatgctccggccctctctcacccttgcttgtgcatcagtttcctgcatcagcagacggtgttctgtgcttcctttctgctgcttgagtttttaaaaatcgagactcagaatgctttcccatgccctgaagcacctctctgtacaaacatgtggagcctgctgtggctgggggctgtcctcactctccagtcacatccgctattctgtgccaggattgagctattggctgcgtttcctttaacctaatctttcccttcctcctgagtgtagattaccaaaggttgactttcccaggcctttccctgaacacacccagccttcattcctagaccacccagtcccagtggcaccagtgattgtggcctccaccccgctgtgtgccctcagggatacagttgggatccgagatagccaaggctgtcatagagcaggtccctagagagagactcctaagtgacatgtctgtgaacaaacacacttgaaagcacttgcctggtgctgtgtgagttgtcaaaaatattagctgctattatgcgagtaaaacgtgcctcatgctaccatggaaattccccagtggtagaaagaaatggagtgtttattaaaggttctgaaaaattgtcccgtgttgagggctgcagggaaatggagactcacctttaacaaagaaatgtcagtggctcctgtcctctttgttcacatcgatgaggctgaatgctgtgtgcactgcacccccccaaccccgccccagcccagatgtgtgctgctggaccctctttgatacttaaggctcacataagcctccgggaatgtattcacgattgaattagataagtgaccagaacagaacagagaagtagaaattctcaaacttgcctgagagtctaggaaattgagtaattctcaatcaatgatttccctgctatcctgcctgttttcaaagatggttgtgtaattgcagcatgaaatgtagccttggtttttgtttggaacaacttgaaagtgtttggccaggcacagtggctcacgcttgtaatcccagcactttgggaggccgaggtgggtggatcatttgaacccaggaattcaagaccagcctgggcaacatggtgaaaccctgtctctaccaaaaatataaaaattacacaggcatggtggtgtgcacgtttgatcccagctactcaggaggctgaggcaggaggattacttgagcctggaagatggaggttccagtgagccgagatcatgcctgggtgacagaatgagacttcatataaaaaaaagaaaaaagtttttgatgaaatctctggatgtcatatgggtgagatgaatgcctgggagaaccaccttcctgtagggttgatgtctgggtcctcttcctgtcaagggcacattcgagggacagccctttccttaacatgggcctgycccctgggcagcttctgctggcagctgtgctctgcctgactccaacggagacttagggcagtccctgggcttgcgtgcgarttagatttctgggaatcttcttgctaaagggctctctgatgggctgcctgtcatataatgaccagtcacatggggagtctaggttctggcaaacatgtcttctaacgggacctgaagccacagttgctttgcttagtggacatgtgagttctgcagtttccaggtcagacctgggtgttcataagcacaccaaagagatctgtcctctaaaatctcattttagaaaaaatgtttacaatttttgaagttgtttaaattgagcgaagacaaatgatttcttccgttctgataagatagcctgctgctgtaatttgacttgctgcttctcttttgttttacagatgatgtctttctacctaaagatattgacctagacagtgtggatatggatgagacagagagggaagtggaatatttcaaaaggtaaatgtggaggctgtgtctgaaaccgtggtgactgtgtgcttgccatacatgtttggttttctgtctttccatggcacttctagttgtcttggacgaagttacatcaagcaagccagacaacatggcttctgaagagccttgtagtaggacaggccagccacacacacccctcccatactcccaacactcacacaatcacttctgctccccctcacatgctagaaaaatagttgatggcagtggcttcccccccacccttccccgccaactggctgttgcgcttctgaggcggtggctctccaggtgtcctgggccagcagcgtctcctggggatacaggcccctacttagacctgtcggatcagattctgggaaggggccggcatctacgttcttgacagccttccgggtgaccctcacatatgctgatggttgaacacactggagtggtatgcttttgagaagaaaagtaacattttacatacttgctgttttcctgatgggcaagttttatcagtgcttgttctataatgttttaactactatgtgaattattaatggcaacaaaattttatttattttatttttaagagggaatctcactctatcacccaggctggagtgcagtggcacgatctcagctcactgcaacctctgcctcccgggttcaagcaattctcctgcctcagcctccagactagctgggattacaggcgcccacaaccacaccaagctgatttttgtatttcagtagagacagggtttcaccgtggttaccagactggtctcaaactcctgacctcaggtgatacacctgccttagcctcccaaagtgctgtgattacaggcgtgagccaccgcgcccagcctatttatttcattttttttattttttgagacagagtctctgtcacccaggctagagtgcaatgttgtgatctgggctcactgcaatccccacctcctacgttcaagcgattctcctgcctcagcctcctgactaactaggattacaggggcctgccaccacgcctggctaatttttgtatttttggtggaaacagggttttgctatgttggccaggcaggtctcaaactcttgactttaagtgatgcactcacctcagcctcccaaagtgctgagattacaggtgtgattaagcgtgcatttgtattataataaaaacaacaaaactggactagaggctgcgcctggtggctcacacctgtaatcccaacactttgggaggccaagacaggcagatcacttgatcaggtcaggagttcgagacgagcctggccaacatggtgaaaccccgtctctactaaaaatacaaaaattacctggacgtggtgacaagagcctgtaatcccagctactcaggaggctgaggcaggagaattgcttgaacctgggaggcacaggttgcagtgagccgacatagcaccattgcactccagcctgggaaacagagagagactttgtctcaggaaaaaaaaaaaaaaaaagccaggcatgcacttgtagtccaagctactcaggaggctgaggccagaggatcacttgaacctaggagtttgaggttgcagtgaactatgatcacggcacttgcactctagcctgggcaacagagcaagaccctgtctgaaaaaaaaaaaaaaaaattccccgagtagctgggattacaggcgcctgccaccacacccagctaatttttttatttttagtagagacgaggtttcaccatgttggccaggctaatcttgaactcctgacctcaggtgatccacccccccttggcctcccaaagtcctgggattacaggtgtgaaccaccacgcccagactgtcaaaatttttaaatacacagamctaaaaagataattaaaacattgcatatgaaaacctgcgggatatcgaaaaacgttaactttttagagctgtttatgtaaggctataattgcctaaattagtttttaaaaatcctgaaacataatgagttaaagatttcacttgagaaattaggaaaagaacaatagaayaaaccaaagaatatataaagaaggagataagagagataatgaaatagaaaacaaagatttggtagagaagatcaacaaagctaaaatatgattgattgaaaacaccaaataaatctttaggagacagattaagaataatagagaaaaaaagacacaaaaaatagcataattagatggaagaagaattaagatgttgataaytatcaaagtcaggtgatggctatgttcattatgctatactatctgtttttgtgtgtgtttgaaaatgtcagtaattaaaaaaaaaaaaagttttgtccgggtgctgtggttcatgcctgtagtcccagcacttcgggaagccmagacaggcggatcacttgaggtcagttcaagaccagcctgggcaacatggtgaaatcctgtctctacaaaaaatacaaaaaaagtaagccagatatggtggcatgcgcctgtagtcccagctactcaggaggctgaggtgggaggatgggttgagcctgagaggtggaggttgcagtgagccaagattgtgcatctaccctccaacctgggtgacgagagccctgtctcaaaaataaatttttttttttaagtgtgtaaatatataagtgaaaaggaggaaataactacagatactggagagattaaaataagagaacactgggaacaacttcattacaattgactttaaaactatgaaatgcaaaatcaacctgaggtaaaaatagcctgaatggtccagtaactactaaagaaatgaaaacaatagctgtaagtctcagtgagaaaactacattttaacagttttaccgagaattctaccaaactttcagactttgaaagaatggattatccagtcttgagcaaactctaccagtgaatttaaatgagtgagacatcacacacacaagtgaatactccctactttgttttatgagacaagtaaaattctgataccaaaatctgcccaaaacaataccagaaaaaatgaaaaatcacaggtttatctcactcatattagattcaaaaatcctaaagaaaatattctccaggaggctgaggcaggagaattgcttgaacccaggaggcagaggttgcggtgagttgagatcacgccattgaactccaatctgggcaactagagcaagactccgtctcaaaaatattctcatacctacatcagtgtaattttcaaaaaaaagaaacaatataccaaatcgagcagtgtattttaaaaagcagtataccatgagcaaattggtttatcccaggaacgcaaatagtgtttcatattagaaaatccactttattggccaagcgtggtggctcacgcctgtaatcccagaactttgggaggcccaggcgggcggatcacctgaggttgggagtttgagatcagcctgaccaacatggagaaaccccatctctactaaaaatacaaaattagccaggcatcgtagcgcatgcctgtaatcccagctactcgggaggctaaggcaggagaatcacttgaacctgggaggcggaggttgtggtgagccaagattgcaccattgtactccagcctgggcaacagagagacactctcaaaaaaaaaaaaaaaaaatcctccttccttcctccctccctccctccctccctcccttccttccttctgacagggtctcactcttgtcacctaggcttgagtgccatgacacaatcactgttcactgcagccttgacctccccagggtcaagcagtcctcccacctcagccctccaagtagccgggactacaggcacatgcaccatgcctggctaattttttttttcttcttttkgtagagacggggtttcgccacattgcccaggctggtctcgaactcctggcctcaagtgatctgcccacctcagcctcccaaagcgccagaattacaggtgtgagccccygcacccagctagaaaatccactaatgttagttgctacattaatatattaaagaagagccatatgatcatggcttagtagatcatggatcagtagatttccaaaaaaagtattttatattcaaccttaaattgtaattcctaggctaaaggagtataaaagaggaactaaaaatcaattttacaggtgatctaattgtctacataggaaatataaaagaacttacagcaaggggctaactgtgtaggatcagtacagaagttatttgcttttgttttttgtttttaaacagagcacggtggctcacacctgtaatttcaacattttgtgaggctgaggtggaaggatcacttgagcccaggagtttgagaccagcctgagcaacatagcaagatactgtctctacaaaaaataaaataattagccaggtgtggtgacatgcacctgtggtcccagctactcaggaggctgaagtggcaggatcccttaaacccaggagaccaaggctacagtgagccaagatgcaccactgtgctccagcttgggcaacagtgagactctgtctaaaaaaaaaaaaaaaacagttatttttctctatacccacaccacaaataattggaaatgtagctcaaaagagcatttataatagcaccaaaatctctcactatccacagataaatctggcaaaagttgcataagacttgtatacaaaagactgaaactttattggaaaacattaaagaagatctaaatcacagagattcattatccaaagacaggaagggttagtatcataaaagctgtcaaggaccgggcatagtggctcatgcctgtaatcccagtgctaggagaccgaggcaagaggattgcttgaagccaggagtttgagaccaacctggacaacatagaccacaactctacaagaaaattaaaaattagccaggcgtgggccgggcgcggtggttcatgcctgtaatcccagcactttgggaggccgaggcaggtggatcacgaggccaggagctcgaaaccatcctggctaacacggtgaaaccccgtctctactaaaaatacaaaaaattagccaggcgtggtggcgggcacctgtagtcccagctactcgggaggctgaggcaggagaatggcgtgaacctgggaggcagagcttgcagtgagccgagattgcaccactgcactccagcctgggcaacagagcaagactccgtctcaaaaaaaaaaaaaaaaaaaaaaaaaaaaagccaggcatggtggtrcatgcctgtagtcccagctactcaggaaattgacacaggagtatcccttgagctcaggagtttgaagcttcagtgagctatgcttacgccacctcactccagcytaarcaatagagagatcctttctccaaaaaaattaaaacaaaaggcaaaccattaggattmcacagcaagcttttgamcactaaactacaaagaggtcttcagcctgaccaaggagccccatggcaagaccagaggaggtgctgctgcttcatgggtttgcagctagcgagccctccctctctcctgctggaggaaggtgtgaagcgacgggagtccctaaccactgctccggggagcataactgttaaattactttggaaaagagtttggcagactctagcaaaattgaagttgtgcctcccgtgcaaccccacaaacagctgcacacttgtgtgcacgacyagaggttctcctgcatgtcccgggggcggggcaaacgtgaggcaagcagcagcatctgtctgttcactgccatgtgttcataccgcagtgaagacgaacagactgtcacctcatggagaactctcacagacataacattgagtgaaataagaagctgtaagaccatgtacatacagtgcagttccctcgatatgaggccacacagcacaaccatactaacatttaggatgtcatagagaagtcacgaaattaccaagaactatggtgaactaattactccaaaccctagggctgtgactacctcttgggagaggacagcacggcgccacggttagcaktgtcaggttttgtgacctgggggtgctgtgactcaggattctccctgctggttatgtggctgtcctgtgtgtcagacaccgtgtgcatgtctcacgtagtctgcagtcgacaaaacaggcctgatgcagaggccactgtgtctcgggtgcaggtggtgtggggagggacaaagccaggtcacactgggcctgggaccttagagagcagcgtgagctctgtgcccatgctgcaagaacctgtggaagctgtgcagtggtttggattggatttcttccttgaatggcttggagcaggaatgtggttgatgttcttgagcattctattccagctgctgtgtccagaaggggctgggggacagggtcacacatgcactaatggaaacaggattagtgattgtcagagttaggaggggacagcagaggcagaaggtaacatcacaaactcagggcttgaccagctagggacagggaaagagaatttggattctgggagatgacacagtcagcccttccagtttaggggagtgaggggatcagtctcatagaggctgcaaggcaagaacgctgttgggcattcacgaatgtttgtggttgaataaacaagccacagtttaagcaaccataattaaacctaatggatgggtgacagtaataaccattttcaggtttcattcaagtttagagacaaataagtaagtaagtaagagacagggttttgccacattgcccaggctggtctggaactctggagctcagaggattctcaaaccttccagagtgctgggattgcaggaatgagccaccacacctggtccagtgtttcaattttgcttacaaaagtatactttaggccgggcgcagtggctcgcacctgtaatcccagcactttgggaggccaaggcaggaggatcacgaggtcaggagatcgagaccatcctggctaacacggtgaaaccccacctctactaaaaatacaaaaaaattagccgggtgtggtggcaggtgcctgtagtcccagctagtcaggaggctgaggcaggagaatggcgtgaatccaggaggcggaagttgcagtgagccaacatcacgccactgcactccagcctgggcaacagagcgagactctgtctcaaaccaaaaaacagtatcctttaggccaggcacggtggctcatgcctgtaatcccactttgggaggccaaggcgggtggatcatgaggtcaggagttcaagaccattctggccaaagatgttgaaaccccctctctactgaaaatacaaaaattagcaagatgtggtggtgggtgcctgtaatcccagctgctcgggaggctgaggcagagatttgcttgaacccaggaggcggaggttgcagtgagttgagatcgtgccactgcactccagcctgggcaacagagcaagactccgtctcaaaaaaaaaaaaagtttgaagtaaaaaagactaatttagaatttaaaatttgattttaggaagtatgtcagatatcaaaggtttaaaacacttgatatcaaaataagatcatcacaaaagaagttattcatttaaccaaactaataattcaaaggtttcaaaaagcaaaaacctttatgttttgataggagactctggttttggagggttggggtttctgggttttttgtttgtttgttttgttttgtttttttgagacagggtctcactccattgtccaggcagtggtgcaatcacggctcactgcagccttgaccaccaggcccaggtgatctttccacctcagcctcctgggtagctgggaccacaggcgtgctccaccacccgctgcctgagactcagttttctcaacagtcagaagacataatgaaaatggcatgaggccaacagaatgtcttttttttttttttcagcttactcaaaagataattgacaaagtattttattatctcttattaatactacatgaaatcttattgaaaagagaaaaccagttgcatcagtgtattactattaattgtagtaaaatcttttaaacagatccatctaatttcaatcagctttgaccacacaggatttccataaatcttttataacctcttagaattttcccattcacttccttttcccaactttctatattcatttattttcttttccatctgtttttcaacttaagaccacttttaaataacctctaaactagtcaaaatcactttttcctttgacaaaaccacatcctcatgtttttcttataaccttccttaccaaaacacatcttactttttcttatgtattttatatgtagaactgttttcctgcttatctctactttgagttaccatgttagtcagaattttagcttttagtaaccttaaattatagtgaaaacttaagaaataagcaattattaatattttgtttatctgaaataagccaggcacagcgttcacaccttgtaatcccagctctttgggaggctgaggtggaggatcacttgagcccaggagtttgaggtgtgagctgcgattgtgccgctgcactccagcttgggagatagagtgagaccctgtctcaaaaaccaaacagaggataaagaatttaagctttccagtcaatgaagctttacattattggcagaaatcatgtcaacaaacagaaaagcgggctgagaaagtgcatatcgttatcaagggttacggaagagaggaattcagtcaactgagaaggtttttttattatgaattttttaactttttgagatggagttttgctcttgtcacccagactggagtgcaattggtgcaatctcggctcactgcaacctccgccttccagattcaagtgattctcctgcctcagcttcctgagtagcctctattacaggcacccaccaccatgcccagctaatttttttgtgtttttagtagagacagagtttcaccatgttggccaggctggcctctaactcctgagctcaggtaatccacctacctccgcctcccaaagtgctgggattacaggcgtgagccaccacacctggccctgtctctattttttaattaaattaaaaactatatatatatgtatgtatatacacacacatatatatggtgcttgcctgggcaacacagcaagacgtcatctctacaaaaagtaaaatcagctgggcatggtggcacactactgtagtagttccagctacctgggaagctcaggttggggagggtcgcttgagcccaggaggtcgaggttgcagtgagctgtgatcgtaccactgcactccagcctgggcaacagagtaagaccctgtctccaaaaaaaaaaaaaaaaaaaaaaaaaagtaatcacaccagagaggcagtgaaatgtgagagcgggtacatcctaccccttcccccacctcaagctgagtaatccacctgctgtattgtatagactctagatagagtgtggccaaagtagctgtaaattaacctcttaatgttgtcatagggataactcatatcctgtagttcaacagtttatagccaatcactatcaatataatttctgtaaagcaatgagaattcttgacaactttttttttttttttaaggcaatagtcttgctctgtcacccaggccggagtgcagtggtatgatcttggctcactggacccttgacctcccaggctcacttgatcctcccacctcagcctcctgactagctgggactacaggcgtgggccaccaatctcagctaatttttatttttatttttattttattattattattttttgagatggagtctcgctctggcgcccaggctggagtgcagtggcgcgatttcggctcactgcaagctccgcctcccaagttcacgccattctcctgcctcaggctcctgagtagctgcgactacaggcgcccgccaccacgcctggcaattttttttgtatttttagtagagacggggtttcaccgtgttagccaggatggtctcgatctcccgacctcgtgatccgcccatctcagcctcccaaagtactgggattacaggcgtgagccaccacgcccagcctcagctaatttttaaaatgtttagtagagacagttctcattatgttgtccagggtggtctcaaactcctggattcaagtgatctatctgcctcggccttccaaacgttgggattagaggcgtgagccaccaagcctggccctgataaacaacttttgtaatcacctcctctcctaatttgttctttttttcttaaaaacttgagttgttctttctaacccccttccctttctaaagaggcaagagatttgggtttcagggaaaaaaaagggaaactgccttctctggccttgcttcacagcatgggatccgggtcccggtactggcagtttggctccgttcctcctgtggcttctttttttttggcctaaattacacagcatgcttttaaaattgctgcttcctactgtttgtaattcagaccttttttcctccttaaatttgtgaccaaggccaggtacagtggctcatgcctgtaatcccaatactttgggaagccgaggcgggtggatcacttgagggtcaggggtttgagaccatcctggccgacatggtgaaaccccacctttactaaaaataccaaaaaaaaaaaaaaaaaaaaaaaaaagccgggtgtggtggtgcacatctgtagtcccagctactctggagtctgaggcaggagaatctcttgaacccaggaagaggaggttgtagtgagcccagatcgtgccattacactccagcctgggcaacaagagcaaaactccgtcccaaaaaaaaaaaaaaaaaaaattgtgaccagccgggcgcagtggctcctgcctgtaatcccactactttgggaggccaaagcgggcggatcacgaggtcaagagatagagaccattctggccaacatrgtgaaaccccgtttctactaaaagtacaaaaattagctgggcgtggtggtgctcgcctgtagtcctagctactctggaggctgaggcaggagaatcgcttgaaccccggaggcggaggttgcaatgagccgagatcgcgtcactgcactccagcctggcaacagcaagactccgtctcaaaaaaaaaaaaattgtgaccaattgctgttagttttaaactggtgcatgaaggtgagttctctccctggccctcaagagatttggaagtttgttttagagagtgctctcagtcacttaaggatgtaaatcttacttacttatttatttattattttttgagacacagtctctcactctgtcatccagggaattagcagcattcccgctgagactggatttgaaacaaagttacagttccttagagccactacagatttctttcctcaatggatacctttagcttaggataaccactaataggaattaatttgaatttacttgaaattatttatgactcttgaccatttgggatacccatttgtcatcttttctactaaaggaaactaaaatattgctctctcaaatactgggtattgttgagctgaagacagagtgcaggggctctctctacctctcctttgtttgcctaaaggtaggacataaatccttttttactgaagacagctactccgcagcccacagatggtgccagtggggcagaggaatctgtgagcagactttaaaccccaaaagactttctaaaaatgaagtctcagttcaggccgaagtgaagtggcttgatcacagttcattgctgggactacagatgcgccaccatgcctagctaattaaaaaaaaaaaaattattttatttattttttttttgagatggagttttgctctagttgcccaggcacgatcttggctcaccgcaacctccgcctgccgggttcaagcgatgctcctgcctcagcatcctgggtagctgggattacaggcatgcgtcaccacgcctggctaattttgtatttttagtagaggcagggtttctccatgttggtcaggctggtctcgaactcccgacctcgggtgatctgcccaccttacctcggcctcccaaagtgctgggattacaggcgtgagctgccacacccggcccaattttttttttttttttttttttttttggtagagaaggcatctctttatgttgcccaggctggcctctgagtatctttccacctcagtcttccaaagtactaggattacaagcatgaactacctccccagcccaaccccacaggtttaccttccctcatttttggcactagtcccatgggcagtttcgtttttctattttcctgtctctttaaatcttccacctggcatttgtgcatagactgtcagctgagaagctgagaccttagaaaatatggcctgacagatgtggcttgcaccctattcgcagctagcaagactttctttaagctgttcttgagaggggcctggggctgaaattttgttccctcttcagagaccttggttaaagccataaagggattcttaattttggtctcatgcatgtctgtgtgtgttggctttgagtcgtttgtgcaggtatgcccttgaatgattataaatttctggtttatatttagaatatgataggggttttttgttgttttgtttagccttctcctaagctaaatgaaaccatatactcagaaagtaaacagtttattaaaacattcaaagacaaacagctttaaatagtggttaccctagacctctaataagcaaatatgttccmcctccaaaacttttttttttttttttttttttttttggtgggagcacaaagtctggttctgtccgtccaggccgtagtgcagtggcgcattctcagyttgttacagtgggtagctagtcaggtgtgagcagggcaggggagggcctcctccatccaccagggatgtcaggtgaccatcaggtgatggttaggcagttgtcacactgcctctctaaaataataattggtcatagccagcaccagggaaactgaagctggtgatcagcagcttcccgataagatctcaggaattgggcaagtgggctcaagcatgtgcactaaggcacagaatggtggagtttaactggtgtgtgaccttccaggtactttacaccgggaagggaagatcgcctcaggtgagcatgcgcatgctccagtaaacacactacgcatgctccctcccaagtgctagcaggccagtgtgtgtgcaggcagcccaccccaagggaggaattgsgagaagggacgcgaggccctgaagtatgccaacacctagaaccctacatcagaggccggatggggcacttgcctctcgagttgcccacttggcctcttccaagtgcactttccttccttttgtttctgctctagagctttgtaatgaacttccactcctgttctaaaacttgcctcagtctcttcttctgccttatggcctttggtcagattctttcgtctgaggaggcaataattgaggctgctgcagacacatacggattcgccaccggcaactcaggtacctgccaccggcaacaggctcgctcagcctctgcccaccaggctgaagccatgctcccaccacagcctcccgagtagctaggaccacaggtgtgcgccaccacacctggctaatttttgtgtttttttgtagagatgaggttttaccatgttgcccaggctggccttgaacttgtaagctcaagtgatccacgcacctcagcctcccaaagtgctgggattataggcatgagccaccacagcaaggctttattatttttgagacgggtctcacctttgtcacccaggctggagtgcgggggcaccatcacagctcactgcagccttgacctcccaggctcaaggatcctcccacctcagccccgagcagctgggactataggcacatatgtgtactgccactcctggctaactttttactttttgtaaagatggagtctcactgtgttgcacgggctggtctcaaacgcctgggttcaagtgattctccaacctcagcctcccaaagtagtaggaaaacaggcatgagccaccatggccagcttcagatctcctctttggtgtcagtttcaggaaggaaaaaccaagaaacaagaatgttgactatttgcctggctaagacctgacacaggaatccttttaaacagctttagagttgaaagttgacttaattagaagctgatatttaggatatatgtgtatacaattttttcgaggcctctgctttctataaaagcttcttggaggccgggcgcggtggctcacgactgtaatcccagcattttgcgaggccgaggagggcagatcacaaggtcaggatattgagagcatcctggctaacatggtgaaaccccatctctactaaaaatagaagaaattagctgggcgtggtgataggtgcctgtagtcccagctacttgggaggctgaggcaggagaatggcatgaacctgggaggcgaaggttgcagtgaaccgagatcacgccactgcactccagcctgggcgacagagcaagactccgtgtcaagaaaaaaaaaaaagcttcttggccagggaagaagctacaaaaaatacaaaaattagctgggtgttgtggtatgcacctgtagtcctaactatttgggaagctgaggcaggagaatcgcttgaacctgggaggcagaggttrcagtgagccaagatcgtgccactgcactccagcctgggtgacagagactccatttgaaaaaaattaaaaattagctaggtgtggccaggcacagtggctcacgcctgtaatcccagcactttgggaggccraggcaggcggatcactttaggtcaggagtacagatcagcctggtcaacatggtgaaaccctctttctactaaaaatacaaaaatcagctggacgtggtggtgggcacctgtaatcccagctacttgggaggctgaggcaggagaatcacttcaacgtgggaggcggaggcttcagtgagctgagattgtgccattgcactctagcctggatgacaagagcgaaactccttctcaaaaaaaaaaaaaaaaaaaaaaaaaaamccggtgtggtggtacatgcctgtagtcctagctacttgggaggctgaggcagagaattgcttgaaccttggaggtggaggttgcagtgagccgaaactgccactgaactccagcctgggcaagagagtgagaccctgtctcaaaaaaaaaaggatttcaccatgttgcccaggctggtctcgaactcctaagttgaagtgatttgccctcctcagcctcccaaagtgctgggattacaggtatgagccaccacaccctgcctgggcctgataatttaagggsgctcacagctctcagattaaacgtttcttttctttctcaggactccttccgcccacccattcctcctcccgagtcctttccccttctcaagtgcagcctgtagcagggcctggaggggacccttgacactgtgcccctcaccgagaatctaaacccctgaccccgcagtgagtttctggcaagaacaggagtgtgatgggctttgccaagcaccagcttggttgtgggctgtttccttcagtgactgtttggctttttgtctttgcaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaaygagaaagttaaaaacaagcccacccagtactcacaccatcaartctgttatagagtgtacgactgtattaacacggaggcctgcctggctacttttttaamatattgttaagtaatattaaaatcatgtctttctttttgaaagatggaatacattagtacagcaggagacctcggctgcttctttctgctgggggagtggggggatagcgggagagggcgtgtaggtgatgtgtccgccatggggagccagggcaccaccccggagcaggtcccaggtctctccaggcaacggctcacccatcctggtgcccccaccatcctctgtgtgccaggcagagcaggcagcaggagacagaaagctcccaaggagctgcatcctggttacttcttactacctagaacactcagtagctcccacttctcccagcctcatgttcagcctgtctctgtgtgccctatcagagtatgacttcactctgagtgaaggtgaakagggcagggcctggttggggagagggtagggagagccagcttctggaggtattcggacgatgaggccacaggatttcctggtggacaggatgcaggtaggagaaagaggtgaagacctgcgctgtgtgcctggaggtgggactggagaccagttctggatggtgagtctgggatgtccaccggccacccaggtgagaggtctggaactggggactgctgttcatggacagagcctgtgtgagggccctgcaggggtgagtagatgggatgggggcccgagctgtggaaccaggaaggcagaggagggtgaggaggcttcgaggcaggtcaggggagacaaggcccagggcacccccacccaggcaccggtttgcaggagaatgaggtggggacagcaggtcctagaactctggagattgcacgaaagctggaaaagggtcaccaaccaggggaggtgcagcacgacgaactttcctcacttgtttttttttccaggtgtgaggaagagaacgttcctttgttcgtgggatgatagggcagagagtgaagcaggtcaggccatgaccacggcaacagtagtgtccttgaaaccccagtgcaggcccccgggactccagccgctgcctcttctggctgcggtggtggctggggaaaggcccaggcccgggcctcgccctatggggaagctgcctgcccaggcccccagtacctgccctgctctccccatggacagcctttaacactgtgctgaaccatgcctgttgctgaggggaactgcacagccctgagtggtgatggggaactctgggtgccccgacacactaagcatcatgctgggacctagagaccctcagacgcccaccgcacatgcccagttctgggcactcccatcacctccatggcaaccctgcctgcggcttcacagctctgcccgctctggcccctgacctgcacctgctagctttggccctcaggctcccagccattgtcctggccatgcccttgccaggaaggatcttcctctatttccctggaaaccactcatccttccagcatcccagggtgcttataggacatccagctccagggtccctgacttgatgggagcccctggggttcctgatgacatcacttccctgtgggggagggtggggccgccataggggagcctcacatttttgactcacacagtagcacagggtgagtatcccttatcccttatctggcatcctcagtaccagaagtgtgtccagtttcagacttttttggatttggagtatttacatcatgcttaccaattgagcatttctaatccaaaaatctgaaatccaaaatgctccaatgagcatttccttggagcatcatcttaacactcaaaaggatttgaattttggaacctttcgggttaggcatactcaacctgtaatagtcatgaaatgaaacaataacaatagttagaaaggaaactttaacagtgaacagttgtattgagaagcttactgttttctgcaccctcagctctgagccctgctcagagattttgcctgggtagagaaacaggcagtaaaacagatagctcctaatctcttcccaaagaaactgactttgtttgcaacaaagaatgaagaggttcaagcctgaaggcactcagaaacagtggaggccatgaaaccctgggaagagagacaagatgcaggctcagctacaggccagatagtttgcaggaggtaactgaagaaaagagctgggagaaggcatccaggggtcagaaggaatatcacacagtgttcccagaaactctctcttcaaaggagtcagaatttgattggatttgtttgtagagcatggtgccccagggcattgttgaaaacaatagaattggcaattagtggtttaatgaatgtggtcagggaaagaggaagagaactctaccaaaatgactgtcatcccagggtgactgtgggcatacgcaaagctacacaccctgaggagcaacatcatagctggaatactagtgggtagtagaaagaaaacaatgatataataaggctgcatcaaatgaatatagaaattattttaaaggaaccaaatggaaattatggaatctgaaaagttacgtgtgtatatatatacacacacatatatatacacacacacatatatatacacacacacagagagagacagatggagtcttgctctgtcacccaggctggagtgcagtggcaccattttggctcactgcaacctccaactcctgggttcaagtgattctcctgtctcagcctccgcagtagctgggactatagttacacaccaccatgcctggctaatttttgtattttttgttgagacggtgtttcactgtgttggtcaggctggtctcaaactcctgacctcaggtgagctgcccaccttggcctcccaaagtgctgagattacaggcatgagccactgcacccagcctaaattttaaaattagcagaaggaaaaataagtggatttgaagatagrctgatggagattatgccagccaaagaacatagagaaaaaaataatgaaaataaagagtctcagaaaaatgtgggacaccattaagcataccagcctatgtataatgggaatatcaaaaggagagcaaagagcaaaaaaaatattcaaagaaataatagtcraaaacctcccaaattgaaaaatagtaacatgtatcccagaagttgaaaatgtttatattaagaaacaagaaagatctcactcaaatcaataaactaacttgtcaccttaagacactggaaaaagagcaaactaggcctaaagtaagcagaaggaataaaatcataaaaattagatcagaaattaatgaaatagaggatgcaaaaataatggagaaaatcaacaaaaccaaaagttttaaaaaggtaaacaaaatagacatctgtagcaagattgaccagggaaggattcaaattactagaatcagaactggccacacagaaaaaggattttaaaggaatactagaacaattatatgccagcaaatttggtaatttagatgatatcttagtccattcatgcagctatgaccaaatatcacagactgagtaatttataaataatagaagtttatttctcacagttctggargctgtgaagttcaagagcaaagtgcaccaacagattcagtgtctggtaagggctcactctctgcttccaaagtggcaccttgttgctgtatcttcatatggtagaagggcaaaaaggggaattaaggtgatcccttcaacctcttttataaaagctgtaatccctttcatgatgatggagcactcatgatttgaacacttcccagaaggccccacctcttaatactatcaccttgggcactaagttctaacatatgaacatataaaccatagcagatgaratggacaaatttctagacaggaagaagctacaagaactgrctccagaagaaatagacaatctgaatagacctataatgagtgaagatgttgaaatagtaatttaaaacagggaaaagtacccacaaaagctcaagcctagaagtcttcactgctgcattttaccatacagttagagaagaattaaaaccaatttttcaaactttcagaaatagaagaaggaacacttcccaactaattctgtgaggccagtattaccttgataccaaaactagacaaagacatcacaagaaaactacagactattatctcatgaatattgatgcaaaattcctcaacaaaatactagaaaaccaaatccagcaatataagaaaagaaatatacaccgtgatcaagtggaatcccaggaatgtaagggtggttcaatatccaacacatacttaatgtaatcatattaatcgaaattttaattgcatgatcatctcaatagatgcaaaaaaagcatttgacaaaatccaacacttttgcataataaagacatttcaccaagtgtgaatagaagagaacttcctcaacctgaagaatgacatctacaaaaaattcactgttaatatcatccttaatgttgtgaaagaccgcatgctttccccctaagatcaggaacaaggcaaagatatctgttttgcagtttctattcaacattgtgctagaggttctagccaaagcagttaggcccaggcaggcggatcacgaggtcaggagttcaagaccagcctggccaacatagtgaaaccccatgtctactaaaaatacaaaaattagttgggtgttgtggtgcgcacctgtagtcccagctacttcggaggctgaggcaggataatcacttgagccccggaggcggaggttgcagtgagctgagattgccactgcactccagcttgggcaacagagcaagactctgtctcaaaaaaaaaaaaaaatttcagctgggcatggtggctcaagcctgtaatccctgcactttgggaggctgaggcaggtggatcatgaggtcaggagattgagaccatcctggctaacatggtgaaaccccgtctctactaaagataccaaaaaaaaaaaaaaaaaaaaaaaaaagccctgcatggtggcaggcgcctgtagtcccagctactcgggaggctgaggcaggagaatggcgtgaacccggggggcggagcttgcagtgagccgagatcatgccactgcactccagactgggcaacagagtgagactctgtctcaaaaaaaaaaaaaaaattttttttcagggaacttctatctcagtaaactttctagggctcccgtggtgtggggcctgtcaagatattccttccaaggtgaaggataagtcgcctcatttggtccctcctacaaccaagaagatccacaatgcttagtgggtctatttggattttggaggcaacacattcctcacttagatgtgttactccagcccatttatctagtgacctaaaaggctgccagttttgagtggggtccagaacaggagaaggctctgcaacaggtccaggctgctgtgcaagctgctctgccacttgggccatatgacccagcgatccaatggtgcttgaggcgtcagtagcagatagggatgctgtttggagcctttggcaggcccccataggtgaatcacagtggaggcctgtaggattttcaccccataggtgaatcacagcggaggcctgtaggatctggagaagatggccctgccatcttctgcagctaactactctccttttgagagacagctcttggcctgttactgggctttggtggaaactgaatgtttgactatgggtcatcaagtcaccatatgacctgaactgcccatcataaactgggtgctttctgacccatcaccataaagtaggtcgtgcacagcagcattccatcatcaaagagaagtggcacatatgtgattgagctcaagcaggtcctgaaggcacaagcaagttacatgaagaagtagctcaaatgcccatggtctccactcctgccaccctgcctcctctcccccagcctgcaccaatggcctcatgaggagttccctatgatcagtggacagaggaagagaagactagggcctggctcacagatgcttctgcacgatatgaaggcaccacccaaaagtggacagctgcagcaatacagcctctttttaggacatgcctgaaggacagcagtgaagggaaatcttcccagtgggcagaagttggagcggtgcacctggttgtgcactttgcatgggaggagaaatggccaggtgtgtgattatgtactgattcatgggctgtagacaatggtttgcctggatgggacttggaagacaatggtcaggggcttgaaagaagcattattggaaaattggtgacaaatttgaggaagaggtatgtggatggacctctccaagtggtcaaaaactgaagatatttgtatcccctgtgagtgctcaccagcggatgacctcaacagaggagaattttaataatcaagtgggtaggatgacctgttctgtggacaccactcagcctctttccccagccacctgccatcgcccaatgggcccatgaacagagtggccatggtggcagggatggagattacacatggagattcagcaacatggacctccactagccaaggctgacttgtctacagccactgctgagtgcccaatttggcagcagcagagactaacactgagcctcaatatggcaccattcttcagggtgatcagccagctacctggtggcaggttgattatattggacctcttccatcatggaaagggcagaggtttgtcctcaccggaatagacacttactcctgatgtgggtttgcctatcttgcacgcagtgcttctgccaagactaccatccatggactcaaggaatgcctcatccaccatcagggtgttccacacagcattgcctctgagcaaggcactcactttacagctaaagaagtgtggcagtgggctcatgctcatggaattcactgatcttaccacgttccccatcatcctgaagcagctggattgatagaacggtggaatggccttctgaagtcacaattacaacaccaactaggtgacaatactttgcagggctgggaccaagttctccagaaggccatgtatgctctgaatcagcatccaagmtatgatattgtttctcccttaaccaggatgcacgggtccaggaatcaaggcactcaagtggaagtggcaccactcgccatcacccctagtgatccactagcaaaatgtttgctccctgttcccatgacattatgttctgctggcctagaggtcttagttccagagggaggaacgctgccaccaggagacacaactattccattaagctagaagttaagattgccacctggacactctgggctcctcctacctttaagtcaacaggctaaggaggagttatggtgttggctggagtgattgatctggactatcaagatggaatcagtctcggccgggtgtggtggctcacgcctgtaatcccagcattttgggaggccaaggcgggcggatcatgaggtcaggagatggagaccatcctggctaacacggtgaaaccccgtctctactacacaaaatacaaaacattagctgggcatggtggcaagtgcctgtagtcccagctactcgggaggctgaggcaggagaatggtgtgaacccgtgaggcggagcctgcagagagccgagattgcaccactgcactccagcctgggcgacagagcgacactccatctcaaaaaaaaaaaaaagatggaattagtctcttactccacaacagaggtaaggaagagtatgcatggaatacaggagatccattaggacatctcttagtattatctaatgccctgtgattaaggtcaatgggaaactacaacagcccaatccaggcaggactacaaatcaggaatgaaggttcgggtcactccaccaggaaaaaaaccaccatctgctgaggtgcttgctgaaggcaaagggaatacagaatgggtagtagaagaaggtaggcatcaataacggctatgaccacatgaccagctgcaggaaccaggactgtaattgctgtgagtatttcctccttttgataaaaaacgtttgtgcatgtatacgctagtactaagaaaatctcttcatttcctttctcctttatcgtgtgacataagatttattgacttcacatcagcatttaagtaccgtcagtcaccttggccgggtgtggtggctcatgcctgtaatcccagcacgctgggaggcagaggcaggctgatcacctgacgtcaggagttcgaaaccagccaggccaacgtggcgaaaccccttctctactaaaaatacaaaaattagccgggygtggtggcaggcgcctgtaatcctagctaatcgggagcctgaggtgggagaatcacttgaacctgggaggcggaggtagcagtgagctgagccgagatcacaccactgcactccagcctggggaacaagaaactccgtttcaaaaaacaaaaagtaaagtattgttacctttatgtaatagtattatttgggttggggactggtgcgtttccggttgtatgaaggatagttgtattatgttaggcataattgtgactttatttttgtctttatttgaagattattatctcaggactatgtatgggttcaagtagacaaggggtggactcatgatggttaatactgagtgtcaacttgattgaaggwtaggaagtattgatctgggtgtgtctgtgagggtgttgccaaggagattaacatttgagtcagtgggctggggaaggcagatccaccctcaatcggggtgggcaccatctaatcagctgccagcgtggccagaataaagcaggcagaaaaatgtgaaaagagagactggcctggcctcccagcctacatcttgctcygtgctggatgcttcctgcccttgaacataggactcccaagttcttcagtttcggaactcgggactggctctccttgttcctcagcctgcagacggcctattgtgggaacttgtgatcgtgtgagttaatacttgacacactcccctttatatatctatctgttccattagttctgtccctctagagaaccctaatacagccaggctcccactgacccccttgtcttggtgccctggcagaaggcaacagcaggagtgttttcccatgccagctgctgtaaatactgttcagtccctgcaccccagcttccaacacaaattctcagagcagtcacagcagcaagaacgtttattataaaaataggtgaataaartaagtgtgctttaacttccggctggatgacaaatgctactgaaatgcagtttctcagtgcagacatgtggctcgcaatggcgggggtggccaccctagtgtgacgtgcagccgcaatactccatttgactggttcgaggcagagaggcgacgctttattccatagaacaggatggggctcccaccctggggaccatacaagtgactccctcaggcagccacccctttctaggcaggctgggggargggctggcacaccagcaccagatagctctggcttaagcctgatggagacacagactgggacctccctctgccagatgttcctgaccccatctccacctccagcctccagcctcactggcagttccctgtgacccagcctgttccatagccaaagggaccaaagtgaacgatcagagtgccccgcaactattctaggggccttggctctcagtagagctcaacccatggcatctgagagcacccaccctgtccctgagggcagctgcaccgggccaggaggccgcaagggcacgggtgagtctcggtcactggcagcactcrgccacatgcctgaggagctcttccccttgctcgtcactgaagcactgcaggcagtgagggcactgaaggtccccctggcctctctgggccgcgccaggatgcccgccctctgcagggggttctggctgctgggacccagtcccaggcctccagccaccaggcaccataagctctaatgcgtcggcggccaaatacttggcagttttgctcccagcgtgaatccggccggcgtctggctctcgagaatcctggagaaaaggcaagggtgtatatacgtgggctgtgctgacggtcacaaagccaggtctcaggttccagcaaccagaggcacttcacctatccctgagcggaacttcagcccctcactttgcttcctgctgcgccccagagcccagacaagggggcgctcagtgaatgactgaggatcacacacacgctccgtcatgtgctcatgaagaagtaggccctggcgtggtccaccccccagccccttggtggaagtcctgttcagttggacctatcggccccaggagacctgactgagaaggtggccctgatgacgtggcccacaggccaccacagagtggaggtggcagagcctctggtggggagctgggcaaactgagtaccaaccctactctgcacctcctctgtggggcctgggggtgctgagcactctggggctcagggggtccttcagtagcagcaagaggtgtccctggcttggccccaccaaccacctggcatgatctggcacatgttctccaaacatccgtcctgaagcactgcagcctgtggccctcactgcttgcctgggaacttcattccagcaggccttggtgcttccacttcctgtctgaatgtggactttccccagtgggactacagcttatcacccatgccttcagcaccactgtccctggctgtgccatctagggactgagcaaccctcgaggggccacaggctactgttgaaagggaaccagaggccacttagtacaaggtctgcaggccccaccaggaactttacccccgggggtaagaatctgggcctgcaagtctggaaccagttcatctggtccaaaatcttcaagaggcggcctgagaccatcctcacgattgtaccaatagtgctccttcaatccaaatcacatgcttccttgaattcatgaaggccagaaaaacctgtccagccctctgctgcagacttagtcccagggttagtcccatagtccaccatgactctcccgtgcccttcatgcggaggagaagcagaaaccactgaggcccagtggctgctcggaacagggcagtggggggtggcctcacagccccagggtccctgttcacaccctgaaacacggctgacgtcctagctccagcccgggacgcatcgattctcaagaggcatcactactgttcagtctgtgccaggagaggaagctctttgagtggggcccaggctattcccagggccaaaagtgtgttaggtacttgatgaggagctamataaacttctcctggatttttgcagagcacaagtcagtgaggagaaggaagaggccatgggtcacacactgaggaacttcatcggttcccattcatgccaggcctccctcaaggcaccccatggtaggaaaagcactgagcccaggggtggggtgaggggcccctgccctgcaaggcccagctccacgtgccaggctgagctggggatgttactggacacccagggccatcacatctacatgacaaggtaagcggggttcccgtctcacagacaggtcaggacacgtagggagctcacactttgaggcccgagatatgctctctgactgcatgacagtgacggacgggccctgaggacagccacctctgctaagacaggccgccatgccagcctcctccataactaaacagtataacagggaggctttccatgaccacgcccaggtaccaggccaggtggctctccccacagcagggaggggctcgccacaaccctcatcaccagcaaatcagggccttggcagacacagaaaggctctaatctcatgagaagagaaacaaaaacactaaacctaagcaggaagaaaaacgccctcatactctacctgtctccaggacacctggtgcagcaaagaggcgaccttttcctccagttcttgaatcctactttgagcccgttcccgatcggccctttctgacatgaagtcatccttgtaagcgagaatctgaagagaggcgagacacacatttctgctcaaggaaggaggaagcgccccaccaggcttctcccacccccacmgtgaccactgcccactcagtgccaccaagccttcagcccagcctgtcccatgatttcggccaccaccggccagcagacatctggtcagtgccgtccggagcccgagggacagacacctgctgttccagcatctgcacccgctccaacgcagcatcccgggccgtcctggaggccgccagctcctgcttcacttcggcacagtcatttattttctcttccaactgtctgttgagccgggagatctccttcctcatcagctcgggctcgtgggggatctgcagccccctgagctgcgcatggagccccctcacgtattcgtccctgctggcgttgtagcgctgccacttggcattgaggtcttcaacctgaagaggtggagccggaaagctcacggtgaaggcagctgacaaagctgctcaagccagcacccagtgtgaattatgtattagcagtgattcgctgagtgagagtttcctcttaaatggaagctgcccctccctgttctgtagagagcagacactaggcccgctagagaatcctgaggcagcacgatgacacccgtacgcaagcagcatgaacggaggtggactyggtgcagctttgctgtcttagaaaatggacctcctgctgctaactcttgcatctcctttactgacttgtggattaattttagggggatggagatggacaggacatgtcccgtacgtcgttttaagcaaaaaagtccagtctctagggactgtgtgtatcaagtcctagtggccagagggcggggggcgactctgggcatcagccaaggaaagaaccctcacttacagtttgtaagccatgtgttcttctcaaacgaaatgtgaaagacactcacgtgagtcaccttctgttttaayagtcgattttcttcctgcaacttctcaataacactctggacagaggtgtgcccatctgtgtgttccgactgcatgaggaagggacagagagaagacactctgtcacatacagcaagaggggagaaagctagacccagaggctgaggccacagattatcactgcgtcccccagtgcagcgggtagtgatcattcatttggtagagaagcaaagcagggacaagggaccaccttctccctgcccaggcccaccccacctggcccaggccagagcccggatggraggtcttcaggccacaccacctttcacactgtccttatcccgtcccacctaccagtttgagctgtttgtcttttaaatatttggaatgtaaatattctaaagccataatgtctgcagggattggcacaccagacatgataaagtcttctcattgccagagatttgccattatcacagacagcagggaaggcaggaagctgaatcccattgtaaaccagaggatctccagtgrgggggcccccagctgcccagggtgggcctggccatgcaccctgcttacctcctttggagcccatgacactgtcctgtctgcagacaatcgggttcaaccaggtgattctggacacagsaatctaacctctgccccacgcagggtcaggagtcacmgaagccacaacccaaaccaacccccactaacaactacagagctgaatgaaaagtctcctgaaactcgtgtgtaccctacaattctgactgtatctcagtgacataatttttgagaattcccctcaaatgacaaaggaagtgcacgtcctaacacagcctacaccgggaagccccgggtgactcagctgagttcagggctgagaagtgacacttatttagagactgtgatgagggcctaccctgccactggccccacccccgcctcaggctcaacactgtgtgtggctcctttcaaatccccagagggaaatgacacagtgactcaaaatcagaccagaacaccctgcctccgcccagacggcacttttcctctggtttctgaatgcagctgtgtcctctctgaggttccccgcctggaatccacccagctgaggtgggcagttctcagaccaaccttctccccagtgggcgcctcggtgaagctgctgatgggtgcgggatgtactgtctgccacagaacatcccagcgcgtgtgtttctgcatgaaccttggtgctgcctcagagaactgcctagaaaggacccgagcgagaggccctgtgcccggcagtgcgagtgagatggggtctcagcctaggtgagatgtgcacggagtgcctccattcccctgcctgccacacacagaccaccacaagcaccagcaagatggaaggtgcctggcacacagatgccttgggccactgctcccctacttttctgcctaggagccccctggtttctcctgatgctgaaactcccacrgtccttctctctcccactagaccccacagagagctacagcccagatccagcctatcctggaggtccagcgaacccttctttggccctcactgtcacttggtgccgctgcccccggcccttgctttgatgatgaggaggctgtggccctgagccaggtctccaagcttgcgggaggccgtgctgctggcaaggacatgcctaaagccagctttggagatggcggttccagctgtgcctgcatgcactcagacacactgagcctgaagaaggcgggcactcacggtccttccaggagtttggggtgtggaactggaggcactccccatccccagcagtaccacctggctctgcttcagtttcctcggatggaggatgtgactacacttcctccaggcagctctgccasgctcagctcctcctcctcatcctcagctgaggcagatgaaagccaagtgccatctcccacctgggagcggggtcggccacaggcctggtgctgggcagtgaggtggctgcctgctttcctattacattttgcatgttccatcattttaaaagaaacccttggatgagtgagctttgccccgtcagctgactctcgttactgagaacagaagtgggttctggggcgccccccgacctctgtgatcaggggcctgtaggcgatgctcccagcacacagaggtcttccccacactctgcttacactgtggcctacctggtcaggacttctctcccccacattcctttgtgcatgctgtcgttcatccagacacttggccagatgctgacacatgtgggcggtggcggtcagcgtcctccgcagctgatgggtctcgttggccaaggagcggcacaggacgtcactggcggcccgggcgcgctccccttctgccatgctcctccgtagcaggacgacttccttctctcgctcgtgttggggctggctcagcagctgctgcatctccctctctttttcttctagtcgctcagtcagcctctcaatttcctaagtggaagatttaaaagcacagtttactgaattaaaagaagcagtgtcaagagcaaatgttcagaaagcaaaagaagacctggcgtggatgccccatcaccagacacaaacatactcactcagaagttgggcgtttgaactaacaattactcactcagaagtygggcatttgaactattaactctggagtttttcagcctacaatgttctgttctgaaacttcatctcaaattttttttttttttgagacagagtttcactctgttgcccaggctggagtgcaatggcacaatcttggctcgctgcaacctccacctcccaggttcaagcgattctcccacctcagcctcctcagtagctgggattatagagcccaccaccaagcccagctaaaagaattttttttttttttgagacggagtctcgctctgtcgctcaggctcgagtgcagtggagcgatctcagctcactgcaagctccgcctcagaggttcacaccattctcctgcctcagccttccgagtagctgggactacaggcacacgccaccacgcccagctaattttttgtatttttagtagagatggggtttcaccatgttagccaggatggtctcgatctcctgacctcatgatccgcctacctcggcatccgcccacctcagcctcccaaagtgctgggattacaggcgtgagccaccacgcctggcccaatttttatatttttagtagagacggggtttcaccatgttggccaggctaatctcgaattcctgaccttagatgatccgccagccttggcctcccaaagtactgggattataggcgtgagccactgcgcccagcaatttttttttttttttttttgaggcagggtctcactgtcacccaggctagagtgcagtggcacaatcatggctcactgcagcctcgacctccccaggcccaagcgattctccatcctaacctgagtagctgggactacaggcacgtgccaccgtgcctggttaacttttttgtattttgtagagacagggttttgctgtgatgctcaggctggtcttgaactcctgggctcaagagatccacccgccttggcttcccaaagtgctgggatgacaggtgtgagccaccacgccctgccaaattctattttcacaagcaagttcataattttagatttcatatcatcaaaatgtttttttgagatgagggtttcgctatatatagcccaggctggtcttaaactcctaggctcaagcaaatcctcccacctcagcctcctgaatagctgggactacaggctcaagccaccacacccagttatcatcaaattatcaaagtggcaattccaagcacttttttgatgggaaaggtagaaactccactgtggtgggtaaccccaaaaagatgtccacaaccaaacctcccattccccggtatctgggaatgaaaccttacttagagatagggtctttgcagatgtaattagttaaggtggggacaaaatggattaggacgggactggtgtccttgtaagcagacagaagtctggacagacacacagagagaagacgaccacgtgacaacaaagataggagtgacgtcttgtcttgtggataaaggccaaggaacaccaaggattggtggcccccacaggaagctgaagaggcgaggaagggtccttccctagaaccttgagagagagccgatgccttggtttctggcttctggcctctagaactgtgaaagattaaatttctgttgcttgaagccccccagtttgtgttactttgttacagcagctctaggaaattaacacacccaaccccaattacttcttaaagaatttaaaaaggttcttaaaatgacaattttwttttgagatagggtctcgccctgtcacccaggctggagtacagtggtgccaccatggttcactgtagcctccacctcccagactcaagtgatcctcttgcctcagcaccctaagtagttggattacaagtgcatgccaccgtacctggctaatttctgtattttttgcagagacaaggtttcaccactttgcccagtctggtcctggacttgagtgatccgcctgcctcagcctcccaaagtgctgggattataggcacgagccaccacawctgacctgacaattttttaatatctggccttaaatttgtacttttccgttttcaaagaatcctccaaaataaacagtacattacatgaaggaggtgaagcaggctcaactagtccatcccacaagtgaagaaacagtttcagaaaagtcacggaggagcccaagcttcccccagaagtggcgggagaagggtccagcctctgtgtctagtacttgaggtaagaagggacagagaccgggaacctagaatgttctcatcacaatggaacaaaatactaagccctattactgcgagaaccctgattattattattattattattattattattattattattattattttattattttagagacagggtctcgccctgacaccgaggctgcaatacagtggtataatcacagctcaccgaagccttgaactcctgggtccaagtgttcctcccgtctcaacctcccaaatagctgggaccatgggctcgaggtcaaggctgcagtgtgctgtgacggtgccactgcactctagcctgggtgacagtgagaccctcttcagggataaaggactttgagcaaaacctgacttctggttttttttttttttgataaagacagggtgtggctatgttgcctaggctggtcttgaactcctggcctcaagcaatcctcctcctgcctcagcaggggtcaccgtgcccaggtaaaatctgatttcggagcctccttcctgcrttggtcaaatgctgacagtaggagaaacaaacagctccacaaacaggagggcagcatgtccacagctcgtagatcctgagggcgtggctctctcttgcctccacaccctagtactcaacactgagcccagccccacacagatgcccagtaaatgggaataagactgggccatacagagacagatcaggacgcaggctctacgctcaacccgtgggggcaggccagccctgcaaagggctgccccactcatcctcccctcggcagcatgagggccccaggacccctccagcccccgggcttctggcatttgtcactggctctgaagttgcagagctttgtgctggtttatctgtctgagtgccttgtccagttagtaacagttcttaggacacaacagcacctcgaccactgtggtcagaaaacaaggtacgagctggagttgtgggtctacacacacaggcacaacacacagactagtcagcaactgggctgacatctctcaggaaagcctgtcgccgggacccacaactccatagctccacgctcagaacacaaaagtgtaaacagctctattaatagtcttgtggattggccttaagaggcacagtggcctcttggcttttagcgctgcggcaacaaagtatcacaaacttggtgtcttaaacaacagaagtgtattctcccaaagcctgtaatcccagcactttgggaggccgaggtgggaggatcacttgagcccaagggttgggactagcctgggcaacatggcgagaccttgtctctacaaaaaatacaaaaaacattagccaggcatggtggtgggcgtttgtagtcccagctactcgggaggctgagacaggaggatcacttaagcccaggaggtcaaggctgcagtgagctatgatcatgctactgcactccagcctgggcaacagagtgaccctgtcaaaaagaggggaggggaggggaggagaaaggaagaaagaaaggaacaaggaaggtggcccggggcggtggctcatgcctgcaatcccagcactttgggaggctgaggtgggtggatcacgaggtcaggagttcaagaccagcctggccaacatggtgaaaccccgcctctactaaagatacaaaaaattagccaggcgtgctggtgggcgcctgtagtcccagctacccaggaggctgaggcaggagaatcgcttgaacccgggaggtggaggttgcactgagccaagatcccgccactgcactccagcctggcgacagagcaagactcagtttaaaaaaaaaaaaaaaggaacaaggaaggaaagaaagaaaagaagagaagagaaaagaaaagaaagagccaagaaaacaagcaaagcaaagctaagctaagccggaagggaaagggggctgatacgccaggaccaggcaaagcctatgaagctggtcccgagaatggtgacaggatggggttgggcaggaccaggttgcacaatgaattggtgccattattccagaaagtattaactggaggggctttgtaaagttatccactcaggccttgtgttacagatgaggtaaggtctcaagtccagctgtggctgcactgaggaccacaattctctggcctgatcttgccccatcacacactgaccgcagcttgatcacagacgcactggtcagctcctccacattctgagcctcagcactctctctgggagccctcagtccctactggtccagggttcctgctcctaacgggctctcatagatgagagcaacctagcaacggcttgcttcctgctgtgtctttaactctgcactgccacctcagtgaacccagggcctgcaggaggtgasaaacctctccattcttccacaggttccatgaccgacctcagattgaacgttgggatgagcaataaatatgtaattgcataaaataccagataaggccagcacagtggctcacgcctgtaataccagcactttgagaggccgagacaggaggatccctggaggccaggagtttgagaccagcttgggcaacatcatgcgaccccttctctacaaaaacttaagaagttagccaggtgtggtggctcatagtccttgtggtaggctcttcgcctatagtcctagacactcgggaggctgtgatgggagggctggttgagcccaggagttcaaggttacagtgagctatgatggccccaaggcattccagcctaggtggcagtgtcacagaccaagaccctgtctctaaaaawataaaaataaaaataaaaaaacaaacaaacaaaactaaatcattaaaatgttccttaaataattaaaaatccccccatgctgggcgtggtggctcatgcctgtaatcctagcactttgggaggccaaggcaggaggatcacttgaagaaaggagttctagaccagcctgggcgacacagcaagatcccgtctctacaaaaaaaaaataaaattagccaggtgtgatggcacactcctgtggtcccagctatatgggaggctgaggcaggaggatcacgtaagcccaggaggttgaggccacagtgagccatgtttgtgccactgcactccagcctgggtaacagagtgagaccctgtctcaaaaaaataaaaaaataaaaatcccaaaacaaaacctacatgcttacatgttgggaagacaggaccagggccagtaatactgggaacacagaactaattctatctgaggctaccaggaagctgcaataagctgcttggtgagtggccagatacacaggacaccagggaacacrtgtgagcggaacaccaatggccaccgactgcaagtatactgctctggttgtgaggtccctgcatcctgtcccaccaacattctggagatgacttcggagtgtccttcygggtccttggtctgtactcatctgtggctcctggcatccacaactctaaaacctgttggtgcagaccaggtgacctctaaacttcccttctgctctagtgagtcaggatgtaccttccagaaagagggagagagtggagtaggggagacactggctgctgaaagtattttaaatgatgtagatactgacaacctaatattaagtacaactgtatacacagcatgaaaacaaccatgccaagtgtacacacaccttatacacagaggaaaaacaggaagaaggcatgccaagagattaacactagtcatccctgcactgtgggactacagcggctattttattctttatttttcagatattcaaaattgttttataattttttttcttttttaaaaagggcatgtttctttttctctctaaaatcaggctgtggggccaaccctggagacaaaaactatctttcgcagactactgcctttgcaggcttagtttctttcctgggcaaactaggataatagccatgaatcaaatggaataatagatgccagagctcacccgaatgtttcagatgcttgcaaatactattgcacaaaaaaactgttacttatactgctgttgtggtgttatagtttatcatcaaaaaacagacataaacatcatagacaaggacaaagagaagaaagtcaggatttgcgtctttttttgtttgtttttgagacggagtctcgctctgtcgcccaggctggagtgcagtggcacaatctcggctcactgcaagctccgccgcccgggttcatgccattctcctgcctccgcctcccaagtagctgggactacaggcgcccgccaccacgcccagctaattttttgtatttttagtagagatgggttttcaccatgttagccaggatggtctcratctcctgacctcgtgatccgccgccttggcctcccaaagtgctgggattacaggcatgagccaccgcgtccggacccttgtgtccatttttaatttaattttttcagacaaggtctcactttgtcacccaggttggagtgcagtggtgcgatcttggctcactgcaacctctgcctcccaggctcaagtgatcctcccacctaagtctccctagtggctgggagcacgggcacgtgccaccrtgcccggctaattttttgcactttttgtagacagggtttcaccatgttgctcagccttgtctcgaactcctgggctcaggcaatctgcccgccttgcctccgaaagtactgggattacaggcgtgagccactgcacccagcctaggatttgtgtcctttatcagacacgggctgcatttgccattgctcccagcatagagttgaagcgccactagtgaaagacacatgcatgggtgagggctggaagggactctagaacacaatatgagtacacgaccttggacccaagacacacatgtgtgcgtacacacacacaccatacacacccctcagaatgtgtctcccgcacacacacctcaaaacacccctaagaaccaaccggaacatacacactacacaatacacacagaatacacacagcatacacacacccccctcggaatgtgttcccacacacgaacctcaaaatacccctaagagcccacctgaacatacaccacacacacacagaacccaagaactgcaccaacccccctcctcagaacccagtgcctcctcaccatccccccaggacccagtgccctcccaaccccccaggatccagcattcgcttatccccttcagaaccttgcaccctcaccccgcaggacccagagccccctcacctccaccagcacctggtgacgcctcaaaccccccaggacccagcacacctcagcccgtggtgtccccttatcccactcaggacctggtccccctctctcccctaggacccagggtcccctcaccccccagaagctgttgccctatcacccccaggacccgacggccccttacccccaggacctagtgtcccctcaaccccaggacccggcaccccctcaacccccaggacctgatgctcccccaacccctcaggagccggggccccctcacccccaggacccggcaccccctcaactcccaggacctggtgctcccccaacccctcaggacccgaggccaactcaaccccaggacccagtaccccctcaacccctcaggacccggggcccgctcgctcacccacccaggacccggcggccgccacacgcactctcgctcccgcagctcctctggtacccgccctcgtacctggcgcatctgggcctcggcggcgccgccctcctgccttcgcagctgctcccggaagcgcgcaacctgctccagcagcgcgtccactagggacggcgcggcgtccccctccagcgcggccaggcgggcgcggaggcgagcgatgagggcgtcgcgggcagcgagctggtcctgcaggcggcgcagccgctgtccggcctcgtggtacagggtgcagagcgcggcagctgcgcgcggggcctcctcccagccgcccgaccccgggtcccgggacatggctgtaggcccgcccgggaggccgcgcggccgccggcaacttccgcgcccgggccccgccggctgccgcccttcccggaactttccccggtgcgccccgcccacccacaacagcccggccccgccctcccccacgcagccccgccccccgcgcagcgccgcccttccccgcgcagccccgcccgacggcagcccgcccagccccttctcgcccggccccacccctcccaccgcctacagcccggccccgcccctgccgtccgcacccgtccgggagagttggcctggcccccgaggctgtccacaccccagctggtgctgggcttattccagtggccccaaacatccgcctctgaggagttgtcggagagtcgaactcagcccaggagtttggggattcatcagcctctgatggaaaggaagggcttaacgacaacccccaagctctggagctaagtgtgggtctgaatctccccgcgagggtccaggccttgcggccacagcagcaacagaagctccaggagctgagctcgcagcgcaccaagcacgtggcatgtgttccgtcacctggggacactgagcccagaaagagctccaaccccctgccccgcacgccgctttcttttttctttccttttttttcttctttttgagacggagtttcgctctgttgcccaggctggagtgtaatggcgcgatctcggctcactacaacctccgcctcccagtttcaagcgattctcctgcctcagcctcctgagtagctgggattacaggcgcccgccaccatgccctgctaattttttggtattattagtagagatggtgtttcaccatgttggccaggctggtcttgaactcctgacctcaggtagatccaccggcctcagcctcccaaagtgctgggattacaggcgtcagccactgcagacgctgctttgtaaggtggctagtatgggcccacgggacaaccttcctgctagatgctgttcttatatagcagaagcagcaggaaaccagccccttcccaccctttcgcttttccatccctttccttccccaaaattcccagacaaacgctagtgtttttccacagcccagtcttccccacaatgatgcccaagcacacatggggtctttccaaggttccctactcaggatagggcaggggtcttccctgtgtgtgcacttgcccacaggctccgcccctgagcagcttcttgactttcttcccttatgtgatccacagccaagcctgagctgagcctgggaaaacacaagcttgtagaatcagacaagcctataagcaaagccagagccacccaagtgcttatggcccggacattgggctacacaggcctggctttgctatggaaggctccttcttactcatcagagcctgggcttcctctcagcagaaggaagggcagagcgagtgcccaccctacctggttgggctgttgtggggactagagggtggagtgtgcatggaatgcttgtccagtgcagtggctgctgcacagcaagcctacagtccccatggctatggttacaaacaatgcctattgattgtctggggcatgagtggaaaaaacaaaactggacccagagctgttagaggctaatgtgtggcctggggcacgtcattccagtgacctaccttgagcctctgcctcaactgtaaaaggtgcatgtgacaatccacagtctctcatccaacaacagccttggggtcaggtgtggtgtattgtattgtattgtactgtactgtatcgtattgatttattttagacggagtctcaatctgtcgcccaggctggagtgcagtggtgtgatttttggctcattgcaacctccgcctcccaggttcaagtgattctcccacctcagcctcccaattagctgggattacaggcgcccgccaccacgcctggctaattttttgtattttagtagagacggggtttcaccatattggtcaggctggtctcgaactcccggcctcaagtgatccgcctgcctcggcctcccaaagtgctgggattgtaggcgtgagccaccacgccaggccgccatgtgtattttagaaatgaggatctttggatttcaaataggtacatataactgggggagccagctttcaaagaggatcccctccttccaatatccatgctcctgtgtagtcccctccaatccactggagagrgctgacctgggtaactaagagggtactgcagaaatgatggagtgtgacttctgcagctagctcccacaagacatcacggctactgccttgccctctttcggagcattmtctctgggggaagccacccaccctatcatcaagtaaccctgtgaagaggtccatgtggcaaggaactgaggcttcatggcagcagccggcgcccacttgcccactgtggtgaagaagccacttygggactgtatcctccgaccctagtcaagccttcagaagacagtagcccccactgacatactgactgtgactccatggaagaccccgggccaggaccgcccagctaaactgctctgagtccctgaccacagaaactggatgagataatatatgcttattgttttaagctactaacatttgggatagtttgttctgcagcaatggaaaatgaacagctaaaatctgacttagtgctcccactgggacatggtacagcaccacaaaaccagacagattacwatttctgcaaagacagggtgaccattcagactgcgagatgaatgaagatcagaaaaagccttgtagctgttgaagtcagattttgtaccacctttaagaaaaacattttggggccaggtgcagtggctcatgcctgtaatcccagcacttagggaggccaaggcaggaggatctcttgagcccagaagttggagcccagcctgggcaacatagcaaaaccccatctctacaaaaagttaaaagaaactaggtgggtgtgatggtgtgtgccagtagtcccagatactcaggaggctgagataggattgcttgaggcaggggtttgaggctgcagtaaatggtgattgtgccactgctctccagcctgggccacacagtgagaccctgtctctgagaaaaaaaagaaagaaagaaaactattttgggtttctgagctttttagatttcagaattgcggatgagggatcccagacctccaagaacacttgtcttagagggtgttgtaaatattcagtaaggtcacatgggaagtgcccagcatgctcttgccttcaatgcaaatttaggtactgggccaggcactggggactcatgtgtggacattgtaatagtggagacagatccttttccaaaacaagaataattgcaacgtaaggaaattttgtgtaaggaaaggaaggggaaaatgtgtataagaaaacaacaggctgggtgcggtggctcacacctgtaatcccagcactttgggagaccaaggcaggcaggactcctgaggtcaggagttcgagaccactctggccaacatggtgaaaccctgtctctactaaaaatacaaaaattagccaggcatggtggcgggtgcctgtaaccccagctagtcgggaggctgaggcaggagaatcgcttgaacccgggaggcagaggttgcagtgagccaagatagcgccattgcactccatcctgggtgacacagcgagactccctctcaaaaaaaaaaaaaaaaaaaaaaaggaggaacctaactttaaagagggtgattagagacaagataacagtccagctctgcaacctaaagggtgagaaggagccaggcatgagagttggctgagtgagttcacaactgggtatggcctagagttgggcaggagctgatacagggagcaatttctttcttttccttccctccctccctccctccctctttctttccgcattctctttctttgtttctttcgagacagcatttcactctgtcactcaagctggagtgcaatgctgcgatctcagctgcaacctctgcctcctgggttcaagtgattctccttcctcagcctcctgagtagctgggattacaggcacgtgccaccatgcctggttaatttttgtatttttagtagagatggggtttcaccatgttggccaggctggtatcaaactcctgacttcaagtgatctgcctgccttggcctcccaaaatgctgggattacaggcgtgagccaccgcgcccagccagcattcactttctgtgttctgaaactcatctagatttgtgcaggatggggctagtgcagcaggcctagtgtgttcaaccctgcatgttccaaaaaagggactggccctagaccttttggaatatcccacctgataagagtgtctttgcttatgtgggggccttggaccacaccagctagtctaagctaactagaggccttgggtcatgagcttgagctctgaaggagctggagaccgagtaactcaggtcagccatatgggcactccccgcctatgtgatcaacccctaaccacagctctggacacaaagtctcaggtgagcttcccagtttggcaacactcccagtactgttgggagagcgatatcctgtgggtacttgcacctggtctccccgccgggcccgctctatgtgccttatttttcctttgcygattttcttctgtgtccttttgctgtaatgaataactgtgagtccttctactgaatcgtcaaacctgaggactgtcttgacaacagggctttttgcagcaaatgtgtatttgtgctagatggactgttgctcccagctttttaccacctcccgccacgcccttttgccgtgtgactttgggcacctgccctggagtagaccaagtctgtccccacctgctcgaggctgcatggccagtggatatcagcagagatcatgcaagagaaggcctaatgcgagacaccagcaccccagagcagcaaagccctgggtagctactaatcccagaatgggtgggtagagtaaacgtgagccccacccacagatgaagctgctgaggcctgcgtggtccactggccctgctgttttcagacccatctgcacccctttctccggctcactgtagaccagtcattctgaaagagcccatgaaaaacaccaagttctctcctgcctcaggactttgtacctgctgcttcagtgcctggaatactgactccttcccatgaaaaacaccaagttctctcctgcctcaggactttgtacctgctgcttcagtgcctggaatactgactccttcccatgaaaaacaccaagttctctcctgcctcaggactttgtgcctgctgcttcagtgcctggaatactcattccttccattgtttgcacaagcaccgccagggggtggggctcacagaggcgcactgcggcaggaactggatgtgggtgtcaaggtggtcacagaacagacggctgggtcagctccccaaggagaagccctgagctgcccaacaggtccctcttaggccccacacttcagaggcagggctgccacgcatgcctcctggatcacctcttggtgtcccatggcccctgtggggctcctacctggcacatcctcacctccaggctcccccggctccaactcagcagggaggtgggaggttgacgggagcaggcaggcatgggagggctcagccggggtatgaggggtgggcagagtccccccacctggctcaccctttctcttcctctcctcctctgggcaccttctttgactcccacaggctcctagctcagacctctccactcttcctggctttcyttcagggaggtcaggaaagtcagggacccgtggataaagaccaggagaacacaatgtaagtatctgggmaaagaacctcytaggcagagggcttggcgagtgcagagccccagggaccygtgcagggcctgatcaagacccttggaggagtccaggggtggctagagtgcagcaagcaggggagggactggagtagccatagaagggaccaggacagactgagccccaaacgtcccccttgcctggcccagcccatgtgtttccrgtattggtgggttcttggtctcactgacttcaagaatgaagctgtggaccctggcaatgagtgttacagctcttaaaggcagcgtgtccggagtttgttccttctgatgttcagatgtgttcggagttttttccttctggtggggttcgtggtctcactggctcaggagtgaagctgcggaccttcgcggtgagtgtcacaactcttaaggtggtgcgtctggagttgttcgttcctcccggtgggttcgcggtctcactggcttcaagagtgaagctgcagaccttcaacaaatgagtgttacagctcgtaaacacggtgtggacccaaagactaaaagaacaaagcttccacaatgtggtaagggtaccccagcgggttgccgctcctggctcgggcagccttcttttattctcttrtctgrccccacccacatcctgctgattggtagagccgagtggtctgttttcacagggtgctgattggtgtgtttacaatccctgagctagacacaaaggttcttcacgtccccgccagattagctagatacattgtcgattggtgcattcacaaaccctgagctagacacagggtgctgattggtgtgtttaygaaccttgagctagatacagagtaccgattggtgaatttacaatcccttagctagacataaaggttctccacgtccccaccagactcaggagcccagctggcttcacccagtgaatgtggagctgcctgccagtcccgcaccgtgcacccgcactcctcagcccttgggtggttgatgggactaggcgccgtggagcgggggcggcgctcgtcagggaggctcgggctgcacaggagcccacggaggagcgggggaggctcaggcatggcgggctgcaggttccgagccccgccccgcgggaakgcagctaaggcccggcgagaaattgagcacagcagctgctggcccaggtgctaagcccctcactgcctgkggccggtggggccggctggctgctccgagtgcagggtccgccgagcccacgaaccccaccagaaggaagaaactctgaacacgtccgaacatcagaaggaacaaactccagacacaccgcctttaagaactgtaacaccgcgagggtccgcggcttcattcctgaagtcagtgagatcaagaacccaccaattccggacacacatggggatgctaggccaaaacccgtaagagccggccggcctccaggaggggcaggggtcttcccctacacaggggtcccggctcagggccgctgcccttccccgcagctccagtgccccgggaccttgggaaatcatcctgctctttgtcctgacctgagccaatgcatttgccttgtcgagcccttaggagcagaaaagcgtaggcgagcagctggcagccaccatcgcatttgctcccggaaggcaagaggaggcagagaaaattccagaacccatttaagcgtctgggaccctgaggtaaccatgagctactggcaggccgggggacacagcgggtacagaaggggtctctggagtttcgtgaggaagtattcgggctgtgcggcgccgcgaccytggcaggacgctgctgtcccgccagcgraagcggggcgcgctcagggctgcgggcagcgggggtgcagcggggagagccagggcctgggcgcggaggaggggctggtatgggaccctccgggtgggcgcggccccgcggggycttgcggccacaccgccaccgtgcccagcggccccatcagcgcatattcaggatgaaccccggacacgcgcccagaaccgtctggtgacccagtgatgaaagctcgaatcttataggatccgtattcatttcccgtgggctcaagcccagcctccgcgggcggcgcgggccctcgcggcgagtgtccacgaggaggcggtgtggacccgcggccccagaccaggcctcaggcagaaggcgagcgcgagcgccccgcccagcccctccccgtcccgcaacccgygccccgaccagcgcccccagcacctctccaccctcgctctcgagcagtctccacgtttgtctcagaggagacccactttgctccccagcgtgggcccctgagcgctgggggaagttggttggtttgttaatgacagagtctcgctctgttgcccaggctggagtgcaatggtgcaatctcrgctcactgcaacctccgtctcccgggttcaagcgattctcctgcctcagcctcccgagtagctggaattacagtgcacgccactacgcccgrctaatttttgtatttttagcagtgacggggttttgcyatgttggccaggctggtcttttttttttttttttaaactagatgtttcctttattcattcacacacttaagtaacatagacttataatttgtaacaaatagaacagaggttacacatataagacaaaaatcttgagtttgaaaactttattatctggctgttttgtcaacatgataatttcatatacaaccacgtaaaaacatctctggtgtttagatttttccgtttattctagctgtttcatatttgtagacgtagccatggcatgtacagaatatgcatagcaacaggactttcatataatatagtacagttggaaaaaaacactatcttgctagggagatatgtcaagtagattctagtttccacattattttgattttactgtatttaactttgtatatattttacatgtattaaatgttttgatgaaacatttcaaactctatattagaaatgttggcaaacattagtatctataaaatataatctgtatatattgtataatctggatataaaatatccagaaatctgtcatatttttataccaattacaatggtcaaagttgacactattcttaaatatacttaatgattatctggattatctccatatctatttttggccctcttttgccatccatacgtgaagtataatgatccttattctttatggcattttttttttttttttgacggagtctggctctgtcacccaggccagagtgtgcagtggcgkgatctyggctcactgcaagctccacctcctgggttcacgctattctcctgcctcagcctcctgagtagctgggactacaggcgcccgccactacacccggctaattttttgtatttttagtagagacggggtttcagcacgttagccaggatggtcccgatctcctgacctcgtgatctgcccgccttggcctcccaaagtgctgggattacaggcatgagccaccgcgcctggcccctatttttattttttgagacaaggtctggctttgtcgcccacactggagggagtggtgtcatctcggcttactgcaacctctacctcccaggatcaagcaatcctcccacctcagcctcctgagtagctgggactacaggtgtgttccacgacaccaggctaatttttgtattttttatagagatggcggcgggggtggggtgcacctcactatgttgcccaggctggtcttkaactcctgggctcaagtgatcctcctgcctcagcctcctaaagtgctgggattacaggtgtgagccaccgcctggcctccgtaattcttttacttcctcaatgctaggcctcagagagcatcccggccaccctatgggagaaaactttgttctgaatccccttagctcagtcgtcctgtgcagccaggtcaagcacagctcatgcctcctggactagcggggtttggagaacttgctccttttcctggagggccaagagggatggcagtgctatggcaggggccagggcagtgttaacaggacctctgagcacagatgcacagagggtcaaggagggagatttctggggaaagagcattccaggccgagggaacagcccatggagaggcccagaggcaggggtgtgtttgccagtgcaggaaacaaggagactcttgtggctgaagcagacgtagtggaggaggagggactagggccgaggtcatggcggctttgtagaccaccgtgggaactctggcttttctttggagcaaaatgggagccttgtaggattcttggggagaggaaatccagaaaagaagcaatggtggtagcttgtccccaagcagtggtcttggagatggtgagaacccaccaggttctgggggggcttctgaagtggagcgaggaattcctaataacgacagaatcarcataatcatgacccccgcccccagacttccacatcctaatccccagaatttgtaaatgtgttaccttccatggcaagggggaataaaggcagcagatgaattgaagttgctaatcagttacccttaaaatagggagctttccctgggtcagcaggtgatcccaatgtcatcacagggtccttcaacgtggaagagggaggcggaagagaaggccagagtaacgcagtgtgagaaggatttgacccagtgttgctgactttgagcctggaggaaggggccacgagccagggaatgccggtggcctctaggaggtggaaacrgccaagaatggattctcccctagagccccagaaagaatgtggccctgccaacaccttgactttagctcagggagacccctgtctcagacttctgacctccggaagtatcagagaataactctgtgttgttttaagccactgagtttgaaataattttttcctgcaaccacaggaaactcatacagactggggtgaggtagggttagggaaaatcaaagaggacctgaagaccttggcctgagcagtggggaggatggatctgccctcatctggggcaggaaggctgaggctggggatggggcatttgagagagcttgggacatcgtaagcagtgacctgattggtttcagcacccccagggtctggcacagtgctgcacaggggagggccctcaggtgactgtggaataaatgaatgaatgtatgatgcatgcatgaatgaatgtttagctgctcagtaaatatatgtggtatgcatgcgtgagtaagtggaagaggctgagctgtgaccccaatatcaggggttgctgggggtggggtgccaggagagggttggtcacagccataccccttgcctgtcttcagaccagctctgggggagcagcccagtggaggtgtggctgccccacctgctgccttsccccagccagccccctagcccagtcctgcaggcccctgtctgcctgtgatacagactatatccccgggagccctttcacaaacgccatttttctccatcttgccccatttcccaatcatagttagggccgggacatcttcccagatgccctggccccagagagaggcttctggaagccttcctatgggagcagagggaccttaggatttggacagccctgccttgggccaaggagccagctctcagaccctcggcctcttccgcgagccccttaggagtgaggggtcagcagagcagggctttcccagccagcatcccaaggacrtgggaggagtgacaacccaggggcacttgtcggcctggcgtctctgacaaactccagtgatgggtgggtgtggcacacggcagctgaggacagacgagcacagcaagaagccygcacagccccggagtgggagggcctggcgtgtggcctgcaggctctggtggccttcacagatctttcctctctgtagccttgatgtttgcgtctgttcaatgaaaattagccacagcttacttttgtcgtgtattaaagacatttgtagcaaacacccatgatagctggcgtgtgccatgctctctgctgctcccaggccacctcatctggatgagggtgatgtgcccgtacggtagaggtgatgccacctatgagggtgatgcccagtagagccctgagctgcacagcccctgggctaggaggtgagggtggctcttgggtctttggtggctcccattccttgtcagagccattttcctcctcccagaagccgtcttctggcctccttcctgttcaaccccagcccctccacacaccgagcggggtgtctgtatttcatccccacggagccttcatctcagctgccagtgagggytcmggtgccatctgaggcgtctgctgatagccaaggtgttaccactcaactccggtgttgggtgatggctacagcgcagtctgcaaattaagatgtttgatggtaaagagttacttataacaaagaggtttttgaagacagaaactgccgaggaagacgaaccccaggagagatgctcttgggggcgagttacatacctggcagctcccggcaggctcctccccaagttgaaaagtcccttcaggtgggaagagcccagggaaaaatgtagtcctcactgaacagctgagaaactggggctcagaaggaaggaccaactgcagccttggtggtccccaggatagagggcagggctccccatgcccccagacccaggccctcatattccccaccaaaggctcaggaatgtgtggctccatgtaggagtgtgggtgaaggggagctgaacataagcaggatggctagaaacgggcagggaaccagatcccctccccccacagcctccacccacagctgggcttctgggcttcccccgccaggccagacaccagtggcttcttccctggcgtggagcagacggagggtctcyggatgcgggggaatatcaggctcagcggggctgaggtttcatgctgaaggtgggaggatgtgatgcacatttacatgatgccaagaccccagcgccgtcccatccacccacccgcagtgctcagaacgccggcagccagacctctcccctctatgcagggtgtcacagggtgtccagggaacctgatcggcagatcacacgggcggtttcctgccaggtcactgcttaccagtccttactctccagcctgagaagccagccgggatgaccagacatctgagagattcctctgatgtggaagagagagacaaaacaaacagaaaaaggacaactggaaggaaacagagactgttytgcgagaagacagcttggaaaaaactgtcattaatatattcaagaaggaaagataaaattttgtatttatgaaaaaagaactaggtgccataaagaaagaacatttggagaatataaagagcacttggaaattaaaaataggatcatggaaattgaaaactcagtagaagagttggaagataagattgaggaaattttatagaaattagagcaaaaagttgaaaataaagcccttgcagtggtgcatgcctgtcgtccaagctactcaggagaccagggtgggaggatcacttgagtccagaagttcgagaccagcctgtgcaacatagcaagaycctgtctcaaaaaaaaaaaaaaaaaaaaaagttgaaaaagaaaaaagttgaaaatgagagaaaaaaaggaattgaaggaccagtctgggacacttaacatctacataatatgtctagatagggagaacaaggaggggagaaaatcatcaaagaaacaatccaaaaacatttcacagaaattaaactcagccaggcacagtggctcacgcctgtaatcccagtactttgggaggccgaggcgggcggatcacctgaggtcaggagtttgagaccagcctggccaacgtggtgaaaccccgtctctactaaaaatacaaaaattagccagacatggtggtaatcccagctactcaggaggtcgaggtgggagaattgcttgaacctgggaggcagaggttgcagtgagccgagatcatctcagtgcacttcagcctgggcaacagagggagactctatctcagaaaaaagaaaaaaaaaaagaaattaaactcaagtttctggattgaaaggacctgttgagtgcttagaaccaagaatgaaagcagatgtgtacttaaggcacatcaaagggagtttcagaacatgggagacaaagagaagatcctgtaaatatccagagagaaacaacaggtcctggccagcagtggtggctcacgcttgtaatcccagaactttgggaggcctaggcgggcagatcacttgaggccaggagttcgagaccagcctggctaacatggcgaaactctgtctctactaaaaatacaaaaaattagccaggcawggtggtgggcgcctataatcccagctacctgggacgctgaggcaggagaatcgcttgaacctgggaggtggaggttgcggtgagctgagatcgccccgttgtactccagcctgggagacaaaagtgaaactccgtctcaaaaacagaaaagcagtaggtcctgtacaactggccaggatcagaatggcttctgacttcgcaacaacacaactagatggttgaagtcaatgaatgaaagctctcaaaattctgaagttggatgatttctaacctcaatttttatatttagccaaactattcatcatgagtgagggtagaagagagaatttcagaatgataagccttcaaaaaatgtacatccctggcccctttctcaggaagtgactccagggtatgctctgtcaaagagagagtaaaccaagaaagaggaagtggtgggatccaggaagcgggatcctacataagacagaagggcgaaagaatgctggtgaagggaggccccagggtgaaggctatgcccccagctcacaaaacagagtctactttgagttggcagaatatctgacatactgaaatgctttgggggagactgggacatttggcagaatttggagttgaattagtaataaaaaaaagtaagcaaaattagaaagacagcatttattaactccagaggaaacaagaagttaagcagggaaggaaaagttatgatggcccattacatagctcaggtatgaaagagttcatgctgtcccctcacaatgtcaactgtgactcttgacctaaatcaaagatgatatagtgatactggaggtcaggaagtagcaatttaagtgtgcttttcagggatatgaagatgaaaccmaaagaatgagctgcaagttgaaggcagttgcctccagagatgtgagtacaggggactgctgtattttgtaagcagccttgtaaaactatgtagctgtttaaattatgtgcatgtggctgggtgtggtggctcatgcctgtaatcccagcactctgggaagccaagacgggaggattgcttgagcccaggagttcgagacatgcctgggcaagatggcaagaccccacctctacaaaaaaatctgctgagcgtggtggtacacacctgtagtcccagccacttgagaggctgaggtgggaggatcgcttaagcccaggaatttgaggtggcagtcagctatgactgtgccactacactctagcctgggtagcaaagtgagactctgtcyctcttaaaaaaaaaagaagaagaagaaaaaagaaaatgtgcatgtataactctgatgaaaagtaaaaactaaattcgaaacacactcatgacttacataccgttttcccttgttggtaagtcagcgggatttgaacttgtgcctcgggatcgacagatttctgtgtagtactagagcatgtccctgttgtcacagggccacctggcacccccccaagtgtggtattgacagggaaaagagcattttaccaattcaggtctgtgcataccggcaagggagcacctctcagcagcctcctgcactggagaatgcagggagggagcagggttgctgctgggggctcccgtcatgctgcagtgggggctgtatgacagcacacccctatcctgctaacaccgggccaggtagagtgtgccactgggggattctcaatgactgatcttttgttttgagatggaatcttgctctgtcgctcaggctggagtgcagtggcatgatctcggctcactgcaacctccgcctccctggctcaagggattctcctgcctcagcctcccgagtagctgggattacaagtacctgccaccacacccagctaatttttgtatttttagtagagacgtggtttccccatgttggccacgctgatctcgaactcctgacctcaggtgatccacccacctcgacctcccaaagtgctgggattacaggcgtgagccactgcacctggcccgactgatcttataataagcacacacgttaatgtgtagtaataaaatgctgcttttacctgccattatagatggtggtgacactaagttttatcttcaatgagcaaaaatgctcatttgtatttatttaattactagtgaagtagaacattgtcttagtctattttgtggtgctgtaacagaatactcaagactgggtcatctgggtcatttatagaacagatttctttcttttctttttttttttttttttttttgagatggagtcttcctctgctgccaggctggagtgtggtggcgggatctcggctcattgcaacctccgcctcctgggttcaagcgagtctcctgcctcagtctcccatgtagctgggagtacaggcgcctgccaccccacccagctaattttttgtatttttagtagagacggggtttcactgtgttaaccaggatggtctcgatctcctgacctcgtgatccgcccgcctcggcctcccaaagtgctgggattacaggcgtgagccaccgcaccaggctagaacagatttgtttcttccagttctggagtccaggaagcccaaggtctaggaactcacactgggacaagggcctccttgctgcatgatcccatggaggaaggtagaagggcaacagggcatgccccagagagagagagaagggaaggaggccaaactcatccttttattaggaacccactcccatgagaacccgcgtcagctagaatggcattaatgcattcatgagggcttggcttattaaaagtcccacctttcaacactggagcactggggactaaatttctaatacatgaactttgagggacacattcaaaccctaacaaacatgtttatttattcatttattttttgagacagggtctcacttcatcacccaggctggagtgaagtgtcaccgttgtaaatcattacagccttgaactcctgggctcaagtgatcctcctgcttcagccttctgagtagctgggattataggtgggcaccacygtgcccagctaacttatttttattttttagtagagcaggggtcttgctatgttgtccaggttggtttgaactcctggcctcaagcaatcctcccacctccacctcccaaagtgctgggattataggtgtgagccagcgtgccctgccagggattgattgattgattggttgattgatttttagtgacagggtcttgctctgtcacccaggctgtagtgcagtggtgtgatcacagctcactgcagcctcaacatctcgggctcaaacgatcctcctgcctcagcctcctgagtcataaggttttaaactatgggcattttaagttttgtcattcacacataattaattgtttactctggcactttcctgagcaactataagcctaaagtgtttcattgtcaaagagtgaccaagggaagctacccactagggctcatggtaccactgatctcttgcagcaactggggtcatcggcaagttctcattcaagttccgagctctacaaatttgtgttttaaactctccaggtttaggcgaggcgcggtggctcacgcctgtaatcccagcactttgggaggccgaggcgggaggatcacgacatcaggagatcgagaccatcctggctaacgcrgtgaaaccctgtctatactaaaaatagaaaaaaattacctgggtgtggtggcggacacctgtagtcccagctacttgggaggctgaggcaggagaatggcgtgarcccaggaggcagagcttkcagtgagccgagatcgcgccactgcactccagcctgggcgacagagygagactccgtctcaaaaaaaaaacaaaaaaactctccaagtttatttgagcaattagtagactggactgggtcctggatcaaattggatcaaattggttctgataattcactggactggattcagctggaggcctcagataggtacttttttttttttttttttgagacagagtctcattcagttgcccaggctggagtgcagtggtgtgatctgggctcaccrtgacctccgcctcccgggttcaagcaattctctgcctcagcctcccgagtagctgggattacaggcatgtgccaccacgcctggctaatttttgtatttttagtagagatggggtttcaccatcttggctaggctggtctagaactcttgacctcgtgatccacccgcctcggcctcccaaagtgctgggattacaggtgtgagccaccgcatccggcccaccttttttgatggtgggtttgtttcaattcaaggagtctgtgaaaactgaaattggcaaaactaacataatcaattggagtgtcttggctaaagatattactgattggcagacatcagatccactcccactagaaaacagattgatcccttataaaatagttactggaaggcccatacctttaataacagagcttcacctgtctcctctctcctaaactctgatatgactaaatactgcaagactttttttttttttttttttgagatggagtctcrctctgtcgccaggctggagtgcagtggcgcgatctcggctcactgcaacctccgcctcccgggttcaagggattctcctgcctcagcctccygagtatctgggactacgtgtgtgcaccaccatgyccagctaatttttttttttatttttagtagagacgggatttcaccatgttggccaggatggtctcgatctcttgacctcgtgatccgcccacctcagcctcccaaagtgctgggattacaggcgtgagccaccgcgcccggccaatactgcaagagtttaatgcattgtgacaaagtgtactttcaccattgactgaggacaatcaaacctttcacagtctagaacctggagatttggtcttctggaaacgacatcagagagagactgcccttgaaccccattggaagagaccctaccaagttcttctcaccacccacacggcagtaaaacttcaaggcctcaaactttggattcacatctcataagtcaaaagggcccctccaggctcctggaaccgtatacgtgttggagacctcaacggaaagctgacaagggaggtttttcttcagatgcaggtgggatcctggatgtgggcggctttcccaaggtcacaaatccagacttctctgtcwtcacgaaagccttttattttttcctttttttatttcctgttgtcttagtcccttccctttccttacaggagaatccactggaccataatctgtggatggctttagtacaggcttatgctctagcaagaaaccagataaattgttgagtctgtgggctaatgccccccaaatgaggaaacaattccactgatgccagtgcctctccatattccgaataagtcaccctgggccgggtgcggtggctcacgcctgtaacccaagcactttgggaggccaaggcgggtggatcatctgaggtcaggagtttgagactagcctggggaacatggtaaaaccccgtctctattaaaaatacaaaaattagccaggcatggtggtgtgtgcctgcagtcccagctactcaggaggctgaggcaggagaattgctcgaacccaggaggcggaggttgcagtgagccaagatcacgccactgcactccagcctgggcaacagagggagactctgcctcaagaaaaaaaaaaaaraaaggcaccctgaaaccccagagcagcgtggaaagctatccttgatttttttttttttttttaagagacaggatcttgctgtgttgcccataatggagtcagtggcatgatttcagctcactgcaaccttggcctcctgggttcagatgatcctctcacctcagcctcccaattatctgggactacagtggtgcaccaccaagcccggctaattttttgtaaagacagggtcttgttgcccaggctggtctcgaactcctgggctcaaacaatccacccaccttggcctcccaatgtgctgggattacaggcgtgatccaccgtgactgttctatccttgatattccagacatcattgctaatgcttttctttagttttcttttgagatggagtcttgctctatcacccaggttgaagtgcagtggcatgatctcggctcactgcaaccttcgcctcccaggttcaagtgattctcctgcttcagcctccgagtagctgggattataggcatgtgccaccacacccggctaatttttatattttcastagagatggggttttgccatattggccaggctgatctcaaactcctgacctcaagtgatccacccgccttggcctcccaaagtgctgggattacaggtgtgagccaccaygcctggcctgctaatgcttttctgtactcactggaaatagcaccctgtcctttccagttactaaccgaatcagatatagaagccctatccaaatgaggcctacaaaaggtacattgtgcttccaggcatcatgtattcaagacctggggaccacctatgtgggtacaagtaattccctgtatgatgtcactggttaagtcatggaaggtctcttttttctttttctttttcttttttttttttgagacggagtcttgctctgtcacccaggctggagtgcagtggccccatctccgctctctgcaagctccgcctcccaggttcatgccattctcttgcctcagcctcccgagtagctgggactacagatgcctgctacgacacccggctaattttttatatttttaacagagacggggtttcgccatgctagccaggatgatctcgatctcctgacctcgtgatccacccgtctcagcctcccaaagtgctgggattacaggcgtgagccaccacgcccggctcctgtctaatttttataccaaagaagtgaaattatgtcatttttgaactttaaggaaactaatatcttaaaggattaattaggtcagaaaaacacataatttatcattggattttggaaggtttgtcaaatatcaaatctttaaaacaatcgatatcacaaaataggatcacagatcattgtaaaataagtcattcatttaacccaagtgataacgcaaggatttcaaaaaaaggtgaaaaccttcattctttgagagaggagatttaattttccaaacaataagtcctactaaaaacagtatgaagccgattaaatttgtttttctttttagtttttcttttttttttttttgagacggagtttccctctgtcacccaggctagagtgcagtggcacaggctcagctcactgcaacctctgccccctgggttcaagcaattctcttgtctcagcttcctgagttgctgggactataggttcatgccaccacactcagctaatttttgtatttttagtagagacagggttttgccatgttggccagactggtctcaaactcctgacctcaggcgatccatctgccttggcctcccaaagtgctgggattacgggtgtgagccaccacgccaggacttaaatttgtttttcaaaattttataaacaatctataaaatgttaatcttgaccatcagatataacctccataagccttttataacctttataacctttattaaggagtccgttaatgcttcaaaaaaatcttgttaatctgacacaggggctcatatgctggtcttgcatcagtgtgcctttgacatttatgattaatttatagagaaactgaatgtattttatctttcaaaaatcagcccttacaatctcacacacccacctcttcggcgatagtccctgggccttaaggagttgagtagctttgatttctggccctgtgtcttaggaatgcagtttattctgaatggcaacttctaccgggcctgaagatgaggctttactgtcagtatttaagatttggcaggacctggtgtcttttttagacccagcatcattgtctggggtaaatacccgagattcgttgtctcatggccacggaaaaccaggacttggcacaccagagtgaggttaagagcagaaatttaataggcgaaagaaagagaaaagacctctgcagagagaggggtcccggagaacatgagttgccacctccactgtgaagtgaaagaggttttatagatgggcttgaggaagcggtgtttgatttccatagggcacaaaagattggtcggaccaggtgtggcatttgcatagtgcatgaaaatctggccacccccactctaatcttttattatgcagatgggttttctacctggctggtaccatgtcgccagcttctttacagtacacgtggtgacaaagaawagggaagatggagcctccgtgttgaacatacctggctcccaggtagcccttttctrttggcacagctgctggcattcacccgtgcaagctgccagcttgcttatctatgtttgcagctcgatttttcaggctgctttttgttagaaaagaaatgatttgggggttgcttttctttctattctttttttttttttttgagatggagtttctctcttgttgctcagactggcatgcagtggtgaggtctcggctcactgcaacctctgcctcccaggttcaagcgattctcttgtctcagcctcccaaatagctgggattacaggtgtgtgccacaatactcagctaatttttgyatttttagtagagatggggttttaccatgttggtcaggctggtctctaactcctgacctcaggtgatccacccacctcagcctcccaaagtgctgggattacaggcatgagccaccacgcctagccaagagggctgcttttttgttaaaagggaaatttcactatggattctgttgtccctactatctgcctaaataatttctttttagctcctgcatcaccaggagttacagccctgtgactcaatgtcacaaggactgttaaagcacatatagaaagatacgggaatgtaacaactttaatttaaaacctttgttttaaatgaggttcaagcrattctcatgcctcagtctcccaagtagctgggattacaggcatctgccaccacgctggctaagttttgtatttttagtagagacggggtttcaccatgttggccaggctggtctcgaacccctgacctcatgatccgcctgcctcggcctcccaaagtgctgagattacaggcgtgagccaccacacctggccttaaaaaacaactatttttttaaaacaaatgtttttaaacacttaaattcctaagtgtctaaactacgctcttccttaaaaacacaagagtaggcccagagcagtggctcatgcctgtaatcccagtgctttgggaggctgaggtgggtggatcacttgaggtcaggagtttgagactggcctggccaacatggtgaaaccctgtctctactaaaaatacaaaaatcagccgaacatggtggcatacgcctgtagtcccagctgcttgggaggctgaggcaagagaatcacttgaacctgggaggcggaggttgcagtgagccaaaaatcacaccactgcactccaacctgggcaacagaacaagactccatctcaaaaacaaaaacaaaaaccaagagtagcctctgttgcaataactattttagtaaaaaaatcaagtgaaaaaaattttgctcaaaaataaaataaaagggtcaggcatggtggctcacgcctgtaatcccagcactttggaaggccgaggcaggcagatcataaggtcgggagatcgagaccatcctggctaacacagtgaaaccctgtctctaccaaaaatacaaaaaattagccgagtgtggtggcgggcacctgtagtcccagctacatgggaggctgaggcaggagaatgacgtgaacccgggaggcagagcttgcagtgagccaagattgcaccactgcactccagcctgggtgacagagcgagatcccgtctcaagaaaaaaaaaawaataataaaataaaaaagacaaggtcctaggagagaaaaacaaaaacatgaaggccttttaaatacaaacacgcacacatacacacccgcacatatgcacacatacacacatatatcttggatgttagccttttacttaagctgacttttaaccaytgagctccttaaaaaatcctttaaaatctcattaccatattttagctaggacaaagtgctgctatttcagaagtaccaagtatcaaaccagaaagggcttgatttaggaaccaaacccaggctgtcatggtgaaaaaaaaaaaaaatgcaggaccttaggtatagaactgcagggtggggtgacagccattgctctttcagtttggcatggctcgcaacaagctagccttgttatgtaaataaaaccccttaagtagtcaaaatcaaaaaagtttccttttttggccgggtgcagtggctcacgtttgtaatcccagcactttgagaggccgaggcgggcagatcacctgaggccaggagttcaagaccagcctggccaacatggtgaaaccccatctctactaaaaatacaaaaattagccgggcgtggtggcgcacgcctgtaatcccagctactcgggaagctgaggcaggagaatcgcttgaacctagtaggcggaagttgcactgaactgagattatgtgtctcaaaacaaaaaacgaaaaaaaacttcccttcttttttttccccctttttttctggccatttttctccccccagcacaccacgtgtgtgtgtgtgtgtgtgtgtgtgtgtgtgtgtgtgtggtaatttagccactttagaggccttgttccccataatttggaacttycctttggattggatcaagtcagatacagttggtcaaacccaatgggaaaaagactgaaacaacaacaaaaacagaaacaaacaaagaacaacaacaacaaaaaacagttaaacaaaacaaatgatcacacagcttatatgattactgagtgttctaatgataaggagaaattaagaccagctggttgttaatcttaactttagccragacaaatgccaattcagttacttacccagggatgggtctcaggctgtagatttctctctaccatmctagaagcaggaaaaaactcaccttccctgttggaagcaagctcaaactccataagggagttacctgccttccatcatcatggaaacaggaaatcttgccttccctgttggaagcaagwaaaactccaaaaaaagaggagtcatacagcaaaataacctctaaatcttgaccaaatttggggagatgagggattctctggagggggtgctctcggacttcagcaaattgtcctattggtttgagccataaagttagctccttccagtaccaagcaccaataggagatttgtcaaaagtcagaggcatctccactcagaatccccccatggttaccaaaatgtgaacgctgaaaacctgagacaggtctcagttaatttcgaacgtttattttgccaaggttgaggatgcatgcccgtgacacagcctcgggaggtcttcatgacatgtgcccaaggtggttggagcacagtttggttttatgcattctagggagacatgagacatcaatcaacatatacaagatgaacattggttccatctggaaaggcgggacaactggaagcaaacccggggagactcgaagcggggagrggcttccaggtcatacataggtagataggagacaagtgatcgcattcttttgagtgtctgatgagcctctccaaaggaggcaatcagagatgcacttatgtcagtgagcagaggggtgactttgaatttaataggaggcagattggccctaaccagttcccagctcaacttttccctttagcttagtgatttgggggccccaagatttattttcttttcatagaatgtacattctgcagttgttgggtagaatgttctgtgaatatctgttaagtatatttgttttatggtatactttaagtctattgtttctttgttgactttctgtcttgataacctgtttagtgttgtcagtggagtactgaagtcccccactgttcctgtgttgccctctatctcatttcttaggtctagtagtaactattttataaagttttttataaatttgggagctccagtrttaggggcatatatatttacaattgtgatcctgttggactagtccttttagcattatataatgaccctctttgtctttttttaactgttgttgctttaaagtttgttttgtctaagaatagctactcctgcttgcttttggtatccctttgcatggaatatctttttccacccctttaccttaagtttatgtgagtctttatgtgtcagatgagtctcttgaagacagcagattcttgtttggtgaattcatatccattctgccattctgtatcttttaggtggagcattgaggccatttacattcaatgtcagtattgagatatgaagtactgttctattcatcatgctatttgttgyctgaataccttgggttttttttcattgtgttgttgttttataggtcctgtgagatttatgctttaaggaaattgtattttggtgtgatttgaggatttgtttcaagatttagagctccttttagcaattgtgtagtgctggctttgtagtggtgaattctctcagcatttgtttgtctgaaaaagacatctttgtcttttttgtcttaaaaagtatctttccttcatttatgacactggatacaaaattcttggctgataattcttttgtttaaagaggctaaagataggaccccaatcccttctagcttgtagggtttctgctgagaaatytgctgtttatctgataggttttcctttatagattacctggtgcttttgcctcacagctcttaagactcttcccttcgtcttgactttagataacctgatgactgtatgtttaggtgatgatctttttgcaatgaatttctcaggtgttctttgagcttcttgtatttggatgtctaggtctctagcaaggccaggggagttttactcaattattccctcaaatatgttttcaaaacttttagatttctcttcttctcaggaacactaattattcttaggtttggtcatttaacataatcccaaacttcttggaggctttgttcttttttaaaaattctttgtttttgtctttgttggattgggttaattcaaaagccttgtcttcaagctgtgaagttttttcttctgcttgtttgattctattgctgagactttccagtgcattttgcaattctctaagtgtgcccttcatttccagaagttgtgatagtwtttttttaattcatgttatctatttcactggagatttttccattcataccctgtatcatgttttcgatttctttaagttggatttcccctttctctggtgcctccttgattagcttaagagtcgaccttctgaattctttttctggcaattcagagatttcgtcttggtttggatccattgctggtgagctagtgtaatcttttgcagatgttaaagaaccttgtttcgtcatattaccagaattgttttcctggttctttctcatttgggtagactatgtcagagggaagatctgggactcaagggctgctgttgagattcttttgtcccacaggggtgctccctggatgtggtgctctcccctttcccccagggatagggcgttctgatagccaaactgtagtgattgttctttatcttctggatctagccacccagtagagctaccagactctggactggtactggggagtgtcttcaaggagtcctgggatgtgatctgtcttcaggtctctcagctgyggataccagtacctgctccagtggaggtagcaggggagtgaagtggacttggtgagggtccttggttgtatttttgttaggtgcactgcttttgtgttggttggcctccagccgggaggtggtactttcaagagcccatcagcagtggtaggatcaggtggtggatagggccacagagctcccaagaaactatgtcctttgtcttcagagttcctcagctgtcccatggagcctgcagyggcaatccacctccttcaaaggagtctgtggattctctcagctttcctggtatattcctgcagtagttcttggagcaaaagttcatgatgtgggtctccacatgcttctctgtccatccaagcgagagctgcaagttagtcctgcctcctatccgccatctccccacaattgtggttctttttttttttttttttttctcctgagayggagtctctctctgttgccaggctggagtgcagtggcaaaatcttggctcactgcaacctccactcctgggttccagcgattcttctgcctcagcctcccgagtagctgggattacagacatgtgccaccatgccaggctacttttgtatttttagtagacatggcatttcaccatgttggccaggctggtcttgaactcctgacctctggtgatccacccgcctcggcctcccaaagtgctgggattacaggcgtaagccaccacgcccgtccaactgtagttctaaatcaccatcatgttccaaagaaagactgaccaacgggacttgaatgctgtagaacagtcttcattgcctgaactttgaattgttcggttttgatccgtttggttcaccgagcctcctgttaaggagtgtgcttcagtttcttgtatcatcctcccaaaagccgtcagaacagtctctctgatacgctgtcccctcaagtgtcttaaatgcttgtatgcagccatccttagtacatcaaatggtctcatcacagttagaggaacaaaacatgaagaaaacatcatcatccaactaacttgacacggtgaatatgaatttcacactgagaccaaacaaatccattatgatggtgacagaaagtgacgccagtgcccaaggtttcagtcaatctctcaaaattgagaggctgcctaaaagaggcaaaggttaaattaacttaaatttggcctaaagctgcctcagcatatggcaaaccctaacctgccttaatctgtaaataaactgcagcctgggagtatactcaagctgcagtttgtttacagattaagtcaggttagggtttgctatagtcacaggactctttggaagaagtcactgagtctcggcccatcagagcagctgagctttcagccagtcacaggctgcaaactactcaggcaggttcaaagaaggcaagcacccagttgtagccaatcagacgatttctgtgtcacttcctttttctgtccataaatactgcctgcccaagttgctggatggagctctctgagcctctactggttcggggtgctgcctgatttaggaatcatttcattgctcaaataaactctgctaaattgaattcatctaaagtgtttcttttctatttttcttttctttttcttttttttttttttttttgagacagaatctcgctcttgcccaggctggagtgcagtggcaccatctcggctcactgcaacctctacctcccgggttcaagtgactctcctgcctcagcctcccaagtagctgggattacaggcatgtgctaccacacctggctaatttgtgtgtttttagtggagactgggtttcaccatgttggccaggctgctaagtagcttcagggacgagaaggtgtaaggatgtgaaaagcacctggtactgtacctggcacagcaggtactccaggagggctgagggtgtgcacatccctgactgggcctcacaccatcacaggccagaccttgttcagctctgcgtcagcacctacccccccactcccctgccgcctcttcagtgtgatgggaaagtccccacccttggggtcctgagtcttctgctgttcccgccagctctgggctgggtggggcagctcatctttccagcttcaccccctgtcagaggccgggaggaggggcagtgcaggctgggggctcagagacagggctactgggccagagccattctgagctacttggtgggccccagtatcaccgccgatagaaccccaccctccacaggctcactgagggcagctggccactcctgaccctgggctgggcacatcaggggtgcccctgagtggagaggtggcactgtagggcatcacagtgttgggggttcgcacataagagcccatgtcatcggggagagggtggcactttggggaggggtgttytcagggccgtagcaggggcctttagggctgccagcatggtttaggggacccacaagtgtggaattaaggccaaggtccactcccaaggatggagaagtggaagggggagggagtggtcctctgggtcctcggctgggcaggcggctgaaggcctggtgagaccccttcagaacccacttgaggccaggtgggacggggagttctgggtcccagtggggcgagtccctcattcactcctgccaaggcagcccagtcctgccacggccatgggagaggcctggggagtcgaggtgggagcagccctcaagtgtctcctggggtcccctctcccaggaggcctcccaggctcatctgttctcttgttccttcctgctctggtcgtgaggggctttgctgtcacgcaggtcaccttgcaccctcatgtctcagtgtccagcgctggctggggaagggctggctgcctctcctgaccctgggctggggtgataggtggggaccccttggggtgacgtgggaacctcaccactgttgaaggccacagcttccccttcccaagccccacatgggcttccccttccagatctcaatgtgttcctgaaggtcacgtggctggcagggggtggtggtgggggtggggggtgacaggagagggggtgttttggagggaggcgggtggggcacgctgttgtgtacaaacacccacctcccacggcacaggggccggaagtggccccagaatagaatgtgctgctttcaagttccaaattgggctctgggggtgagagcaggcgactctggatgtaaaaatagaaaagccagtgcgtgygtgggtcctgggtcctccacscacaggcctggtattacaaaatagagcttcctaatgggacctgcctgacactctcgttttatgtagaaaattgactcaagcaaacctcagaggacagagccagcagctgacctgggctagaggtgtggcagccaggcaggcagggcaggccctcctggggagtgctggtggcctgggggcgctggctggcccttgacctggcgtgaactctggctctatttccctcactctgccctctagcgctgtgcccctgccaggagagtcctcccaggttgtgggagcccagctcagtcctactgtccccaaagagccttcgccgacttcgtcagcctttaccagctctcaggctggccaggaagccaggcctgtcccaggcacgaggggcagtgggcaagctggctgtgggccccaccctccacaggctcactgagggcagctggccagaagcccacaggctggggccacccactgaggatgttttctgagcagggccccgtgttggaccatcctggggaccagagccactggaagagccctgacctcaaggcgccccagcctagggggtgggatggggtggtgaggaaggctagttctgggcagtgtggtgggatgtaggtgcacatctgggcatgactgtgggggtctggggaggtcccctggggtaatgctactgagctggctttcccgggatgacgctggagggcagtggaggcagaggggaggccagtgtgcagggcactctggcgtggggtctggctgagacctgagcgggcctccatgcttccacccctcaaccagcacacasgtcctaccatcccacccaacctccactgctccccctccagccccaggctsctcctttccccttcattcggtaaaggagaaaatattccccatcccacccagggcaaggcgtgaggcagccaggcctggcctgggatgcagagatggcccagagcctgggaggggccactcctgtccagcctgccctccctgccagagtgcctgccaccagcccagcctcctgggagagatgccagcccccagccctgtcctcagagccagactgatgcctgcgtgtgaggcccagcctgcctcctcaaactcctcttcccatgagccacaatcctcccccacaccccctctgcccctccctccagtgctgggctgtgtggccaggggactggactgtgtggcaggatgactccacacagcctcccccagggagtggggattgggggaggtagggtgggaacctgtcccctcctatccccagggaagcaggtgggaagcctgtggccttggccctactcaggaattgcctctcctagcgaggcggcctggtgaggtggtacactgtatcactgtggggccactcctggggacagggacaggtgggagggcagggtccatgcttccaaggtcctctggacacgggacccaggtggcagctccaaaacctggctaggatgggcrcrgtggctcatgccagtaatcccagcactttgggagctgaggtgggtggatcgtttgagcccagtagttcgagaccagtctgggcaacatggtgagacgctatttctacaaaaaaataaaaaatataaataaataaaaattagttgggtgtggtggcacatgcctatagtcccagctgaggtgggaggctcacctgagcccaggaggttgaggctgcagtgccactgcactccagcctgggcaacagagtgagaccctatctcaaaacaaaagaacaaaaacaaaacctacctagccccttccttggggctgccccttgaggcctttgtctgttcattcaccaatcatgcactgggagtctattttgtaactcaggtgccctggaagcagagcccagaccaagggaagcgaggggtccaggcacacccgccaagggtgatctaggggcaggaatggcaagtgcaaaggccctgaggtgggaatgtgtctgcggtgctggaggagacaggaggccagtgtggccaatgctaagcggggctatggagagagaactcagggagcaggcaggtggcacaggctcggtctgggccctgcccatgcaaggayagaaggcatttgccttgggggaggtgggatctacagaaagttctgagtgaagaagtgacatgacctgactcacactgtgactgcacccctctggtgtgatgatggacactgccaggcaagcgcaggagagggaggatgaggcaggcaggggctgagaaaggcaggattccaggtgtgctttgccaacagaaccttcagggcggacgggatgtggggcgagcagagaggcatcagtgcggacgactccagggttgctggcccagggaaggaaaaagagacttggcaggcgcatgaagccccctgctgggacgcctgtgacacgtagascagcggcagatcttgccctcgccatcctaaccgtcagcctcaccctcagcaggtcctgccctaccccccagacagcagctgcctctgcctgttctgggtcctgccaaatcagtggcatggccgatggcacacgggggatgggtgtggcgggggaccggcccccttctctttggccttattctgtgggtgtgattggggcatcaccatgggcttctaccccggatgtgccctgtggaggtctgctccccagctccctgcyggccaggggtcctcgccttacctctgctcacctgccctgcataccctcccagcaggcgaggtcatcctcctcacccatccctgctctgtcagcctcagcggaacccctgggtgcccagaggctctggccacagcctccagcagcttcttgctcggaggggctgctgggagctgccctgaggccccaactaggagttccttcctcccacgccctggggttggactggtaaggggggagaaggggaggaatatgaggtgtgggattctccccacggtggaggctgcaccctgttccccctgtttggctgaggtgccctgcacagaggtgctttgcatttctgggtgatcattctctaggcgcctggtccgtccacactgtctgcagtgaccctgctccgtcaactctgagcttggcatctgaggccagccctgtacaccctgccctgtagtcaggccctggcggggcmgcaccgacgtttggctttgctccactcccctcccggtctctgcccctttccccagctggtcccctgggaacaggacacttgctgtgacccaatggcatctgctcatttgtccatttgctcctctcgtgagccacaagggtagggacttccttgtatcatcttgggtccccggggtctgrtgtggggccaggcatttatttagctgaactggacatcagggacatcaagatgtacagccccaaggtcatgagtgttttgtcaggagccttagaccagtctggcccagcctggagctccctccgcaygtggcctctkacaggagtgacgcagccccatgcggtgctaacagtggcagcactgaacgtcggatggggctgagcccagccacttccacaatggctgtagttcctatctcttcctccctgctaggaaaatgtgaaatagcccagagtggggggtgggcagaagagttgcaggctacccaakgctgggatgagcagagttgagacctggggagccaggcccaggacacttacaggtggggatgtgagcaggcaccccagagagtgagcaccccagccagccagcacccatctactccctcactggggtctaagttcagccccgagagctaggctgtaggtgggtagagtcacagccccagcgccggtgtgaggggtggccctgggccaggtagrgtgagtatctgcctgctgtcatgccccatccacttctgccgcctccccagtagaggaccccctccatttcacagatggggaaaaggggccctgttgtctgaagactctcccatatcctcccctgcctctgccatcccctgctttgtcccttcccttccagaggccctgccttggtcctggtcacttcctggtaggcactggctcttcctctatgcctgggctcagggcctggccacctagttttctgactcctcccacttactcccctccccagttaacctctctgatcccaagtgtgtctctccagcagggaggagggctattgcagccagggatcccctttctgaggcttgggacccattattgggcagctctgggacaggtggacggtgacttggcccacactcggtccagctgcaaccctgagaacccgcttggtttggctgtgtctcctggaggccctcaggtatttcaacctgtaggacccaaacccagtccttcacctgctgcagggccagccctggacacccctgcccctgcctgatttggagcagccaattcagcccctgtcattggactctggcctcttgtgctcagtacagagggtcagaccttggccgcctgcctggacagggccaggtcaccaccacccacccccagctcccttgggttcccagcaagatcctgtccttcctctactcacagcttcctgggctctgggacctggggtccagtccccactcctcatggggaggagtccccccacgccccaagcagttgactcccgcactggtkgggggtccgctcgccctcaagctctgcaggcccagcttggtctccccagcctcttcactttctccacggctccctccacctacctggccctgagagctccccagggaagccatttcctcccaggaagcccctcctcttctcgcccctgcccttacaccaaggcatctgggcctactcttagggagagggtgatggtggaggaaagggagcctcagaggaggccaagtgtaaagcacccggtctcctgtgcctcccagccccaagacgacctctgggccaccggagtccagacctggtccaagaggcgaggtccccctgggaagtgcctgaaaagtaccctggaggacatttggaaacaaagacaaggttycctggtgcccagcaagccctcccccacctcccctgctcctgtcttggccagggcctaagtcgcactcacggggcaggggtggggccgcccaggatcaggaccacggggctgggggggtggacagcgccctttccacctgggtcgctgggcactggggtgtcactgggagggacacgcaggagggacagacacgctacctcactcacgggcgagaactaagcacctactgtggacccggcgtctaggcccgcgacaacgccagtcttcgccccccaggggcctcgtcccggggccgcggaggccacgtgcagttccccgcccaccctgaggtaccggccccgccccacgcccagctcggacctccaggattgcgggacccgccggggaggggcggggccggggcggggccaggaggagggcggactgggcgggcgcgggcgggacggagctgcggcggcggcgggtcccgcgggcgggagcgcctggcggccgagtcaagccgccgcctcgacccagggcccgcgggccaggagagcgctcggcgggtaagcctcggcggcgggtctcggcgggtctcgggggtctcgcgggggggcggtctccgcgtctggaaggggctcggcgggccttggckgtctgggggytctcggcgggtctcgggggtctcgggggagtctcggggtcccgacaggtctcggcgggtctcgggggtctcgggggagtctccggggagtctcaggggtcccggcaggtcttggcaggtctcgggggagtctcagggtcccggcaggtatgggcgggtgtcgggggtctcgggtgcgcagcagcctcccccgggccccggggcctccgtgtccttgccaaaggacrcacggggcctgggcacggcgggcagtgcccgagggagcgcggcttcggggcgggggccgggtgtcccttgccgggggctcaggggtgggaggcggtgcgacgcgtctgtttcgcacccctcgcgcccctctggccccgcggcggggcccctttacgcgaccctccccacaagactcaaaggctgcggcgggcactcgctctccgcccttcccggaatccaaacttccctctgcagcggccgcgcttcacggagggcaagaaaagccgcccactggcgctgattcacactgaagtgtgagtgactgatagccgggcgtctgagactctcatgggcaacagggaatctcaggggtggcagagggactggaggagttagggggcggggacagccccttccacctgtacgctggcctccctgcagcccagcactttcccgctgctctgggcctcggctccctgggggyattgagggcctgagccctgctgtggggagccttctgctggtgctcctttccgtgagcacctcctatcccctctctgtgcctcagtttgctcatctgttgacactggggacagctgtgcctcctggtctagtggccacacttaagtccttcgaattggctgtggccaggggcgggtactccgtgtgggctgctggggtggacagcctgcctggatgacatgtgtgtggccttgcaggtgacatgggccggtgatgcaatgtgtagaattgtttccacaaccgcctgaaggcagggcccacagcctcctccttgccgaagcaagcctctgggttcaggtcagccctgcaccaactccatgagcctggacaagctcctgccctcactggctcaggccctgtgggaccagaggaggggctgggctccaccccctcctggttcttcscactctgtccactgtctcctctacgtagacaccgtcgaagggccctcttggagcccaacctcagggccccactccaggcactccactcctggcaggacaggaggcctgggacgagggctgcaagggagtgaggattctgtctatcccctctccctgccacccgccaggctccctttgcctggctctgtgccctgcgttaggcacaccctggagggggcaggcagaaggaagacagataggcagccgtgtctaggaactgccagccagggccatctggtgagaggggtgctgacaggggacctggcctttcagggagtccccaggcctccaggatcatgggggagcccaccaaggaggctggcctgaagaggcagacagagggaggacaggctctgggcctgccttggccctttctgcccacatggacagaggaagcagggtgctgagtcagctggagctccccaccccccagggatgcacgcacacaagcaggcccacagacgggaagtccaggggcccagagagacgagatggccagccttggttcctgaggggcagggaggaagggygcaaactcagccaggatcttgggtgtgaactcagatgccaccagtttccagctgtgtgatcatggccaggaggcttccccctgccacccctccgttttctcatccatgacctgagggctgtgaagcactttgtacctggtgggtggctatgagtgtccgtaggggggatggtggtggtggtgacatgtgcttggtattcagtgacagtgggtcgctgagggtgctctccctggtcctcagggccgctgtatgtcctgttttgggtgggggcagggactggcctggagaggcctgggtaaaggccraggctcccaggttcctgcccacattggactaaggcctgagtccatcaggagtggccagtgttgggcagcccctgggtcttcctgcgttctgtcctcaaaagctcccttgtggggacaccccaggtcagtgactatgtgtggcaggctctgccctcctcactctctgtcctctcttgacctcatgatctgcccacctcccaaagtgctgggattacaggcgtgagcccccacgcctggcagagtatatagttctttaataaccgggtggcttggccatcactgtgcagcctgggtgggtgaggagaagggcaggctggcggggaaaagacggggaatttgccacaaggtgagagctgtcctaccccagacgcagtggagcggctcccacccctcgggccaatgaatacagggtgggccgtcaggaggagggatctgagccgggcgggcagccatgcaggtacagacagactaagccaaaggcgggcggtagggagggtgggagaccagtttgaygggagtggcctttgcatgccaggtgtggtgagggtatggaggggcctgggaggcaaggagaaggggccgtgcagaccctggaatccttcctccaggataggcggctcctccccagaaggcctctgcattcttctggtggccctgtctggacaccgaggggctggagacagtcccacgtgtgggctgcctaagtcccagagggggtggtagggagcatttcaggctcactggctggcccccttccctggggcactggaccctcctcaccaccccttggcctgtgcacgggagggtagacaggatggtgccaagagcaagggactggccctcagccacgggccaggagacctgagccttgtaggcgaattgcacttcctgaccctcagtttcctgwtctgcaaaacgggatgacagaagtccctggctctggaccacgctgctggatttgggttccgtgccgggcccctgactacactcatccttcaagggtgacgcgagagaagcacgtgcccaggttcggggcgggtggagacctgggtcagacaggagttcgaggtggtgcaggctcccaggaggggagaaaggtgccctcccccaaccttctctcttctccccaggctctgtaacttccaaggccatgagagtggtcaggccctgcttggtttcccggcccccgatcacagatcrtgctggaactgctggccccaacgccctgaggtgactggccctttcttcatggattccggtcacatctggtccatctttgtcagctggcctctgggaagaatgtgggctcggccacctggagcagttgcctggggagatcagaggagccctgaggggttggcagagcgccctcgtggtatccatacccccatccctgtagctgagctgattccaagaagtgccctctgcttccttgtgaatcagatgtttactgcgctcctgctgagcctgctccaggcagctgggtggggcgtagggtgcctgtctgctcaagcctgcagagggaggccagctccccrccccagggtcagccaggctggcaggcaacagcctcaagaaggcagtgtgcgtgccatggcacacggggctgaggycgcgaggcaggggccgagggaagcggcacagagcttctctcaggcaccagaggggagctgagttctgggctcagagcaggcttcgtctgagggcttcagcgtcctccttgtgaaatggggtgaaagtaggtctaactcatgggaggccagatccccaggcccgagctagggcctccctgcccttgacactgtgtgaatgggcagctccgtttgggggagttccttcagcctcgatccaggggtgttgtaatctagtgatgctcttctgtggcatttgagggtcctgggtccccatgccctgcagccctgtccactgtcctgagctaggcataggggtgggcccttgctgctggctgcccctggacaaggtgggaagggatcaggggtcattctgggagcctggaatgctgggcggtccttggctttttctcagccttgggartctggggcagtggtgcgcctttaccacccaccctggtttctgcctctggggcagtggtggacctccttcagaaggctgctgcccagccccgggccccactcatgcaacactgggtgcctgtgtactgggccctgggctaggcatgcactgcaagagcagacaggccacaggtcagagggcaggaccgctggcaggtgcccatgggtagcagctcacctgcctggcccaccttgccactctctcccttagaagcaatttcagctgaagacataagtgtctgtcctgcttggtgctcagggtaccctccctggccacccccaactccaccctgagctgggtgccttcctgagcccccagcctggtctatggccaccatgcatgttgacccatccatggtgacctgtccgcctgcccctcctgcttgggaactcaggaaggtcagggtcgcgtctgagagcccatgccctggtggtgcccacgtgggcctgtcccagaggaagggtgaggggagtgccggctctcccagcctcccactcctgggcagggaagtggcgcgggcaacgggcgggctgtgccaagctctttgaaggtggcttgtcactccccccacctgtgtttaactctactgagcatcagagcctaatgtgccagtcagcctggcagctgccgcccagttggtggagtttccaatcagataatatcagactgttgtgctttggtctcccacgaaactcttcaggtttccatcacagcctcctcccttccccctgcgggctgcgctgtgacagccaccgctgcctgccacccggcagcagggacccagctgcttctgggcctggtctcggtggccctggcagcggtagatagggaggaccaaagcctggtgaggaagagccgccgagckgagtcggtgtcccctgtcctctccctgaacgaaagtgctttctttctctgtagctgctcttcctaaacgtgtgttggcttgagattggagttagcctggcctacctgtgccaccagggctttgggtcccaaagagctggcacctgaggcaagtccaagcaaaaggccggatttctcaccattaggagggcaatggggaaagatccagaaaagctggcctgggagccctgagtggcaggtgggggtacacagccctgcatggagaccaggctcagagccagaggaggcaggccaggaaactcggcactcatctcctctctcggaaacrcccctccctgaccccagctgcttcctctcctcctactcgaggccagaaagggaagcccctttccagtggggtgagtggctggcgctgcccgaggcggtccgctgatggctgggcagatagtgctggggcctggcctggcaggcagatcagtggtcagcagagtgagtttgaccagggcagaggggaagatgacgggggtgcatcccccgagctgggggaagtgacttcccgttgccatcacctcttgtggcctcaggcgttcccaggctgagwcctctaggaacacaggtgctgggtggctcaggtggctccaccaggccaggccgtgtgacctgggcatcctccgccttctctgggcagggcagggacaggaagtgcagcctcatgggatgcgtgarggtgagggtgtgcccatccagctgctggggcggggtgtgtgggagtggccccccaggagctgcacgcagcacggggcctgggaaactccaaagccggcgtcaggtcatcgaggcctccgggctgattaggactaatggcgctcaggggtgcagcctcagcctccacccgccacccgtacccgccctgcctcaggacttcgttcctgctgtacccctgctggctgcctgtccccacaggtggctccttcctccccaccggaggagctgctcccaggcgggaccctgggggtggaatctctgaaatgccttcccctcgggaccctcaccgcgactggacttcgctcagcttcagaccctgggctgcagctgcctaatgaggtgggatggggccctgggtgtgtaaagtggagggaggggcagtggccacctctgagccctgagccatcctggggtcctgggtgctggcttcaggaaggtttgctacttggggcaggggctctctgagatcaaccttcccattttcttgaggatgtgaccaggagggtgatgttttgtggtcggggtggctgtgcctgcctctggggcaggaagttgctggggaaggaagaagattgagaaaggacccccaacccccacctctgcagaggatctagcgggccttgccccatgccagggttcctgccggctggcatcaaggggacagctrttccagggctggkgtcctgagaagcaggggggacccacttgggacccaggccccctcgaagacctacccagagccacccttgcggcaggcagggtcctggcccttccagtacgaagctgggaaaaggcagcaccaaagatgccaggggygcctcacggatccccccgggggggcctccttgagggggagcaggaggaggggccaggctgagggctcaggctgtgtgaaagacaccctggttttgaaaagggagaggggctagagaggtggggcccgagggcctggtggggcttccagcaggggctggcttatgttttcaagcttactctggggtctggagaccactgccgaacatacgccctccaagcagtggccacaagaagaccatgaggagctcgggcggggtctggggaaagggtgggggctgccacagacagaagtgggttcgtcgaggctgcagaaggctgggtgggagtggaggaggtgaygtgaccaggatggggtcggtgacccctgcacaggggctacaggggatgaaaggggagggagcagcagactgctgagattggggtggcattggccctggtgggactgactgtccccggctcagtctccctcctccttggctggcttttctggcagacagtggcatggtccagagctgcctccctggggagggaaagggcatccccaagtcactcctgaggctgtgtccccagagtgtccaccgggctgtgccacctccctgtctgrtgcagcctgcccctgcctgagctgcccgagcctgccccgtggctgcttcccagccaggaggaggccctaggggcagacaccggcgggcttgcttacaggccctgctgactccagagtcttactgccacccgagcagtacgtggaggtgcttgtcctgtgaccgccccccccccgggctgatgacgggccaggtggcacttcacctgggggctctggggaggctgtctcgggctcccgtgccaggggtgggtgcagggaggctgggcaggcaggagagctcaggcctcggctcccacgggtctggggctgtggtggttggggaccctaactagagccattcacccctctgaggaaggacctggcctggagcgccatccccagggagcagtaagggcattgggggtgtcttggggtgacctggccgggggcagaaggccaggcgggagtttgcaggtggggaacggctggaggaactcgtggaacagcctgagaggtgtccggcgaggtagggcatgggtggccttgagccctgaggctgagcggagctgtctttgagagccacctctgctgaggctgcagcagaaaggctgtgacaggctggctccgagggaggaaggagctgggctgtgggcggcctggccttgggaagggggctggacagttgcatggttgggggcggagaggaggagaccctgatccagactccacccctgcctgtcttgaccgcggaggaccggggcccagactgcaggggtgcagagagsctgcggcagaggctgggggctgggctcctttcccggcaggccgggcccaccgccagacccttgtcctcactgggcctctctgaacagtggagcgttgtgaggggcctgggaacgttcaggtcacccaggccccctctgggccacgctgagggtgaggacaggagccagcgggcatgagtcatcctgtcccctgcccgggccccgaggctctggggttcccaggctgaggaggaacacacagctctcggttccccaacccggggtctggcccactccttsttccttctttttgcctctctgtcagcacctcttcctgttgcctccctcttgctcctgggcctgcctgcatctcccttcccctgtccggccagagaccccggcctgggagtggctgtggcctgctctcccaccccgatgcctgctgcagccccagcagaggggctggcctgtcgccttgagcccacctgtgcyggcctgtgagtggccccaggaggaagccagcgcaaggacaagacccagcctagacaggaaacctcctgaggccaacctaaaatttactaaggaataaaaaatgacaagaagcagaaggcaagggaatagaataataaacccagagagtaaaaacgaacaacatccgggaaaaaaacccatgttagaaaacagtttaaaaatattagccaggcgtggtggctcatgcctgtaatcccagcactttgggaggccaaggcgggtggattagttgaggtcaggagttcaagaccagcctgaccaccgtggtgaaaccccggctctactaaaaatacaaaaataagccaggcatgttggcgcatgcttgtaatcccagctactcgggaggctgagacgtgagaattgcttgaaactgggaggcagaggttggagtgagcaaagattgtgccactgcactccagcctgggtgacagagagacctgatctcaaaaaaaaaggggccgggcgcagtggctcacacttgtaatcccagcactttgggaggccgaggccggcagatcacctgaggtcaggagttcaagaccagcctggccaacatagtgaaaccctgtctctactaaaaatacaaattagctgggtgtggtggtatgacctgtaatcccagctataggaggctgaggcaggagaagtgcttgaaccaaggagacagaggttgcaatgagccaagatcgtgccactgcattctagcctgggcaccaaagtgagactctgtctcaaaaaaatatatgtgtgtgtgtgtgtgtgtgtgtgtgtgtgtgtgtgtgtgtgtatgtatatatgtgtgtgtatatatgtgtatgtgtatatatatgtgtatatgtatatatatgtttgtatatatgtgtatatatatatgtatgtgtgtgtgtatatatatgtgtatatatgtatatatgtgtatatgtatatatatgtttgtatatatgtgtatatatgtgtatatatgtgtatgtatgtggtgtgtgtatatatatatgtatatgtgtgtgtgtgtgtgtatatatatatgtatatatgtatgtatgtatatctatatacacacacacacgtaacgttagggaaaaaggatcacggcgaatgcattaaggcagcagaaagacctaaccctcaagtgctgaaatgagtggacagagggaagggaccctgttgtgctgactcagccttggtgggtcccagcctgtggcacccgctgacagatggtgacagggttcctgggtaagcgaggggcccaaggaccctcagtggtgcacagaggagccatgatgggggccacgcctgggccccagcgtcctttgccctgacccaggagcttgtccagataaaacgccgtaaagtgcctgggctgagcccgaggtgtgtgcaggagctgcatggttttgtgcggtccaagggaggccgccaagaccgccacggtacgaaaagtaccacggtgatgagtgaaagggacaggcggcgcagggctctcaggccacttactgctatacggtcccaaggcccaccctgtagggcttacacagctgcctacacagggtgcccatcgtggtggctcctgacctctsccgttggctctgggtgggagcaryggggctgggtttctctgactggcgcccctactgcatgccaccccagcaggagccccagggcctcggcatctccactctgttcccttgttatctcgccctggtgctgggatccgggataagcagggtgctgtccacttccagggcctagggacccagtgctgggccaagtgcctatggcagagtgcttgggagctgtctggtttggtcctcagagtcctgttgctaataagcgtggagggggaggacggagcaaggctcagggagtgaagtgacttgcccctagtctccagcttaagggaccaaggctgggactggagcccaggcgtgaatggtgcccaggagctcatcccagggaaggtctgagatgctgtctgcctcacctgggcatgtggcctggactggcagttctaactaagacccacctctgtctctcatgtcagaaggtgggtgccttctcttacctgcaaccccagggcctttgcacaagctatgctctgtctgactctatgtaatcccatgcttggctaactcatgtggaagattgctcccaggacgctggcggatgtgtcaacgtgtctgggtggaacagatgtcacaaggatgtgagtcagaggtggctgcctccctaacagattgggagcccagacagagggtgacagtagcttggatcccgggtgcagggtgtggcgtttgcctgtaggtgctgtgcctgagtgcctcccctgtgcccgataccatgagacttcaggccgagtggagtgacactgtgcaagagagacagggtccggctgaccagcctcaccatgactccagccgagcccactgaataggtgggctaccttccaccattccctggcctcggtttcctgctctcggtttcctcagctgcctggtgggttccactgcaactctctgggggtctccttctgtcccggcaccgcctgctcctgttcctcatccgagtctctgcggatgcgtggaccccgccctctgtgcagcctcagcactaagtcctgggtccagcagctccgggactgccccagttactcctggggaaactgaggactggagctctgcttctttgcccgagttttctctagggtgagcaccagaccactctttcttcaagggaaccagcagcattgagcgggacccaaaagggggctgtggcctgggagagcttcccaaccagcctccccaggggctcttgggatcagtttaaaacagaagcagctcctaactcctcaagggtgggctggagcccctgcttccccaggccttcctgtcctgctgagctgggccctgcggtagcttcctccctgtaccccacatggcgtggcccaccctgtgtcccctggcctyctacccagagccctgccccctccacagaggccagggcccacccccactgtccttaaggttggtgggcttccttctgagagtgggcctggggtttctcctctccttcttacccaccccagagccaggctcagcaggaaatgcctggtaggggccctgccagggccataaggctttcagggcaccctcaggttgtgttgtaggggtgggccaggtggccccaggctctgggtgacactagccacgctggctgggtagccaagcgttgcagctcactcagcctcgaggtcctaatcgggagaacaaaacgagcagttggcgatggagcgggcacagagctggcgcactcagaacacagtggacatttccttgggggctcccygcccctcccttggtccagcagcctagccctcctatcacaagaggtgactgtgggcagggaagcacccccaaccttcacacccactgtgcccgtggcccaggcgtcccacgcatcccaggagggtctggttggcgggagcsctctgcttctgcttcctctagatgaggaaggtgcccggcagrtttcctacctaagcacaccccctgggcccggagggtcagcagccaggctggtgtgggcgtggggtgtcccggccacagctgatctgctcagtgactgctgctgcccttgcctatcgatgaggatgctggggccgggaggtcaccctggaggcccaggctgcgcttggtgggtgcagagcccctggagtgcccccctcctgcagccaggggtcccccgagatggaagaagtggggtgcctggggctggccagatggtgtaattcagcacatgagcccatgagctaggccccacggagagtaggggttccagccagctggggtgtggacgaggtctgttcatgctgcaggaggcacctggtgccagtgtcacactgggcactgttcaggcaccaaggacatgggggacggacatgcagagatctctccccacagaactggtgtcaggggaggggcagatagccaacagacatgctgaaaatgccacagcgtcggggggtgccgggtgggggctgcctctctgaggagtgggggccctgccgtggactgagcctgtgtgggagaaggcccagggcctgcggattggggtccagcccaggggagtgtggtctagatgaggggccaaggggcaagggcggggcagaggaggtggagagggtggcgttccaggtggagggcactgctgctgccaaggtgcagagagggaaggggtgtggcactgggaatgtggctctgtctgtgccaagggccgcggggagacgcctgttctggaggccaggcccgcaggcaggaaggaaaagcacggccggacgctgagctgggcggttcctcccttcccttgacactagagcaagcccagcagccagctgccccacccccactgctcaagtgaggaaactgaggctcagagtgggccacaggccaggaggaggggattgagccaggcttgttcccaccaaagcctgcacgctgaccacggctctattctgcctgccaaggtcacatgcatagagcggccctctctggtgggagccactgggtggggcaggactgccgcccctctcgggaccctgcggggctggggcatagggtgcccaggctggctgcggtgagggacagtgaaacccttcaggccaggagaggcgaggcagggtggggaggaggtgggccccagccttgggtgggagccaggaacttggggtggtggacccggcccaccccacacatcaggactctggagaattttttctcaagtgattaaaaggtagaaactcgtcagtgtttgtgaagaactgaagtgtgaatcctgagccgcctctgctgcttgtggtttgagactggagagtggctccaggcgagcagcagtgccagccgtggcttcccccagacccacctcgccttgcctcacttcactgtctccagccccacctcacygtctccagccccacctcaccctcaccaccctcggcctggaagcccgccctggcctcctccctccagccagtgtacggcccctgcctggccaggccagagctccgcctagggcaaccctcttccaggtgtggaggcccccgggcagtcccgactcccatgcccatctcaagaacctttcctggggacagagacaccaggcctgagagaggaaggcccagtggggcatccggagatgtgagaacattgcagcttccctctgaggacagagcttgagggccaagcatccaccaacagcttggccttgctctctgaagcccaggtgccatgcaggcagctgtgcctacagggcccttgtctgcatttttcttaattccctttgtccgttgcacacagcagtggcctgaccgtctctgcctccaccctgcaccgctctgtgaagcccctggggcctctgagccccgaacacactgcgtcttctgggaacactgctgtctccagtgcaccagcctttctctgttttgcagcgagcagcctcacgtgcgtgcccagggctggccgscggcttgtctcactgggcagaggtccaggggtgtggaagggcctcagctgcggccgtgctgcactccagttctttgaaaacctctctcattgagagtccaattagcgctaagtcacaattttttcactctgagctctgaaggatgtactggttacaacctcgctggggtctggcctcatgtatggacatgacagtgaactcatctgtttgtctgtctgtcyttctcttgggtcctgccatgggcctggtgcccatctgggccttggagattcagtgggacttggacccgtggggagtgccagggacacatggggtaatgctggtggcagaactgtgccattgacttggagatttcagagaagagggcaaggttctagatggttccatcctcaaaggatgagggagcgtttggtttccatgtggaggtgactgcaggtaccaggatggggcaagtgcatgacaggtccagtgtcgggggcccagggcaggaagggaaagcaggcgccgcaccccatccacgtggacagggaaccaacctcgctgctgcgccgtggtgaatgtggcctgagacaaggaagggcaggccaaaggggtgaacgcgaggccaggaggtggggtcagcaagcctggcgggtgtgggtcaggcatggcaggtgaggctggtggaccctgtgtgcaggagggtgggaggtggagagcccagccttcgggaggctgtgggcacctgcggaggcaagctcagcagtgcccgcccaggttggtcacagccttgtggagcctgtctctccctgacaggcacgcccacactcgggatcagactaagtggagcctgcagttcatcctggggaaggactcaggtgagtccccgtgtggattcatttcctggggctgccctaagaaagttccacacacgaggggcctgaaaacaacagaaatttactctctcatgattctggaggccagaagtccaaagctgaggggtctacagggctgtgttgccccggtggctctggggaagccccttcctcccctcccagcttctgctggtggccggcgatcctcggtgcccttggtgtgtggccacatccctccagcctcttttccatccttacatggtcctttccaggcatcttctcctactccatctcttacaggacagttgccttggatttagggcccacttggtcaatccaggatgtgctgcttaacttagttacatcgaagaccctttttccaaataaggtcgtgttcacaggttctggggattaggatgtggacaaagcttttgggggccacctttcagcccactacaacatgtggccccaggcagggtccttctttctagggttccctctccctctatcccagttgggtagtgcccagtccgagttcccgggaatcctcccagtcctgcatcatgggacagcaatcagaatggggcatagagggaaggggcttctggctggggagagcctgggagggtcccagggatggctgtggagcggacccaggccccatgggaggggctcatgcaaaacatcttattttgagagcttgagattttccctgggggtgcccgccttcccccaggctctgtgcccacccaccctcctagggctcagtgcccrccttcccccaggctctgtgcccacccaccctcctagggctcagtgcccaccttcccccaggctctgtgcccacccaccctcctagggctcagtgcccaccttcccccaagctctgtgcccacccacccttctagggctcagtgcccgccttcccccaggctctgtgcccacccaccctcctagggctcagtgcccgccttcccccaggctctgtgcccacccaccctccccgggctcagtgcccgccttcccccaggctctgtgcccacccaccctcctagggctcagtgcccaccttcccccaggctctgtgcccacccaccctcctagggctcagtgcccgccttcccccaggctctgtgcccacccactctcctagggctcagtgcccaccttctcccagggttagtgccctccctccctccctgggctcattacccaccttcccccaggttcagtgccctccctccctcctctgggctcagtgtccaccttcccacaggctcaatgccctccctctctcccctggactcagtgccctccctgagctctgcagaccctccttggcatgttcagcacctgagcctctcctgaaggtggcaagcaggtaccaggctgggtacagggtccctgggtgccagtccccatgccactgatccctagcttcctctctgaaccccagagatgcagatggcaacaggactgtcctcttgggctgtgagccttgagatgaggcaggtgccgtgaggcaggaggtgccagggcagggtcagctccgtggtggctgcagacaccacccactgtgctgggtgtttgccttactcctgagcgggctgaaggctcccagaacccagtgaaagctccctccctcttctttttcaggctgacccttggccctctgcctgccctgctggctggctcccactcatcctggtaagtgccctgtgtctggcatggtgggaagtccccaagcctggcagtttgaggcaccagctcaggggcaggggagcagctgcaacttgggaaggatggagagggacaccagggctgcccattgaggcggccccggccatgccccgctgcacacaccccctgcttggatgcaggcgtggggtcatctccatggttaccggcacagggtaaatgtcaaggagtggccatggctgaggaggggagaatggcctgtgtttaggaatatgaacggcagtgtcatatgcygcagggatgaagaggaattgagagagcaattggagaagctaaggcccagagaggaggggtctgcagaggtcacccagcagcccaggactcccagctccagcttccctctgggaagatagggttggggaaggggctggtgtggatttgtcccccacccccagggtcccctcacctggcctgctcctctcctmtgggctggactccccctgtagcatcacagcattggaccagggctgtggggggaatgggcctgggccagggtcaggtgggtcttctgcttgcttctgcctctgccgagtctatgagtgtggggcttttggcggagcaagggcaggggcgagcctggctcctgcttccagctcaggccttgtccgctcttgcatttgcctgcccagtaaggggtggcgtgttcctgagagcgccggctgcctctgggttcttatcttcatgggttgtcatccctgaagctgtgcgttggccacctcattgcctgtggattcctcccaaccctggggtgtgctcaccccaagccccttcctcccgtggctccctcaccccagctccttccagcaaacttcctcctctatcaaagctgggcccctcctctgggaggcgttccccagtccagaacccacagggcctggtccctcctctggaccctgcagccccaactgtcagaactgcctgcctcatcgtccaggctgggcagtggcccaggggttcctcacctgctgtttgatctcaaccctcctgcaaggaggaaagagaatgggaagaggccccactctgtccgtgccctcctcgctgccctctgtctgtctgcctgctgtggccagccttctgctgaaggtgtggtctgcccttggccacctgaggggactgaggctggcacaggctggggacgccagggtgtctgtgcccatgctaargaggccccagacctaaaagcccaagctcctcaccctctaggagacagtggggtgtctgcagcccaaacgggcccygagggggaccttggcagcagggctggggctgcagacacagctggggagacggagctccttagcctgggagctgccttttttgagtgacccgacacctaggctatgggacagcttgggacctgcacagccggttacggggctggggtccagggtttgttgggaggctgatttcggggggccgtgccctaggaagcctggcgggcaagatgagacccctgcagctttgtggcctgtgctctgtggcctctgtcaccctcaaatcctgctgtgagggtggccccaggccccagaaagcccctttctccagctgcctctgcccaggggtcctgtcctccctgggcaagttctgggaggagagggagggcgctcagcagccagtggctagaatccccattccctgcttccgggctctgggcctgggcagggcactgggcttggtgggggcagagcagccctgggaggggccgaattctgagcgggccttggggcaggggccggtgagtacgggagcgtgctttgccactcagccataatgtactttctagcaaaccagatgttagcagagctggtgtggttgcggggacgtgaaaaggctggggatagagtaggaatcgaggaatgccagagcccaggcctagtccctcagtcccttggtgtsaaagggcacagagatggccaccttgaaattcatagaaccgggtgcaagacataacagccctctgtgtggcctcagatggcagagcagggtggcagcagctgccctggcaggaagagcatgctggtaaggtgacaccatccctgtgtgtgttgtaaatgctgctctgtgctgggcctgacacccagggtgcaggttgtttcatggtttgctagggagaagccgagtattcagaggtggccctgcggggaggcagcagggagcttcctcccagggatgcagctgaccttgcgctggagccagagagccctggcctctgaccacaggatgggagggcaggagcagtggaaggtaggagttaaaacccggatggtggatgaggggcagccctgggccccaggcagctttcaggacctcacagggtagaaggcaggaagtgccggctacttggtgctgcccagggagcagggaacaggaagtcccgggtggggaggaagcaccggcggccacaggcctcagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcaggtcagtggggcggccccaggactggggctcgggaggcggcactggtctagcacctgaagaaccagtaagggggccccacgtgggagccacagccttcctcggggctggccgtgggagcccacaggaggtggccctgagcctgcaaaaggcaacaggctctgaggagagtggcctctgtctgccttgagaggcccccgagctggcaggcacagggggaggccagagagggaatgtgatacttagaaccccccccacccccccatcacatgcggccgacagggaggcgggggccagcctgctggggtggggcccaggtccgggaacttctcatgatacagcctgcagggtggccttggtgtttgggtcctaagtacacacatgttgtgtatgtragtgtgtgtttctgttgtgrgggggtaacggagagagctgtacaaggtccctgctgcccacctggggagtgccatgctctgaaacctgcaatgtggaggaccckcagggacctcagggactgccgggctggggctgtgctcgcagagcccaggctgggccaccctgccyctggccagcagtgcttctctggcatagctggttactgggcctttacgggagamttttggttttgattatgttaacagagaaagattctgggaacaggaaggaaacaagggaaaccgaaaaggaagagcagacagctgtggggaggcagggcagccagggctccaaggtggaagccgccccatctgcacatcccacgcccaccaccggccacccactgtgcgccaagctgggccgtggctgtgctgggccgggggtggtgcgtgagccaccatttactggctgtgtgactttggccaagtttcttcgtcagtgacttggggaggactctggtttgaagctcaaggtgttggatgatggggcgatcactgagaagcacagagcttggcccacagggagtgcccagtgcgctcggcacaaggcctgatcctctcccagcctctatacccaagtctgtaaaatagaagtaaagtattgagctcaggtggaccctggkcgatttagtgagctgtgaggtacagcttggcactgggccctggcagggctgggagtggtggtgatgattctgtgctcaggcttcaggacacggagacacagaagaccgcacttgacaggtcttgttggtcgttggaggctgtgtgtgtgtgaatgagtgcttgcatatgcatgagtgagtgtgatgaatgtgtatatcagtatacatatgggtgtgagtgtgcacgtatgagtagacatgagtgcatgagtgtgtatgagaacatgagagcgagtgggcatgcgggagaatgagtgtgtatatatgtgttagtgtggatggtgtgagtgttaactgtacatgcatgagtgtgacaggatgcgcatatatgagcgtrtgaataaagtgcacagggtgacctggtatcttctccctttgggctggatccccagccccaacttgccctgtggctcccacaaatggggccaacctgatcaccactaacagtaagtccttgaccctgtggtcacatgaggtgctggctcccttaccacagccaggatgatcctgyaggagcccagcctcccagagcccccaccctgctcctatgcaggggctcacgcctgtgtgcatgcgagctgtgcagctcatgtgcacgtcctgtgtgagtgcaccacctgtgacattaactgggtgtgcagagacacagcgcacatgagggcctgcacaggccatgaccacacacgccacagrgctcatggggccccagggtggtgggagccacagagcctgcattaaatggaacccgatggggtgtctctgtgggamtgagcacttttcacctgactgctctgccccccaccgcagcagcctcaggccttggggtcacctgaaccaattgcaactttgagagaaggtagggagatgagcacagaaacagagacctggagagtgtatcccaggtgccccgtcttccctaatgtgcatgtgcacacacacacacacacgcacacacgcacaagtgtacaggctcaaatgcaaatctccacgtgtgcacacatgcaragatcacatactttctggaagggctcatggagcccagcagccaccaccagctttggccrcccaacgctggcccatgtgtctccagagccctgccccagagagcagctgcagaggtgtcaggggactctgagagtggactcctccatacccactttacactggaggaggtgggggctcaggggaaggaggggccccaggaaggatgtgaacccagatcttcagcactctccctcacagctcctgcccatgttaactcagccgacaccgcagcagcatggtgacaggtccccccagggtgtctgcctctacagaggaagggactgaagcacccagagagctggcaggtaggcctgtggagtcccctggaatgaatgaatggaatttaaccatcaggtccctggaagaggggctgggcactgagaagcacagccagggaggcctggccagctaggagtgtgggtgctccttggggatgccccctggttttcccgagcacaagtggggccagattctgtgagctgggctgaacttccccaagagcagcatggtcaccacggcctccatggcccatcatcaccctcagcctcagccgacctttcccctttctgctctcagcctggcctggcactgggctcctggccaggtatcaccccctggcacagggcagggccaggtggggcagaggatagtaaggtggcaggggtgggtttccccttgaatggcccctcctctggagaggggctgtgggtgtcagcgtctgtccctgaagcgaggaattcccaggggaggtgagggtgccacatgacctgcccttgtcatgacctgtccccctgcccagggtcagctgatgatcacctaagagccttcatcctgcccacagcgggacagcagccaggcaggaacgagcccctcacaggcctgcccctatctggccactgagctggacccatgtaggactgtaacctgtccctgtaactcttcctgctgagccttgtccaggtgtggagccaggaggaggtggtgggttccatctgtcctcacagtggctcctcccactttgacacacaggccaggtcttatagcttttgggtggcgggggcacagtggggtgtgatgccccagggtaggggctctgtttcagcttcctgtgccttccaggcaacttgcagtccctgtcacccacagggtgaacattccatccttcttttggggctacctgggtgtcccccctgggctgggtctgagctggtgaggatgggagacaatgaccaactagtgtggtcagtgttaggggcagagaaggctatgctagccccaagggagggacacaggactccagagaggttatgggagactgcctggaaaagggaacgcttgaactaactcttcctttcatttttggattgttgctagtatatagaaatagaattgatttttgtatgttgatcttatatcctgccaccttgctgctcatttattctaataattttttttttttgagatgaagtctcattcttgttccccaggctggagtgcaatggcgcaatctcggctcactgctacctccacctcccgggttcaagcgattctcctgcctcagcctcccaaatagctgggattacaggtgcctgccacctggtatttttagtagaaatgggggtttcaccatgttggccacgctggtctcgaactcctgacctcaggtgatctgcccgcctcagcctcccaaagtgctgggattacaggcgtgagccactgcgcatggctattctaataatttttaagtggattccttgggattttctgtatgtaaaataatctaatcagtgaataattgttctttctttccattctggataccttttatttctttttattgcctaattactctggtgagaatctccagtactatgctgaatagaagtagagcagacatcctttccttgttcctgttcttgggggaaaaactttcagtcttttaccactaggtatgttagctgtgggtttttcatagaaccctttatcagattgaggaacttcccttctattcctggtttgttgactsttcttatcatggaggagtgttgaattttgtcaaacacttgttcttcgtctatcaaaatcatgtggttgtcctttattctattgatatggtgtattacattaattgttttgaatattaarccatccttgtattcctgggataaatcccacatggtcttggtgtagaatcccttttatatgttgcaggattcagttggccagtattttgttgaggatgtttawgtctatacccataagggatattggtttgtagttttattgtgatgtctttgtctggttttggtrttgggataatgctgctctcatagaatgagttccctcctcttctattttctggaagtttgtgaaggatccatgttcttttgagccaactcttgatggctgggttagttcagtttcaactttaggctgtggcaacagcaggggctgaggcctgcaagtgggtgcttgctcgattcaggtaactggagccatagggtctggctggcgtaagagcacagaaggtagagggcaggagtggctgaatcaggaagggccaggttggcatgaggaggccctagaggtttagcactgagcagtgatgggaatggtgtgcgtgttgattctgtgctgggtggagggggctggaggcagaggaagcctgaggagaggaagtggagggggttgccaagaggcaatggagaggggcctggcagggcrgctggaaggaggtgggatccttgaggcaggccagacaagggcactgagaacagaggcacagagatgggacagagcctcgaaggctgggtgcagtgggaagaagtccagatagcgggcctgaggtggggccttgaaaccagggtgggtgcccaggatggacagctaggtagggtcaggcccaggctgttagagccacacctgcatctggcccatcttggtggcagcttgtttgcaggtggaagatggaggaggcaggatgcctgggaggccagcaagggcctctgccggcctttggccaccccaggggactctcctgggtgaggtgcctgcgtttgggcaagcaggtgggaggtgccaaggaccagacccctggctccttggagaatccggggctggaggcccatggagtcccgcaggaaagtggagaaggtgagggcggggcacgtgcccgatcccttgccccgttgccgccctccatgcaggtgccgttttgcagaggccactttcccgagggagctggttgcaagggcccggcgggatgggacctgggcggggcctcagagccgaggctcccgcgccggccgtggatttccaaccaagctgtgtggactggcaggtgttgggggagtggagcgggaggcctcgtttgcatcgaaggcttcttgattccaggctgcaccaacagatgtgggcctcctgtcccaagcgcccaccaacctccttgcagcgtggggaaactgaggcccgcagggggctcacgtgcctcccgcgcacggtgacgcggcagggggcggggccgggaggggcgcgccgggatcctcacctgcccgcccagtcccccgccgagaggggaggagccggcggctgccaggccagggccggcgggcatggcgggctccgggccgcgccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgccgtgagtaccgagccccggcccccgagccccgggacccgggccgcgagcttccggctctggaccccgcaccccgagcccctggaccaggccgcgagccccgggcgctgctggtcgcccacgcgcttcttgggggaacaaaggcgggcgtggaccgtcccggcgggcggatgggggactcaggccggcacggggcttgtcgatctgcgggcagctccccgcgggcggactgggcacggggctccctcctccatccccactgcggggctccytcgggccgggcgcggtwgggcgggcggcggggtgtggcggcgcctttgttccaaaccttggcctgtggttgggggtcctgcggctgggacccgcccctgacccctccctgcccagaggggctgtctttgggtgcagaaggagctggtggggtccagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactataggtgtgcaccaccaagctcagctaattattttttagagatggttgtctctatatgttgcccaggcaggccttgaacgcctgagctcaagtgatccgcctgccttggcctcccaaagtgctgggattacaggcgtgagccactgcgtccggctattttatttatttatagagacagtgtctcactttgttgcccaggctggagtgcagtggtacgatcatagaccactgcagcctcaaactcctgggctcaagtgatcctcctgcctcagcctcctagagcagctgggactacagatgcaccccaccatgcctgactaattaaaaaaaaawttttttttagagatagggtcttgctatgttgccctggcttagttttctttatgtatgttttttggggttggagctgtagtggaaccagtcccagccccactgggcatctgggtctgaccttagctgctccactaagggcttaacaggacactggccacaggcctgctcccatccaactccactggggccacaggagkgaccctacccaggatggagtgagggcaggcacagaccaaacagtgcagggtcggggggtactgttcactgggacaagagatgaggaagatgctggatttaagtgggcaatgagggtgcctagcagaagaggggactcttaacctgggtcttgatggatgagtagaagttctctgcatgggaaggggtggaggtcatttcaggcagaggaggaagcattaaacagcatggtgtatctcaaggagagcagctggagcatgagtaaggggggctggagtagggggcagggcatgatgttgggtcctgtgggcctgggttagccccaaggcagtcactggtcctccactgactgtgtggtcctcgcttgggctcagagggaaggggagtgatatcctgggctggtggggtggatagcagccaacccaccaaatggtggtcacgaccactgctgacaacagtgtgctgtgtgctgggctgggtgtccactctgtcctccagcatctgaggcttgggatctcccagaaagtcacaccaggatgggagcccaggtcgtttgagctgggtgctcttggctgctcacttgccttcttcctgtctaggccccttataggttcacctggcactgggacttgaagtagttatggcctgaggtctcacttacctgggctggcagttttctgagttcgttcatctctacccagcccccgtggggccttgcgctcagtggctgtgtgcagaatgaaccagtggagagaaagggctgcacgtagcgctcaggatcctggggttgggtttgtggctgagtggaccaggggctgactgagtggagcccgtggctctrtctctccctggggtcccacctggaagcccaaggccctcagaaaaggggtttccttgcctgtyatggccctaccctccaagctgtgtcctggatcttggcagtgtccccctgagcgccctggctcagmcatctcctgcctgaccgyagctgagccacgtgcctttgtcctttattgcagcttcatggcggctgaagagatgcattggcctgtccctatgaaggccattggtgcccagaacctgctaaccatgcctgggggcgtggccaaggctggctacctgcacaagaagggcggtacccagctkcagctgctgaaatgtgagtccctggggtggtagggtgcacagtaggagggcatgggggcagggctagccatgtaagtaagcatcctctccaagcctctgcttcctcacatggtgtgccctctggattttcccattccctctctggtggctggcacccctggagaagcagaggttgacttccctagcccccaggactgtagcagggtcyggggtggtgcacagtgctggccagctggcaaggggagctgcagcctgcagccaggacctggggaccacaggtggccaggtaggtctggcctctggtgctgccctcactgaatccgtgaatgttcagtgagttagttggtcacttcgcccacagtgaacctatgtgtcaagtcctggctgggtgctggacctctggagctgcacaagacccaggctctggcccccaggacagctggctgggaggaagaagcagccctcaggcttgagagatacccaaatgctgagatactgaaggccaagagcatcagggcctgagcagcaggtgctccatgcctttgcagtagcagtgccctctgccagggactccctggtcctgggccgcctggttgagatgtccaggctggactgattggttcctgtacgggcactggttgagctgttctcctctttgcacagacagcctccttggaggagctgtaactggcttgtcccccagcctgggacagggctggggcagtggagctagggtggtttcagtgtaactttccacctaggggtggccccacaccagtggctctcactggcaaactctccgggctcctgagtctccctcttttattttattttttcgagacagggtcttgctctgttgcccaagctggagtgtagtggcgtgatcatggctcactgcagcctcaacctcccaggctcaggtgatcccctcagctgggactacaggcatgccactatgccctgttaatttttttttaaatttcttgtagagatggaatttcattatgttgcccaggctggcctggagctcctgagctcaagcgatccatccgccttggtctcccaaagtgctgggattacaggtgtgagccaccgcatccagcctattttttatttatttttgttttttatttatttatttttttgagatggagtcttgctctgttgcccaggctggagtgcagtgacttgatctcagctcactgtaacgtccacctcctgggttccagcaattctcctgcctcagcctcctgagtagctgggattacaggagtgtgccaccacgcccagctaatttttgtatttttagtagagacagcgtttcaccatgttggtcagcctggtctcgaactcctgacttcaagtgatcctgtcttggcctcctaaagttctgggattacaggcatgagccaccgcrcctggcctatttattatttttatgtctcactctgtcacccagactgcagtgcagtggtgcgaacacagctcactgcagcctcgacctcctgggctcaaatgatcctcccacctcagcctcccaagtagctggaactacagatgtatgccaccgtgtccggctaagttttgtattttttgtagagatggggtttcacatgttgctcaggctcaccccatcttttattttyagagacagtctcactcttgtcacccaggctggagtgcagtagcacgatcttggctcactgcaacctctgactccygggttcaagcaattctcctgcttcagcctcctgagtagctgggatcgcaggcgtgagccactgcacccggccttagtccccctcttttagctctggggtagtgggagcctccaacagccctgcagcacccagcaagtcagctgtggcctccctgggcctctggtcctggctctgccttgcctcatgctggctccacacagccccccaaatctacctcttctttgtgggcagccaggcctgccctcgggtggcactctggggctagccagtgtgcctacaattttttccgtatttggccccagagtgggctcctggggagggggcagcatgccagccttgctccctgctcttccatttggtaaggcttagaggcaggaggcctggccccaagttgtcctgtggagggtcctcacagtgggtcttggcagctgcccctccaggctcaccttcctgcccttgccacctcccacagggcccctgcgctttgtcatcatccacaaacgctgcgtctactacttcaagagtagcacctctgcctccccgcagggcgccttctccctgagtggctataaccggtaagtgcccgacctgcctgctgacctcgggcccccacagccagcgggtccctcccagcagagccccagctgggcctgcccctwattcccgcccaaggaaagtgctttcccgaagcagccttcgtgcccatcccctgtcctccccgcccagcctccacagtgcctcgccctctccgcgtgtcctgccctcaggcgcaggaccttgggggtgccagggtcttcctgtggctttgtgcacaagtcccagaggcctggacagcctgctctccagagtctccactcggccaccacccagtgacttctgcatctctcctccctccccaccttgccccttcacccaccatgacctctttccaggcagcccagaccccagccagcccaggccctgtcccaaacagaggctgggccctaggattccctgctccagggtcctcccaggccgggatcagtttccagcttcacgcatgtcctgggctgggctctatccagtgatgggccatgagctgccctggagggccttctgcactaacaggcaggtgggcggtggccaggtggcatgtgggtgggggagtgcactggcacagcccatggcctggggcccacacaaagggttaatgctggcacccagctctggttctggttgctatcccatcggagccctgcaccccacagcatttatctatgcctcttaccaccccttaagggcccagcccctcctgcctatgaggaaccaagggtcacatggtatcagtagtggaactgggacctttggagtgactctaggccccggcctgcaccctggccacaggcctggtagggcagccttgccagagcacccagcctggtgccaggcccccatgctggcacagagctccggggtcccctggggaaggtcgttccctttctgcagacagacacagcgccttccggcctccagcatgtgccagccatgccatgaaccctgggcccagtggcagatgcaatcatgccccagggaattgtctagcccatcagggaatgctgggcctgaggagttttggccaggctcttatgggccgtataagtgcacctgccccggtgcctggctggcagggctccccacgtgataaactcagcgcaaaccccacatcctggctgtgtgagtgggccgcagagcaggcacgagtcattccctgaaatgcactcagggctgctgctgggcctcaggggcacggagccctgtggggtaccccagggaggccaagcaggcctgggcaaatggggccagaggtgggagggtggcgtccatgtaaagtggcattggcgggcatcgaggcaggtttgtccttgtctcctgtgcactgctgctcccacgaagcccacccagcacccctcttccatgcccctccatgcccccttacgcctgcctgggcatgaagctcactactgggagcatcagcagccagggcccacccagatctgccctcttccgttggggcgtggtgctggtgccgagacgtgttcacaggggggtgctgtgggaaggccatccctatagctgtgaaccaggccgtgacccctggcgctgtgcccccagggtgatgcgggcggctgaggagaccacgtccaacaacgttttccccttcaagatcatccayatcagcaagaagcaccgcacgtggttcttctcggcctcctccgaggaggagcgcaaggtgactgggggtcckaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaayatgctgtcctgggaggtgcccctgtgggctgaggggagccacacagccatgttgtatccagccgggtcgcctcctctgaccttgggagtcacagcagagcaggcagggcagtgaaggtggaggggtgcggtggggyccaccctggtggcaccgtgcccaccacagccccgctgacctgcagagctggatggccttgctgcgcagggagattggccacttccacgaaaagaaagacctgccsttggacaccaggtgagcccgggcccagggcataccgggcagtgagggtccctggggcgcctgggcctgacccgggtgtccrcctyccagccccgggcttggcatagaattccgtccttaaaggtttcctggaggtgccagctgggctgcgtctctctgctcctgtctacagataaacacagatacaggacaagcacagatgttcacacacagacgagcgacacgcggacacgcacacacaaacacaagcaacacgcggacatgcacacacacagagcaacacgtggacatgcacacacacacagagcaacacgtggacatgcacacacacacagcaacacgtggacatgcacacacacacagcaacacgcagacatgcacacacaaacacagagcaacacacagacatgcacacacacacagagcatgcacaggtgtgcatgcatctctctgctcctgtctacctccagccccatctgtcacatctgtttctgtgttgccgccatgggtagttcctgttaggggatcatgtgtgtttatacgcctgccaccagggaggcctggcatggcagcagctgggcactttgggttcccagccccctacgcccaccctggctcactcagagtgagaccagaatgattctcctggcggggcgccactgggcagtctgagccttggcagcctcccccgtgagctggcccgacgtgcagcagatactctctggattgggactycctggcccgagacgatgtggagggaacaaaccttcctgtcctttcacaggtggggacaggaggcccagggagggctgggcacagccaaggctgccctgcaggtccctgcctgactccgggctcccgtcccctggtccaagctgttcagcctcgggcccagcccagagtcgcccaagccctcttgaggcaggagcaggtggagacgtgggcacagtcagggcggccatccttgtgggccagaaggggcacctagtggaggcaccacagcctccagttcttctgtctgtccttgtaactgtgtgtgcatgtccgcgtgttgctctgtgtgtgtgcatgtccgcgtgttgctctgtgtgtgtgtgtgtgcatgtccacgtgttgctctgtgtttgtgtgtgcatgtctgcgtgttgctctgtgtttgtgtgtgcatgtccgcgtgttgctctgtgtgtgtgcatgtccacgtgttgctctgtgtttgtgtgtgcatgtccgcgtgttgctctgtgtgtgtgcatgtccgcgtgttgctgtttgtgtgtgcatgtctgcgtgttgctctgtgtgtgtgtgcatgtccgcgtgttgctctgtgtgtgtgtgtgtgcatgtctgcatgttgctctgtgtgtgtgtgcatgtctgtgtgttgctctgtgtttgtgtgtgcatgtctgcgtgttgctctgtgtgtgtgtgcatgtccacgtgttgctctgtgtgtgtgcatgtcctcatgttgctctgtgtgtgtgtgcatgtccgcatgttgctctgtgtgtgtgcatgtccgcgtgttgcttgtgtttgtgtgtgcgtgtccgtgtgtcgctcgtctgtgtgtgaacatgtgtgcttgtcctgtatctgtgtttatctgtatacttccatgtctgtgtgacagagtccttgtgtctgtgtgtctacatgtctgcgcgtgtccctgtgtctttktgtatatatatccatgcctgtgtgcctgtgttcctgcgtgtgcttgtgtgtgcacgtgtgcatttgtgtgtttgtcagagtatgtrtgcatgtgtgtgtctgtcagcgtatccatgtgtgcatgtgtgtgtctgtcagcgkatccgtgtgtgcatgtgtgtgtctgtcagcttaaccatgtgtgcatgtgtttgtcagtgtatcygtgtgtgcatctgtgtatctgtccatgtatcygcgtgtgcctgtgtgtacctttgtgtgagcatcaagggacctcccaggcctggtgctcaccgtccgccccaacgcaccctgcattgcagcgactccagctcggacacagacagcttctacggcgyagttgagcggcctgtggatatcagcctttccccgtaccccacggacaatgaaggtgaggtctttctccgcatccactgcccgttygcctctccccacctggcctcctcttggccgctgtggaggagagggaggtgtgttcggctgtgctccttgctctggccctttggcagtgcgcagtagcatccctgggctctggccttcagcggcagggtctggactcacagtcctcccagcaggtgcttgccccttgcctcctggactcagccccatgcatggagcattgctcggagactgggcctgggccggtttggctctcaccacmcccctctccccatgcagactatgagcacgacgatgaggatgactcctacctggagcctgactccccggagcccggaaggcttgagggtaggtgrggcgggtgggcccggggagctctgggtgtgtaggaagcaggggctgggaccgggagcagagcccctccsaggctggggatgctggcccaggtaccgctctgggtggcttccgcttccctgctgtgtcccaagtattatgaggattggagcagaagaggtgtagctgctgccacctctgctcatttcctcctcccacctcccaggaggagggacaggcacatggcgataagtggcaggtggagccggggtggccctgggggttaagcatggggaaggaaggacgctgaggagcgcgcaggctcagggcaggtccatgtccccatggctgccagcttgtgtggacactgctgcaggccaggtcgttgtcccaccccaccccatcccatcccagtgtccacctacctcctgcagcacatggcctagtcaaagagacaggctgatacaggtggtcacacgtggatgacggaagcacgagctgggtggggaggacgtgtctctgtcctcctctgtcscctccctcccttcctccctccctattgtctctccagccccctcatcttgtcaatttcctcatgtctggggctgatccttgatccttccattttccctgcgtccgccctgcctccttgttttccagcctcctgttctcactgacttggcctctgctgaccccagcccctgaccccgtatcctctctgcctcccatcccctcccaccttcaggctcccgggtccagcccctcttctcctgccgctccctccctccttccctctggggtcccagtgccaacagtccttcagcccacsagggtctgcgggccgcttgcctcagtttccttccatgcagagctcttgtctcacagtgttcaccatgcctgtcccttcgcccacacactactgccttccgtcttagcctggctggccaagccttggtgaactcagactccgtctgcccagccctgagctgcagcccagtgaggctagagatgggcctggggagccaccagtgctcctgcatgctactgctccactcaccctccctctgtacccccttcatcctctccccgagacatttctcgtccaggacgcctgtggcctccccattcccagttccagcgctcagtcctgagccacaccagcctggcgcctgccctgttccttgccagcccgtcctccaggcgccccgtgctcccagggtcctctttctcctcagctcctgtgctggccccatgagggatacccgggactcagacctcactcctctcccgaattccctgggtgacagcctgggtcatctgcaggctgcccgctccgagtcatgtccagcctggatttttgaactctgcacacattccctgaccccgcatcccctggcatctcccagctttctggatatgttctgagcaaacacgggccttcaccttcctcccagctgctcccctcccctgtccttgggaattccgtcctccctctcgctccagccgagccctgagatccttcttgacttctcttcctttctcttccttccacctctgggaacctgatgggctcctcaggtgtcctctaggcttcaggaagcgtccacaggctgccatagggaggatgaatggggaaggctgggggtggtgggtggtctgggaccctggggaaggcaggatgggagtgctgggtgctgggctgctgggtgggcaggctgtggggtgggcctaccatgggttgcactcctggttggcctggctgaccactgccagcagaggatagtgttggcccagtctctgtcagggtccaacccgggtctctttgctctgcagatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggckgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagtgagtttgtgtggcggctgcaagccctgcctccagctasagggaccctggcctggcctctgacgggcactctgcccacctcgctcccctggcactcttagcccacgacggggtaccaggtgcaagggtaggaaggttcccggttgcctccagtccgccttggtggaacgtggagcatgtccatgactcagccctgaagcttgctggaaatgctttgtttttttttctttttgagacagggtctcacgctggcaaccaagctggagtgcagtggtgcgatctcagctcactgcaacctccacctccggggttcaggtgattctcctgcctcagcctcccaagtagctgggactacaggcacctgccaacacgcccggctaatttttgtatttttagtagagacaggggtttcactatgttggccaggttggtcttgaactcctggtctcaagtgatccgcctgcctcggcctctcaaagtgtagagattacgggcgtgagccaccgcgtcctgctgaaatgctttctgctttatttctgggaagtgccaggagaccagtttgtcccccactcccacagagttacgccaatggctgtggtcaaaggcatctgggaccccaggtgggcttcctgccttgcctggcaggcaaagggtccaggaactggaggggcaggtttcgcatgggtgtgctggccggcacgcgcacccccgaatgcccttgcccacggtgcccttctcccagggctctgcgaacacctctgagatgcctgctgcctgtgtggaagtgcctctgagcagcccttgtcacactcgtggttctagttcaccaagggctgcagagatgcagatgttyggaagtcacgtttttccatgactgtggggatagcggttccagggctcagcctcacccacaggctggcctcccatgctggcgtggcccgttaatcctccctagagcctttgaggctttgctgagcaggaccggctagccacacagggaggcgtgcagggacgccatgggcgtcctttggggtcacactgcattgttcatccagttcacgtccactcccctgtggctctgagtgggctgtgatttggccatgaccggacctcccctccccacgagcatccagagcacttgttgacggtgtgatgacactgagcttgggaaccctggactcccttgccagcatccatggcagccctgacccctgactccggtgtcgggcgattcctgctgtcccagggcagtcagcacgagccctacccggatctctgttgtcctgagctttttagggtcacaggggccatagcaggcagcttgccgtcctcacacagagggtggagtgggsaggggagcagagggtggccgccccgtgtctgacagtgaaatggtcctgccttcctctccctgcccctccaggcgatcaccccccgatgggcagagtttcaggagcttctcctttgaaaagccccggcaaccctcacaggctgacactggcggggacgactcrgacgaggactatgagaaggcaaggctgagcggcaagcctgggtcccagtggccagtaggtggacaggtggtgggaaagccataggccagggcggcccctcacagaccgtccygagcaaggaccccccgagaaccygggagcctagggggacacagcaccatgtaaagccccggatcccggcaccgggtggccaccgtcyggggagtggtggtgcgggtggatcactccgacgttggcactgacaccgtcagcctcttgcaggtgccactgcccaactcggtcttcgtcaacaccacggagtcctgcgaagtggaaaggtcagcacaaagccctgtgtgtgctgggtcctccgccatgcccggcttcctgcttctgtgtccctctcactagcttccgtgttggggagttgctggcacaagttcatggccctgcgtgcagcagaaaccagaggagtggacctccctgctctgtcccatgcccagctggcaccctggctggccagggctctgctgggctgcttctgtcagcctcacggcagcccgacgtgctcagctcctgagacctacaacagcgagagracagaaagccaggcttgggagcggggcgggaaggtccgtgtgaaagctgcccgaggaggactcacccgctaatatgactgwcttattttaggttgttcaaggctacaagcccccggggagagccccaggatggactctactgcatccggaactcctctaccaagtcggggaaggtaggcgccaggggaagatgccccagggcccctctggctctccacacacccaggctgtgggtgggcccaggactccacagttcctaaaccrctccccttgtggactcttacttggtgtctcagctgaattctcttcccagcagcaccccccaatctattccctaatagatctccatctgcaaattgggggccatgatggccacctcccagtgggggccaggactcgggtggggtagggctcatgctctggggtggcggaggccacatggggcaggggaacgccaggtctgcccgtgtccctccgagcgtgaagttgtgacctcactgagccatgctctcccgggtgtgtcggagtggttattggtggttatgagctgttgctcatcagaggctctctgagggctgccagtgtcgyccccgctgtccttgtgcaggtggtctggagtccctccccgccccccgagggccacaggacccagccttgatggttctgcccccctatccccagcccatggtctcccgaggctggtcccgctgtttctcagggagccgtcagcctcccgcttccgtcctgtaggtcctggttgtgtgggacgaaacctctaacaaagtgaggaactatcgcatttttgagaaggtgagagggctctgagtgggacggggaccctggccgcatggcctggcaaggggcagggcagaatctccctgatgaggcataggcagcgggtagactgagactggcacctccaggataccgccctccccttcccctccaccatcgctcaccccccacccctcctgctcagcctccctcctctcgtggcctacctttgtcctccactgaccctagtggggatgggcggtcagccatagaccctgggttgcttgtcttgtctttttctttttgcggggacaggggtctcactgtctttctcaggctggtttcaaattctggggctcaagcaatcctcccacctcggcctcccacagtgctgggattacaggcgtgrgccaccgtgcctggcctaggttcatttcctgaccttgtctgaagtgctctgggtgcaggctcctggacatggaggacggaggggaagtgaggtgggaacatggagagcacaggcctgatgcggaggccaccttgggggcaccaccgacagccaggggccagcctggtgatgccgctgttgatgctgctgccttgttttacagacggggagactgaggcctagagccgcagagtggcctggccctgctgacgctcccccttctcttcccccacaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggycctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctaygatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctrgaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgwgctagtgagtggtgcagtccaggacacctttgctttatstcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgygttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccascagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccarccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgctacatattgtctcacttgtgtttgtgttttcttcctcccttttctctccttttccccttctttgagattgagcaacttaaaacaaatcatttcatttccccccttctcctagttagaaagttaaacactctctattcttactgaagtctagagttaactaataaatacttttatcctcctcctggacaacataaggacctcaggtgactttcattggtctccctcattacttgatattattgttgtatatatctaattctaactcaatgtattttaaaactctcacctaagaccgtatttgtttttttgtttttttttttttggaggcagagtctctgtcacccaggctggagtgcagtggcgccatcttggctcattgcaacctccatctcctgggttcaagcaattcttgtgcctcagcctcctgagtagctggaattacaggtgcctgccaccagacccagctaatttcttgtatttttagtagagacagtgttctgccatgttgtccatgttgatctcttaactcctgagctcaggcaatcctcccgccttggcctcccaaattgctaggattacaggcaagagccaccacgcctggacctttttacttttttgtagttggaaaaggaaggaatattttaatagctttaaaattgttttattatgataaaattttcatattataaagtttatcattttaattattttaaagtgtacagttctgtggctttgcgaatattcatattattgttcagtcatcaccaccatccatctccagaactttttcatcaccccaagcttaaactctgtacccattaaacactaaatccccattcctccagccctttgcaaccaccattctacctcctgtctctctgaatttgactactctagacacctcatacaagtggaatcatacatttatctttttgtgattgggttatttcacatagcatgtcttcagtgttcatccatgttgtagcatgcgtcagaatttcctttcttttggccaggcatcgtggtttatgggtttatgcctgtaatcccagcactttgggaggctgagtttggatttgggaagattgcttgagcctaggagtttgagaccagccctggcaacatagtgagatcccgtctctacaaaaaataacaaaaattagccaggcatgttggcacgtgctggtagtcccagctacttgggaggctgaggcaggaggatcccttgagcctaggaggtcaaggctgcagtgagccatggttgcaacactgcactgcagcctgggcgacagagaccctgactccaaaaaaaaaaaaaaaaaaaaaaaaaaggcacaaaaccccaataaatagaatttccttctctgcataatgctgctatgaacatggtacaaatagctgttttcatttctttggggtatatatccagaagtggaattgctggattatgtggtaattatgtttaattttttgaggaaccactctacggttttccacagcagccacaccattttacattcccgtcagcgatgcacaaagggttccaatttctccgcatctttgccaacacttattttctttttttcctcttcttcctccttctccccccttgaaactttttgttttcttctcgtttttgtagagaacagggtctccttatgttgtccagtcaagtctgccaactcctgggctcaggctatcctcctgtttctgcctccctaagtgctgggattttaggctgaagccactgcgcccaactccctgcttcttcaactgccatcctaatgaatgttaagtggtatcccacagtggttttgatttgcgtttccctagtgattaactatgggaagcagaagtgaatgagacagaattgtgatcttgtcagaaaaatcgtcttggaaaagccaacgtccaacagaaatggttagaacaggggtcgctggcttccatccagacagtatccctgacccttgttggggcaatgtcacagaggctcctgctgagcagggaggtctggattccacactcttctgccactgcccagctctggacctaagctttctatgggtgtcaagaggacaagcagccgtgcccatttgtctcgctgcttgtttttttgggtgtcagatgcgccagcaggagggacagtgtgcgggaaggtgctggtctgaggctggtcctgccaaagccccgcaggctcactccctggtcgtgcggaggtggctggtgctcgctggtctcctcagcacccgcaggccgggcccgggggccaggcagttgtcctctgtggagccttatcggggcccacaggccctgctgccttgaccccacccgggccccaaaactcggcctggggactgcacaaggcggggctacgcggggcagggcccgtctgctgggggagtgcgctgggcggcggcgggagggcagggtccctgggctccgacagcccctccggcggaggtcaatcacaatgaaaccgtgtccagcggacccggcaggggctcgccgcagtctacctggccaccgtgaagccatgacctggcgcccgaagctgccggccggggtgtactccgcgcgggaccctgggcctccgcaggccccggcggggtcgccccgaggcgggcctggcgagtccaatcgccctgcccgcaggggacccgcccctcatgggtcccgccaatcgcagggtacgttgctcggcagtgctgcgcggcttggcctatgggacggcgcgttgttgggctgcagcgccgcaggccgcacccaggtcgggcggtgggggcgagcggaggggctgaggggcggagaggcctggcgggccgctgctgcgggccaggggacgggggcggagccrgagccggagccgacgggcggtggccgcactgggaccccggaatcccgcgcgctgcccacgattcgcttctgaggtgaggctagctagcgggggcggcgggggcccggttcgggctgaggcggcggcgggggcgcggggaactgggccgcggttgcggcgggcgggggccgcggggcctgcggcggcccgggcagcctcgggggcggggaggccgctgcggcgccgagggcgtcttggaggggtccccgcggggccttcggcctgggccgagccggggagcgagggcgccgcagatctttcatcgggataggaccccggggactaggcttttcccgggccgctcgttcctggccggcttgtgggctgcaggggtgggggcggaggaggacgaccctggctggacgctggtcagcatcctgcttgtgagaccggttccgcggtccgcagcgctggtggctgcaaggtttgtgtacggacgcatctgtcggctctcgtatttaaaaacgacggcttctgccaaaagagaaaagccatatctgccgacggacgctcgagagataatcgtggaactttatcagcgatggggctgttggtcacctttgccctccctctcttttcttttttcttaatcttttattttcgttttttgggagatgtcagagggcctttccctgttaggatgacttttatctttgctcttgtaatggctcaagatagttgggaggtaatttgcattcactttatgcatacccaccttgaaaaacgtattttggttcgcctgaaactgttgttggtttgagcataatttatgtttagaaagacaaaaagcaattgtcatatctccaaagaccaaagacatagctgatagctgtakgcattactggtaagttaaagaaagattttttgtgtgaaaaattgactgagatcttaatggggataggaaatagaatgctgataggtcgactgtgtctatgagtagaggcgcctagtgaaaacaagcttggagtggatgagtaggagttcaacaggcaccagagagaggagggcatttcaggcagagggtgtgaattgtatgaaagtgagtttgtaaactttggagccttgaatggacaaaggcccgygatgataccttttttttttgagacggagtctcgctctgtcgccaggctggagtacagtggcgcgatctccagtcactgcaatctccgcctcccaggttcaagcaattctcctacctcagcctcccgagtagctgggactacaggcgcgcgccaccacgcccagctaatttttgtatttttagtagagacggggtttcaccatgttggccaggatggtctcagtctcttgacctcgtgatccgtccgcctaggcctccaaaagtgctgggattacaggcgtgagccaccgcgcctggcctacgttaaaattttaatatactcctttgattttgacagtggagaaaactagaatagtaaagttgtcttttcaggaagtggatgatttgggcagtcaaaactgcttttcagagtttcgatgtggtttacaatggtatggacagctggtatgatttgttagttttctacttgtggtgtctttaggttttaaagtttcggagagtcgctgagtgatgtgagtctaaactctagccagtccccgaattgtgagatagttttccttctaaaatatacttcgtacaagctggtcatttttccccttaattcttttgatgttatctgatatactgagaaggttttgtttggtgttcagttttgtgttactgattttgccataaaaactgtttatttacatgatttttagtttttagttcttatagtctttgaattgaataagaaaagtaaatactgaaatgctttgaaagataacaaaatatttacttattgcttgaaacttagagttagattgactgcccttcctttctttccttccatgtttacctcttaacatatacacatatgtagagagaatagtataaaccccttttctcaaccagtttcaacagtcaatcttgcttcatcatatccccgcagtcctagatatcctttaaccgttaaatagttcaatatgtatatcttaaagacttaaacaaaaggtaaacatgagtaccactatcacagaaaatgaataattccttaatactttcaaatatccagccagtgttaaaattgtcagaattctcattttttttcttaacaatttcaatcgatccacatgctatctatacagtgtgactcattttaattgatagtttcccctccatatttagttttctcttgtaatttatttatggatgaaacctggtagtttgtcatgtggagttatgcacagtctcaattttactctgtggcatagtttcacagaatttactgaaaactggtggttagatctaaaggtatgatcagattcagctttacttttgtcaagcaaacttcttaggtaagtaggcagaaatgattagtagtctttgttcgcagcccttgattgtcagtgcctacagtcatttcagcaagcattgaatatattgatatttgaattctataacttcttttattaaatagaatatttttataaagataatttttcatgcctccactatttggttatcttgaggtatctcttacagaaaagggaggataaatgcttaattcttctccattatttactaggtttcacataatgaattgtttcgctaatatccttcaaaagtagccaatgaagctgggcatgctaggatgggcctgtaatcgtagctgctcctgaggctaagatggtacgaacctgtgagcctgggaggtcgaggctacagtgagccatgatcacttcactgcactactctgtctctttaaaaaaaaaaaaaaaaaaaagccgagcgtggtggctcacacctgtaatcccagcactttgggaggccgaggcgggcggatcatgaggtcaggagatcgagaccatcctggctaacatggtgaaatcccgtctctactaaaaacgcaaaaaattagctgggcgtggtggcggatgcctgtagtcccagctactcgggaggctgaggcaggagaatggcgtgaacccgggaggcggagcttgcagtgagtggagatcgctccgttgcactgtagcctgggcgacacggagcgagactccgtctcaaaaaaacaaaaacaaaaacaaaaaacaagctaggtgcggtcgctcacaatcccggcactttgggaggctgaggcaggtggatcgcctgaggtcaggagtttgagaccagcctggacaacagtgaaacctcatctctactaaaaatacaaaaattagctgggcatggtggtgcatgcctgtaatccccactactagggaggctgaggcaggagaatcgcttgaacccaggaggcggaggtcgcagtgccattgcactccattctgggcaacaaaagcgaaactccgtctcaaaaaaaaaaaaggaagtaagactaggattctactcaaccttctcatttttatatacctgtatctacttttcttctaagccaaacattttggttctacttgctcactgtttcaacccacaccgtacacatttcagtctcagaacaagatgaacacgtgaacctcgaaaatttgagacaggtctcggttaacttagaaagtttattttgctagtgttgagaatgtgtgcctgtgacacagcctccagaagtcctgattgacatgtgcccaaggtggttgggcacagcttggttttatacattttaaggagacatgagacatcaatcaatatatgctagaagtacattggttcagtccagaacggcggggacagcttgaagcagggagggagcttccaggtcacaagtaggtgagagacaaatggttgccttcttttgagtttctgataagcctttcctaaggaggcaaccagatatgcatctatctcagtgagcaaagggatgactttgaatagagtgggaggcaaggctgggcatggtggctcacgtctgtaatcccagcactttgggaggccgaggcaggtggatcacctgagatcaggagttcgaggccagcctggccagcatgatgaaaccctgtctctactaaaaatacaaaaattagtcaggcttggtggtggatgcctgtaatcccaggtactcaagaggctgaggcgggagaatcacttgaacccaggaggcggaggttacagtgagttgagatcgtgccattgcattccagcctgggacagagtgagactccgtctcaaaaaaaaaaaaaaataggaatcttaacatagcataatattaaactttaatagagttgtttaattgttaatgcttattctggcctttctacattgaggaaccttgagtttaaaggaatgaggggaagcacatttaatacagtttgccttttgagcttaatttttctagaagtacctttttaaacagttgttataactaatgtrtaacactgtttttgataactgtcagcttaaacatgttgagcatatatttatttaattaatttattttttttgagacagactcttgctctgtcacctaggcgggaatatagtgatgtgatcatagtttgccgcagccttgaactcctgggcttaagccattctcccacctctgactctgaagtagctaagactgcaggttcatgccaacaggcttggctaatttttttttttttttgagataaggtttcaaaagcctgagctgtgttgctcaggctggtcttgaattcctggtctcaagtgatcctcctgtctcagcctctgaatatgctaggataacaggcatgagtcactgcacctgacctgtttccaggtttttactgttataagcagtgctccaattaatattacatctccatattgggcacttatgaggtacatctataaatacattctcagaaatgaaattgctatgtcaaagaataattgcacttttcatttgcatagacatttccaaattaccctcctggccccaattaatattcttacatttccatctttgggcacctatgaagtatatctatagatacattctcagaagtgagatkgccatgtcaaagagtaattacacttttactttccgtagatgtttccagattatcctcctaagaagttacgttggtttatactcctaccaactgtgtattttctccacataattaagtatggacactaaagtaacaatagtccctatcttacatggttattgtgaggattaaatgaagtaaatgccaaaaggtacctactaagctgtcagcaaatgacttatattattaatataattattgtttttttctgaactttattaccagaaatattataaacctagacagtgcttcatgaggttgggaaagagggttcatacaattgatctgagcaatatatgcctccaaaatactgttatctgtattagaacagacgagctctgcatctaggccttgggcccagggagtctggcatctggggctgacgttaggggacagagtccacaggtatatctcaaatttgctggaaagggcatgcctcaggaatggggcgcagtagatgtaactacatgtgtgcctctgcagcctggaatggcagctgtggctgtttgcatggggaggagaaagtcatcatttgggagggacctttagaatatcccatcccaaacacttctctccttctcttactctgaagggcttaatttaaatttgctttgtggattaacgtattgagaatgatttagggagttccttacctaaaaaatgttttccctcatctgcacactgtcgcttgaaatttatttcacaggagagggagccgtaaccataggcagtgtggtattatgaaaggagtactggctcttcactatgggtttactgtggtttgctgagggtagttgagtgggtgagaaagtcacttagctgccccaagcctcacttttctccatcggaaaattaagtagccatgtaatacatgaaagagagaatgttgtgaaaacactttgagaatgcaaaggccaagtgaaaacatatgtccgtacaaaagcttgtgtgtgaatgttcagagcagcattatgtttaacagacaaaaagtgaaacaccccagatgtccatcagctaatgagtggatcaacaaaatgtggtctgttcatacgatggaatagtagttggcaatagaaaggattgaagcactcatacctggtacaacatggatgaactctgaaaacatgctaagtggaagaagccaracacaagagaccatgtgcttcatgattttacttatgtgaaatgtcttcaataggcaaatctttttgttttttgttttttgtgagactgaatctcactctcttgcccaggctggagtgcagtggtgcgatcttggctcactgcaacctccwcctcccaagttcaagcgattctcctgcctcagcctcctgagtagctgggaacaggtgtgtgccaccatgcccggctgatttttttttctgagacggtgtcttgctctgtcgcccaggctggagtkcagtggcacgatcttggctcactgcaagctctgcctcccgggttcacgccattctcctgcctcagcctcctgagtagctgggactacaggcgcctgccaccatgcccggctaattttttgtatttttagtagagatggggtttcaccgtgttagccaggatggtctcaatctcctgacctcatgatccgcccgcctcggcctcccaaagtgctgggattacaggcgtgagcyaccgcgcctggccacgcccggctaatttttatatttgtagtagagatggggtttcaccacgttgcccaggctggtcttgaactcctgacctcaagtgacccacccgcctcggcctcccaaagtgctgggattacaggtgtgagccactgtacctgacccccagtaggcaaatctatacaggcagaaggtagatttggggttgactggggctccagctggggagaatggagtgggaatgaggaatgactgctaatgtgtatggggtttctttttgggtgttgaaaatgttataacgttagattgtgatgattagttacacaactctgaatacactaaaactctgtatacttcatttagagacagtcttgctctattgttcaggttggggaacagtggtataatcatagctgactgtaacctggaactcctgggctcaagtaatcctccccacctcagcctccggaatagctaggactactggtgcataccaccacagctggctaatttttaaaaatgttgccactcaagatgtgtggccctggatcaaaatggtgaaattctctgaactaatttttctcatctgcagaaataggagtaataataataacagtcatatctaactggaggtgtgaggctgtggtaagcaaacttacaatgcttacagtatgtgaggattctgtcagtgtgctttctttccttcttttccagaacatagaggatggaggagcaggccttaagagggaaagacacagaagatgcaatagagagccttgtagctcttttttgtctgtctctccctctctctcaaaataaagcctatgtagaggtatttttttgtctgatacagctgcatgtgtttgcagtttagtaggaactttgtggttaaaccatgctttctaagattttcttaaaaggccaaccttgttgccagatgataccattaatcaagttattcaagttattgtcacatagggcttcaggcaggaaggaaggttaggaatggtctttagtctcatagaatgaactcccttttggtctgagtgtctccttcagtaggaagggatgtgatgttaattgaccagtctttaggggggaaatagatgacccccaccatccggatactcagtttttattcttttttttttttgagatggagtttcgctcttgttgcccaggctggagckcaatggctcgatctcggctcaccgcaacctccgcctcccaggttcaagcaattctacttcagcctcccgagtagctgagattacaggcatgcatcactacgcccggctaatttttgtatttttagtagagacggggtttccccatgttgaggctggtctcgaactcctgacctcaggtgatctgcccgcctcagcctcccaaagtgctgggattacaggcatgagccacagcacccggcctcttttctttctttctttctttctttctttctttctttctttctttctttctttctttctttcctttctttcctttcctttctttcctttctttcctttctttctttctttctctttctttctttccttccttccttccttccttcttttcttttcttttcttttcttttcttttttttcttttcttttctttctttttttttttttttgaaagagagtctcgctctttcgcccaggctggagtacagtggtgcgatcttggctcactgcaacctccgcctcccgggttcaagcgattcttgtgccccagcgtactgagtagctgggattacaggtgcacagcaccacacccggctgatttttgtgtgtttttgtagagatggggtttcgcagatactccatttcagtttttttctgagcaacgtctccagggactgaagcacacatactttgacaacagaatcaccagcaatgtcactgacctagggtgtctgcagcattcagtgtcttctattttctrtactaggtgttttctgtactgtttgtaaagcaggaaatatctttttttttttttttttttggagacagagtcttgctctgtcacccaggctgaagtgcagcggtgcgatcttggctctcactgcagccttgacctcgtgggcccgagcagtcctcccacccagcttcctgagcagctgggcctgcagacccaccccaccacacccagctaactaaaaaaattttttttttagtagagccaaggccttgctatgttgcccaggcaggcctgaaggtgcttttaaactcagataagcaggacatttgtagctgtggaaatagctgtaatctaaccatcagagttgttttaaggatacaaattacatatagtgtttaaagcataatgaatgtacaggttgctagattgggttttactctgttctttctgtaactttttagaagttggtcacttactttttttttttttttttttgagacaggttctcactgtgttgcccaggctggagtgcagtggcacgatcttggctccctgcaacctctgtctcccaggttcaagcaattctcccacctcagcctccccagtacctgggattataggcgcccaccacacccagctaatttttataattttagtagagataagggtttcaccatgttggccaggctggtctcaaacatctgacctcaggtgatctgcccacctcagcctcccaaagtgctgggattacaggtgtgagccaccggcgtctttttctagtataagtgtttaaggctatatagctctctagaagcatctctttagtgaagccaatagtttccaactgtaatatttttgttagtaatgtatatttaaattttcattatgatttcttttttggcccataaattattttaaaatgtacctttaaatttctaaatatatggtttgaagaaactcttctgttattatgttgtttttttttctttcagactgagttttgctctcgtcacccaggctggagtgcaatggtgcaatcacggctcaccgcaaccttcgcctcccaggttcaagcgattctcctccctcagtctcccaagtagctgggattacaggtgcccgccaccacgcctggctggtttttgtatttttaatagagacagggtttcaccacattggccagggtggtcttgaactcctgacctcaggtgatccacctgcctcggcctccaaaagtgctgggattaaaggcgtgagcgaccgcgtctggccgttattatgttttaattgcattgcacccggagaaatggcttgtgtgctgctgattccctggaatttgttgtgattttctttattgccagatatgacatgaatgtttataaacattccttgtattctaaagaatatgggctgggtgcagtggctcatgcctgtaatcccagcactttaggaggctgaggtgggcggatcacctgagatcaggagtttgagaccagcttggccgacatggtgaaaccccatctgtactaaaaatacaacaaaattagcccagtgtggtggcacacgcctgtaataccagctactcaggaggctgaggcaggagcattgcttgaacctaggaggcgtaggctgcagtgagccaagatcatgccactgcattccagtctgggcgacagaatgagactccatcttaagaaagcaagcaagcaagcaagmaagaaagaatatgtatttaatttgtgtgagaaagggaggtgcaaggttctgtatatctctaatgatctaactttttgcttgcattgctcatatttcctatttactgttactgacttgagcaatgtggtagattattatggtaatctcattatggtagatttgtcagtttctctgtgagttctagcaatttttggttcatatatgttgacagtattttattaggtgtgaataaccttatacttttcatcttcctgttgagctgtacttaggtttatggccttttccattccgaataaatgcttttattttcttggtcttcattgtctgatattaatataattactccagctttgttttgtttggtgtttgcctggtatttgtatttttgtccatttattttcagactgtctgtgttctgtttcatgggtatattagttttttgtggctcctgtaacaagttaccacatacgtggtgctttaaaacagcagaaattattctctcatagttctggaggccagaagtttgaaaacaatatcactggaccaaaatcaaggtgtcactagggctgtgcattcttcctctggaggtcgtatgggagaatctgttcctcgyctcttccagcttctcatggctgccacattccttggctgtggctgcatcactccaatctttgtgacccaggtcagattggtttcttgtcttctgtgtggttaaatctcccccacctcgattttataaggatactggtgattacattcagggcccacccaggtaatccaggataatttcacaatcccaaaatacttaattatatctgtagtctttgccatataaagtaatatttacaggttccaggcattattcagacctgttaacttggggaccgttactcagcttactaaaagagtgtctcttataagttacctgtaatttctgtcttttaactggcataatttagtacatttatgttatgattcagataaatttgtactttctttatcatcttaggttttgtattctgtttgtcttttctccccatgcttgcctttttaaacaactgggagttgtttgtttttctttatattcttccatcttttggtttggaaatgacatactcttaatattcttttagtgattacccttgaaattttgctatgcatatttaacgaagtctaaaactaatattctgtcgccctcctagatacagcaaaggcatgaaagttctttaattccaattattcaactctcaagttacatgctgctgttgttcagtgttttagtccagactttttttttttctttttaaagagacacagtcttgctctgacactcagactggagtgcacaagtttttttcttttcttttttttgagacaggttctcactctgttgcccaggctggagtgcagtggcgcgatcacagctcactgcagccttgacctcctgagctttagtgatcctcccacttcagcccccaagtagctgggactacaggcacatgccgccatgaccagctattttttgtatttttttgttgaaacagggttttgccatgttgtgtaggctagtctcaaactctgggactcgagatctgcctgcctcagtctcccagagtgctaggattacaggcgtgcaccaccattgggcatggtggtgcatgcctgtagtcccagctactcggaaattatttcacacaagttcttttttaaaaaaaaaaaaaaaaatagagacgagtcttactattatgttgcccaggctggtcttgaattcctgggctcaagtatcctcccacctcagccttccaaagtgctaggattacaggcatgagccaccactcccaaccttcacctaagttcttgaaagataattttgcttgatatagaaatccagattgacagttatttcttttcagcattttggagttatcctrctgctctctacttttgttgtttctgttggcaagtttggcagtagtcggtttgttattcccttgtaggtgatctgtctttttttcttctggcttctgttagaattttcttttctttattttggccttggctattctgcatattcattacaatgtgtgtaaggtatggatttatctttatttattttgcttggtttttgtagattcatgtctttcagctctgggaagttgtcagccattttcttttggaatatttactgttccctatttattatttctgcatgttactcaagtaaatggttactagagttttttttttttttttttttttcctgagacggggtcttgctccgttgctcaggctggagtgctgtggcatgaactctgctcactgcaacctccacctcctgggttcaagtgattctctcgtctcagcctccaagtagctgggactacaggcgtgcaccaccatatctggctaatttttgtatttttaatagagatggggtttcaccacgttggccaggctggtctcaaactcctgacctcaggtgatctgcccaccttggcctcccgaagtgctggaattacaggtgtgagccaccacacccagccaacgttcttattctgttattttttattttttattttttttgagatggagtcttgctttgtcgcccaggctggagtgcagtggcggcatctcagctcactgcaacctccacctcctgggttcaagcaattcttctgcctcagcctcctgagtagctgggactacaggctcatgccaccacgcctggctaattttttgtatttttagtagagacagggtttcaccatgttagccaggctggtcttgaactcctgacctcatgatctgcctgtctcagcctcccaaagtgctaagattacagacgtgagccaccacacccggccagggcaattttttcaaagctgtgttttaattcgcaaattcctctttgtatctaagctgttactcattttttgacctaaaaattcaatttaaatttcttttattctaaaagttagcaggtgtggtggtgctcctgcagtctcagagtcccagctactcaagaggctgaagttagaggatcgcttgagcccaggagtttgagaccagtgtgggtaaatcgaaaccctgtctctacataaaatacaaaaattagccggacatgatggggtgcacttgtggtctgagctactcaggaggctgaggtgggaggatcacttgagctcaggaggtggaggttgcagtgagctgagattgtgccactgcactccagcctgggtgacagaatgagaccctgtctcaaaaagaaaatctgagtggtagggattttcaagtatttgccttagttgaggtctccaaatggaaatagtgattgggcactagtttaaaatgtacaaaaggtgtattcagtgtgaggttggttccaaagtgcacggtttgacagcccagggagtgagtgaggtgtgttggtgtgttttccatgatacaggggaactgactccagtatggccagtatacgagactttggtaaaatcattactttgttctggaactctattttagcatctgtaaaatgacttctaaagttccttctggggcagaaaatacatgcttctaaggttctgtctcattgctttttttttattttagtaatttaataagcatttatttaagatctgctgcattcagagcattgtgttaggaatattggaagtaaagcattgtaatagctcttgccttcagtaagcttgcagtctggcagttggattaaaaaaatgaccatacgaagccgtgataacagcctctaggagggaactctactatgtggtggagatatgtgtccccctgcaaataccaagaaagacagttaattagtgtccattacagaatgttcttctggtgtcctttttaaagagattcagtcagtctttaaagatgatgctattgctgctactgctaataataatagtgatagctaccacttactgtttactatgtaccttgtgctaaacacttgacataagttaactcgtttaatcttaaaccarggaagtagataatgattctcattttacagatgaagaaactgaaatagacagagatgaagaaatgtgcctaaggttacgcggtttagtgaactgggatcagaacctgggttctctggccttagactataaaccatagataggaattgagcacatttattaatcagcattgcaaggctggtggaattttgataaacacccaaaccagattcttttctgcactagtgataccagacagattttggaaatataaacaggatagggtgcattaaagttcactcacatttgttcagttaaacagatggttggcttatctttagttgcttcactcagtcatttccaaaaccacacccaaggccaggcagtggctyatgcctgtatttctagcagtttgggaagctgaggtcagaggatcacttgaaaccaggagtttgagaccagccttggccacgtagtgagaccatggctcaacaaacaaagaataataaacatatttactattatgggacgtctatgtgccagacattgtgctagacattttacatttattatttctaattgccccaacaacctgggaacatatcaccgagtgtattttattacaaatgtggaaactgaagtacagaagacaataagcctatgaagtgatcgtagggcgttgctggtacaaagtcaaaacctgcatcattgggccctgcgcctctatgtctgtggggagaagggattgttgatgatgtgatagctggaaaacataccattcatcaaaataaatcccaggtggattaaaaagaaatgtttaaaattatagaggcactgtggagaaaaagcaaaataaaatgtttatcagagataacgccttaacattttcttggaacattttattagatgtgtgcctgggaaggaatgataactttctttttaaaaccagaagaaatcacaaaggaaaaggtttgtcaacctaaatatgcaaaatgttaaaatattttcttattgaaaaataaaattatagaagatagtagtctgagaatgacaaatatgataaaagggtcaatacctgtactatttttttcagatgtgtagaaataaatacatcaagatctcaacagatatgtgtacaaaggaaatcataggccatgggaaattttaaatgtaaataagcatataaaaaaattcatgctcacatactgagagagatgccaaataaagtagacatttctacactccagccttggcaaccgtgagaccctgtctcaaaaaagcaaaaccaaagcagacatttcccatctaccaaaacagagaaattttagtgatagcctctgcttccttttcggagtatgtaagccaaaaggaartgaaactttttatttaatcctcacccattttggaggttttctttactgtaaggtttcctttccagtgtcaggcttaaccttcaagcagttaccactttagacacattgtttgctgccatttcattcagcagctgcgttattcataagatcactttataatgacatacttttccatcttactgttttataattattaaatggttcccctgatattgctccattttttttttttttcaggagaaacattctcaggttagtactgttaatccctccttacgtgtttaattagattatagagtgttggttttttccttccttataaaatcttacgtagagttttctatactgatgtgtctggtcaacctgtgcttcctgacttagctgagtcttcctgcagtctttatggggtttcataaagtgagcaggtaccatgctcacttagttataacttccctgaggtctagaaatctccttttcttcttttcttattgtcctacctctgggagttgtttgtgtgagctttagtctccaaatcgagtcatctagaggcagacatactagctacgtttgctttatcaactttgggaattgacgtrattttggaaacataagaccttcttaattcagagatacaaaacccartttgatatgcagattgtccatttgcagtctggaatttccttgtgagtggcgaacttgtgagtgaaatttggagtgttttagtttgttgctgtactccaagggtctcttcagtcggacgtcagttgtgattgaatgaagcaaagcaaaggtttttcttagtcatatgcctctagaaacaaaacttagattagcgttgttagtccaaaatgttagatctggaaatgtatttgttcttccatatgtattaattgagagactattacgtgacagctctgtgaatacagtagtgaatgagacagaccagtttcttgtcctcttgggagttttattatactaggggagatagtttatttctgacagtaatactaagagttaacacttaagtacttcctatttgtcaggcacttattctaagcattttacatgcattaacctgttgttaaactcatatttcaaatgtggaaacttccaccagggaagttaagaaatcttgccaaaattacagagtcagtaagtggctgagctggagtttgaactcaagcagtctagctccagagtctgtgccctgatagtgatggtaagtactttgaagggtaagaaaacacaaaaagtccagggtgatttgagagagctgggagtggggactattctaaatagggtgggcagggaagcaaacttcaaaatttccagttgaaatttgacctgcagcctaactgataaggactaaggcattcaaagtagctggaataaattctttgttctaggcagagaggacagcaagtacaaagactctgaggcaggaaggggctgggagtgtttgaggacagaagggagactagtgtgtctgggaaatggtgagcaagggagcgtgggggctgggggccaaaatgggaaggcccctgcatattggggtcaagagtgcagattttattctagggactgtgggaagccattgaactcttggccccaagtggtccttggcctcccaaagtgctgggattacaggcatgagctaccactcccaaattaagtagggtgcgacatttaaatatattaatacctttatggagaatgaattattaagagtttatgagtttagatacagagagacaagactagagattaagagtcttattttgaataagttaggtttgagtagactttaaatattcaaacagatgttttgttggcatttggacatacaagtttggcctcagggaagagtttagggctagagataaaaatttggggcccattagtgtatataaatcagtggttctcaactgtgagtgcacatttgactcacctttaaaaatgctcatgcccaagctccattcctagagattcagattctgtgggtctgggtttgggtctagccatggtttgttttaaatctatctaggtggctctaatgtatgacgagggctgagaaccactggtggaggtggtatttagagccaaggatgggcctggatcagtgtgatcctttaaggcaaacttgtccaacctgttgcccacatgtggcccaggacagctttgaatgcagcctaacacaaattcgtaaactttcttaaaacattatgagatttaagttcatcaactatcattagtgttagtgtattttatgtgtggcccgagacaattcttcttccagtgtggcccagggaagccaaaagattggacacccctggcttaaggcaatggtatagctagggaagacaagcagctcagggtactggggcagcccagcaggtagaagttggatagaagaggtagaacagcaagggagactcacagcagtagctggagaggttggaggaaaaccagaaactgatgtctgaaaactggaagaggacrgtgactcctgaaagtgggagcagctgtgccagatgctgctgagagctggtaaagtgaatgcgctcagaaggaattgaaactagcttcactgaatgggtctcagaggttcaaaccagggttttaggagctgtagattcaaatcctacccctgacattagttttctatttaaaattaaacaggatgctcttttcttagcctctttttatctttgcttattaaccaaaatgtaactgaactgtctcaatgcttaaagaaaggagatgataaacagacagccttattcccctctcccattcccaaacaaaagccagttcttacctggagttttggctctagctttctctctgcctggagtgcctttctggatatatggccacctggcctagtgctctcaccacctgtttgtctgtgagtccttccttagctgtccccttctctgggagctttcctttgctcttcctacttaatgatgtgactcacctccccaccccctggactcccagttccctacccatagcacttgtcgccttctaacagactgtgtgatttacttatttatcatgtttattgcctggcttccctgcaggaatgtaagaaatctttgttttgttcattgatgtcccctgagaatgtggattgctgagcaatgcctggtctatagcagcctcacagttagtgcttggtagatatttggtgactgagtgctgactccatgaaaatgattgtcatcctttgactctgctccagttgcatttgaaaagttgcatgggatctgccacttctctccatgacccaactatagagacttctggagtgtggcttctcccctctacctcagtactgtcatgcctattgaatttttttgagacagagcttcactctgtcacccaggctagagtgcagtgggatggtcatggcccactacagcctctactaggctcaagtgatcctctcacctcagactcctaagtagctgggactacaggtgcatgccaccacgcccagctaatttttaattttttttttttttttttttggtagagctagggttctgccatattgcccaggctagtctcaaactctgggctgaagcaatctgcccacctctgcctcccaaggtgctgggattacagttgtgagccactgtacaaggctttacttggaatttttagacttcagaaattatttgaatgttaatataggaaagtggtagtaataattagaagcaaattatatatatgagaaacagtatttaatgtattttggagaccaagtgttatgacagggatcagaaattttcagttgtcactgacagtaaaaatcattgcaagaagcaatttggtgctgtggaaagttcataggcttggaagccaggatacttggttcttaggtttgtccagtaatcttagccaccctacagtgagtgtctgctgtctgccaaacactctaaatgctttccagacagcatttttgattttactgtatcactcatggttgccattactacaccttgtttttttttgttttgttttgttgttttgttttctaagagatagggtctcactgtgttgcccaggctggtctcaaactcctgggctgaagagatcctcctgcctcagcctcccaagtagctgtgagtacagtcatgagccactgtgcctggctactataccctgtttatagatggaaaaactgagtcccagagaaaagataagaaagaaaagattctattctgatatgaacagaatcattttggagtggagaccatgtggggcacatttaacccctatacactgtcaactagagagtttggttaacttactgtctctaccttagggtaagacacaatctccgaggacctacattttatgacctgtgagatcaggataaggctatcctgctaaaacacttaaataacagaatttatggccgggcgtggtggctcacgcctttaatcctagcactttgggaggccgaggtgggcagatttcctgagttcaggagttcgagaacagcctgggcgatacggtgaaaccccatctctactaaaatacaaaaaattagctgggcgtggtggcgtgtgcccgtagtcccagctgttcgggaggctgaggcaggagaattgcttgaacccgggaggcggaggttgcagtgagccaagatcgtgcgtgccattgctccaccctgggtgacagagcgagactccgcctcaaaaaacaaaacaaaacaaaacaaaaaacaggatttatattgtaaaatataaaactttaaacaaatgttttgtatcattatgctgctgaaaatacaatgttccaacagtgtcctctgttcattttatactcacagtgatgcttattattttatttattagaatgtatctgagatgccaagttcaggagatttttggagtcctgctctgtgtgcccttctgccaggtggccctatgcttataatcactcttaggtgtttacacttccttcctttttcttgtcagggtccctggctccctctggagtctactctccaggaggtggggggcgctgatgtcagcagggaaggggggcttattgctctcagtgatgcttattattttattcacgttcttaatggtttgagtttttggttttttaagagatggggtcttgctttgttgcctggctggatttgaactcctggaccccattgtgcctcacttgttttatttttcaaattttattattttgtaaatttcccttttataaattaatctttaaaaatgtgtgtgtgtatatctatgaacaaataaaggatctcctggtcatctctgtccccatccacccagctccctgttcctccttacaagtaaatcaccattgtaagttgtatattcttcctgcatttctttatgcaaatagaaggaaatgtgaatgtttttcttattctcttccttctccccacaaaagatgccatacatacactattttctcttgttttttttttcctgcctgacagtatttccttgtttttgtgaagactagaccatctaaaattttgtgtactcataattacttgatagcataaagactttcaagtctccatcagctgacacaattaattttcaatgaacatacctttggcaagtcttcttaggcttatttttgtgatttttaaatgcttcctgcctagctctaaaaaggaaaacctggcaccatcctcagaagtttcagagttaatgaagtatctcatgtctcagcctttgcgtgtacagaataaatacgtttttctcagttcacttacccattgtggtgttctcagtttatgagcccttgctataattttcaaagctttcttttatcatttgtctttcagataaaacaactgcttcacaactaggaacttttagttgttgattattaaattctgtcaaaactgcctgtttgttttttgtggtcagtattttaatctcccttatctacaatcctgccaaacttccctaccttccccctgctccagaaaaataaaatccaactcaaaccttacttagcaaaccaccctcacagagtgaaattcagaaaaaaaattttgtttcaataaaaagattttgaaagatttcatcacttcaacaaaactatagttaaaaaattaaaatattatattaattgaaggacagtaacagtataatgagggagcaaaaatagagaaagtagctgacattgccagaagataagtcaaattctgctttttcccacatgtaattgttcaggacatgtggctcagaatatgtgaattagtatagtaactacagcagagtctctctgggttgtgttatttgctcaattgcgagatagcatacttataaaattatttctagattcactcctgaaatcttaactgcagtctgctttgtggaatttcttcttggaagaacttgtttaagagtatgctgattgatatttgttcatgggccatctgaagattctggatgttattttattttattttttgaggcagtctccctctgttccccaggctggagtgcagtagcacaatctcggcttactgcacccttcgccttccgggttcaagcaattctcctgcctcagcctctggaatagctgggactacaggcacgcaccatcacacccagctaattttttgtgtgtgtgtatttttagtacagacggggtttcaccatgttggccaggctggtctcaaagtcctgacctcaggtgatctgtccgccttggcctcccagagtgctgggattacaggcgtcagcctctgtgcctggcctggaggttattttaaatcgttttttttttttgggatgaaaacaaattttgttaaaattagtaatacagaatgattttgtgttcttttatcattcattcatttaccaaatatttattgaggcctgttctgtgctaaatggtggggagatggtgctgaactacacagaagagccccagtatgcctgctagctcttcccgtgtttacattttgattttctgtgctgcaatacagtagatgagcttggcattgagagtgagtagtcttggatttaggttttgagccggccatttatttattgtgagacctctgaagcttaaaactctgagccagcacacctgtaatcccaatactttgggaagccaaggtgggtggattgcttgagcccaggagttcaagaccagcctgggaaacttggtgaaaccccatctctacaaaaaatataataattatctgggcatggtggcacgctcctgtagtcccaagctacttgggaggctgagatgggaggatcacttgagcccgggggcagaggttgcagtgagccaacatcacgccactgcacttcagcctggatgacagagcaagacccagtctgaaaaagaaagaaagaaggaaaacccacaaaaacactgagtcagtcttgatctgcacatggaggaatcttgcagggtggttggaattaacgagtgtgtgtgagaacattgttctctgcagtggtctttatagggtctttagacaattcgtggtcacttttctggatcccttgcattttctagctgcattttcctcaactgggtttgggaaaaattaggtctggagtttgggatggggagctgtttttactttacaggtgaggtaactccatacgtgttgaagttttataggagtatgagtggaaccaacctctgatttttggctcagtactgacccttggactggagagtcctgttgtcagcaacaagaacacagtttaatgagaagcaattaagagtgcggtctccaaaccatagtcttaatttcagattcttgcttctccacttactgcctactaaaccttaagcaagtaactggaatatctctcataacataccataggattaattaatgctgtagttaaaagaaaaacaacaccagctatgtaattgtataaaagacttaataaaatgtggatgatttaggctgggaagccgttaactaaccattcatcataaaagggaggaagcaagaggacccacttgagtaggctgggacaaattgctgtggttcagttttactttttgcttttgtttctaattggagctgttttgagacatcctgattgtcagagagaatgtggattagagggaggaggaggagctctggagtcaggcagcccgagttcagactccagcaaccccattactggctgcttaactgtgttgtgccttatctgcagaaaaaatgagttaaaacacacatagtgagcagtgataactgtagctgtgattatttgaaaggggccttttgagcagctgcttctgcaagaggacatccggagacacaggaatagaaatgatccgatcagagtaattaaaggcttttaactgagctctgaggtcccaaacagggcacaytccgtcagcctaaagctgtgaagaagaaccttcaacataaggtgggtgttctcttttagggtggtggagaactgtgtcattaggctagtactgtaagcagtggggggttagagcttaactacggttgtgtttgggagatagcgccagatgttgggctccctcctgccagtagattacagggatttcctttgcattggctggtgctgcagccttccagtattgcaggtttccaagtgtttgtaatgaatttctggccagggcgtccatgtctcttggtgctggccagggtgtgtgctgacggctgcactgttcccagccctctgcctggatttagtcttcagtgtcggagcccccaagtctgtttacaatcttgttactctttccagcgaactctccaccttctgtttcactgcgtatttcctgacgatgcagtttcattttggatgcagacctcttggagccctttgtcccagggaagttagatgtcccttgtggcaaataccctccttcgggaataaacagtctcatttgagcccctgctatgtatgacacactcccccagggcccttgtacaaacatgagttagaaatgtattgtccctgtatttcacaggcccacagaccagtgatggagcaagtatgtacccagataatttatccgcatatgatttggtcctgtttgaaagtggccatgggagaggtgggaatggtgtatgttgacacacaggagtccaggtgccaggcttggggcgtggggaaccttcatagagcgggaagcattcgagttggatattgagaatgagtgggggctgaaaggtttagaatagagagaatagttaaattaggtcattaaaaatatgtggaacacctgctgggtgccaggtactgcatgtgaaatcagacgacggttgactgcgctcactctgctgtgttttctgtgctactccctaaagctcagtagatgtttattcaccaggtgactgctgccttccccaagccacctggcagtcacgttttacctctgaaatcatctcagtgaagctttcctgacagcccctctctatgagtttcctagagctgctgtaacaaagtgccacagaccaggggcttaaacaacagtaatgtgtcatctcacagttctggaggctagaagtctaagatcagggtgtgggcagggctggttcctcccgaggctgtgagggagaatgggccccatcctagctcggtagtcggcagtccttggcgtttcttggcttgaggaagcactgcgtccacctctgccttcatctacacttagttctccctgtgcgtgtctctttgtccgcattttccgttttataaggacataagtcattttggattaggtctgccttgtggaccccatcttaactaattacatctgtagcgaccctatttccaaataagggcatattctgaggaactgggggttagggcttcaacatgtgaattttggggagtggacacagtccaactcataatatcctctctcagttctttctacctcccactcatggacactttccccctgctgatatactgtaagtggagttctgtcatgcactgagagaattttgtttgttatctcctgctcttcgtatttttcagtctctggtgccttgcatgtaaggtggaaggtgtctccagtgcaaatttattatgcgccaggagttagtagaaataagggaagatactgcagagatcacctctcttcttggtctcctattgacaattccaaaggctctctggagtcgggtgccaggtggccaaggacattaccaggggataccactttsattatctcctttttcccacggagcagtaattcattattagctgacaatcaaagagcattagaaatctgacaagatcctttgggtcctctagcaggcattttacacggaggctttctttaatggctctcttcttcctagtttcagccgtaagttttcatgttccagctttagggattcaaaagtaaatcatgtgaatgctgggaatagttacccttagcaaagatgtctgtgccagaagggagatgccaataaataattgaatctgtccaaaagtttcagaattccctcattatatatttgagagaagcaaaaatttgtctggtatctgacctgaggtttagttacacattaataaagatggatcatcccagggctgcagtacttctgctaagaaagaatattccagcataacctttgttatttccgagtcagtaaataatgtactaggtagagtggtgttttctgggacattagaaaagagacgttatttggactaaatagtgctgttcagtcaggattttcttcaatgccatttagcaaaccaactgtccttagtctgtccagctagcaagaatttgtataatgcaacagagagtgctgttcagtcaggattttcttcaatgccatttagcaaaccaactgtccttagtctgtccagctagcaagaatttgtataatgcaacagagtactttacagttttcacactttaaatgtcacaggaggggttcttcactaggcttctggaacctagtctagcaaaattagaggaaaggccctaaggagatttatctctgttaagagaaaaagttaacattttcaggctaaatagttgaatctactgaagataacaaataatgtctactatttcaaccctccaaagattgaagagtgttaggattgtcatttgtgtttttttgtggggtagttgaataaaattgggcagctaaaattttcagttccatgtgcctcctaaacaaaaaacaaagtaagtagtttgtgaattgactgtagacaaaatagaaactatgctgcatgctgttttttttgtaaacagatgacattttctttctttttttttttttttgagctggagtctcgctctgtcacccaggttggagtgcagtggcatgatcttggctcactgcaatctgtgcctgccgggttcatgccattctcctgtctcagcctcccgagtagctgggactacaggtgcgcgccaccacacccggctaatttttttttgtatttttagtagagatggggtttcaccgtgttagccaggatggtctcgatctcctcacctcgtgatccaccctcctcggcctcccaaagtgctgtgattacaggcgtgagccaccgtgcctggccaacagatgacattttctaaccaggcacatgccatccaatttacctgtcgatcataccattgtataaagcagcagaactgaaggggaaatatgattgttaaacacactgaattgcttttatgtcatttgagatagttggtgtaagtgtcttgactttttatatttggaaacattaaataaaaacataaattttttaaaaagggatgttaagatagctgttcatcctgatcttagtagtatcagtctgaaaaagcatgctgaaatatcttcatctgaaggccggcagagaccagctcatgtaaggtctggaggtgctttcttctgagagcaagaagaatcacggagcgtttcaaacacatacaaaatagacagcacggtgtgatgagtcctgctctaaccttcatccagtgtcagtggttagctcatggctagtcttatgtaacttcatttccccttgcccccatataagttttaggcacatttcagatgtcattttatccagaaacatttctgtatctaatataatcctagtaatactacacctaaaatgtaaaactaatttcttaataccatcaaaatctagctagtgttcaaatttctagttgtctcaaatgtcacttttagatttttattttacagtttgtttcaatcaggatcctactaaggtccacatattagttctcagattttaagcagaggagtgagtgacatgatctgacttacattaaaactctctatggccaagttttagagaatggattgttgtgggggttgttaagagactggaagtagagaaaccaattaggaggccgttgagtgtccaggaagtgagtgatgasaacttggatttgagtgacatctgggggatgggagatgtggaggaagcagatgtcacttgggcaggccatacttatttgtcacggttcatccagatttttgttttctgttgtctgtgtttatttgaaaatattgttcccaaagatttcattaatttagctatcaatatattgttgatggtgaaatcttaaaatgtattacataagtaaaatcaaagcaacattatagaatattgagatagagaaacattcatccatactttaatcaacttactcaaatttattccagcttatttgccattatatcattttgccagtgtataattatggcattacataatagaataagaaatatagtttgccacttaatatgttttatactcttttatctgtattatgctaaagagtctctgtagttacatgatattgtattgagcagattttaatgtttatgttacatttatttatttgagtcagggtcttgctctgtcacccatgctggagtgtagtggtgccatcatggctctctgcagccttgacctcccaggtcgagtgatcctctctcctcggactcctgagtagctgagactacaggcgtgtgccatcactcctggctaatttttttgattttttttgttgagatgcagtctttactatgtaagctagacagcttggaactcctgggctcaagtgatcttcccacatcagcttctcaaagtgctgggattacaggcatgagccaccacgcctgacctgttcctacttttaaaattattttattttaaattagtttaaatttattctaagatactatgaaaaatgttccagaagttagttttttgcatgtttttccctttctctctctttttttaactttttgattaaataatattattattattttttaagayggagtcttactctgttgttcaggctggagtgcagcggcatgactcagctcactgcaaactttgcctcccaggttgaagtaattcttgtgcctcagcctcctgagtagctgagattacaggtgcgtgcccccacgccccgctaatttttgcatttttattagaaacarggtgtcaccatgttgcccaggctggtttcaatctcctgagctcaggcatccacttgcctcggcctcccaaagtgccaggattacagacatgtgccactgtacccagcaaataataacttctctgtagagattttacttgaaaactaagttgatgaaacctgcagtcataattgataaaaatgaaggacaggtttgtactgcaaagtagaattatgcttaatcttgattaytgggctcagaatgtgtatactktcattttgatttacatttatagacttccttattgaaggaatggagcatgtatatacctggcctgcagtgtttatcttatcccattcacacagcaatttgtaactaggggaaagtaatacctgccttatcttaaatatgatggttttacaaagattcctgtctttcactgtcttctgggaaccaggaaatagctatagttacctctaaaatataccctcatatccttttttaccgatgaaaatggcttataattgggactcataatgattttctttggtcttttattgtttttgaaacacgaagcagaacatttttattattggctcagaatgttcagctttaattacatctaatgaggaaatattgccagataactcttattgttttgttctttggtcattcttttggaaggtttacaataaatagattgggtaaccagaataaattaaacaatttaaaggatataaatagagaagaataagtttcagagattccacttaggctgggctcttgcctgtaatcccagcactgtggaagtctgaggcaggaggatcacttgaacctaggagtttgagaccagcccgggcaacatagtgagacctcatctctaccaaagaactaaaaaaaaaatagccaggtgtggtgatgtgggcctgtagtctcagctatgcaggaggctgaggcagtgggatggcttgagagcccacaagttccaggctgtagtgagctatgattgcaccactgcattccagcctgggtggcagaataaggctctgtctcaaaaacaaagagaaaaaagattccactgaggtcattagttcgtttattctatgttgatgtttagtcccccaattgttttcatgttttgcctttaagttctcgaagtagtggctgggggcggtggctaacgcctataatcccagcactttgagaggcctaggcgggcggatcacctgaggtcaggagttcgagaccagcctggccaacatggtgaaacgccgtctctactaaaaatacaaaaattacccgggtgtggtggcacgtgcctgtaatcaaagctactcgggaggctgaggcaggagaatcacttgaacctgggaggcggaggtttcagtgagccgagatcatgccactgcactccagaatgagcgacagagtgagactgtctcaaaaaaaaaaaaaaagaaagaaatactgccactttaagcatatttttatcttatctttacatttagaacagaaatatcaaattgatctttttcttaaaaaaaracactaatttcttcaactgattctttggttattggttccacaataaaaatatcttttttgcataataaactctactttataggcttgttatccaaagtgcggttcaagttcagcagcattggtatcacttgggaattgatgagacatgcagaatttcaggccccactccagacctaatgaatcttaatttgtgtattaattcaattcccaggtggttcatatgcacatttgaaagctaacagggcgtggtggctcatgcctgtgatcccagcactttggaaggccaaggtgagaggattgcttgaggccaggagtttgagaccagcctctgcaactcagggatacccccatctctacaaaatttttaaaaaattcgccgggcatggcggtgcacgctgatagtcccagctgcttgggaggcttaggtggaaggatcacttgagcctgggaggttgaggttgcagtgagctgtgactgggccactgccctccagcctcggtggcagaacaagaccctgttcccctccccccgagaaaagaatgtaatgtcagtagccatattcacagaattttaaatttgagccatcttggcatgttaggttattaacaaactgagcatcttgacctcaaattgctggtacctgccattgttcttttaaccagaaaggagctgttagggaggaacatttaccattttgtgagttatgtgtgagtggcttctcttctgttgatctgtttgtgggatcctttgcaaaaccactgctggtaccttatgggaaaaaaaatcagaaatcaaatttcttttggaataaactgtgctgttcttagcagatcttgtctgtgtggaacaaatcatgtctgtaaagaatcacgtggtcaaaagtttaatatttagttctttttggatttgtcagaggacttaattgctttgttagattgttgtcttgttctcctctttggaacaatggctaggacaaaacacagcattggttagtgggaggrtgggaggtggttgatcagccatgtgcctstgaggccacaaagaagcctcacaggtcatggtttccactgtcagttggtcattacatcctcctgttgaagattgtgtttaccaagctcatgtgctcatcatgaaacactgttagacattgatttgaaaacaataatttcttttattttgattctgtaggracctagaaagattgtacaatgaatggtgattctcgtgctgcggtggtgacctcaccaccccygaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgtgagaagagaagtcttttctctgaccagatgtcatctttccttttctaatacttcaggtcttatgccctgttgtatgagtggcatagttcattgatcttatcacaggaaatcagtgccttgagtatacgtatatggttgttgaaagaattcagttcagttcatgttatcagacatcataaatgaaaaatcttcagtgtcgtaaaggataggaagtgttaatttctcctttttactcttgtgacttttctagagggtccttatatattggggcaatttttaaattacaattaaaaaaatacctagcttaggctgggtgcgtcggctcaagcttgtaatcccagcactttgggaggccgaggtgggtggatcacttgaggtcagaagttcgagaccaggctggccatcacggtgaaaccctgtctccattaaaaatacaaaaattggccaggcgcggtggctcacgcctgtaatcccagcactttgggaggccaacatgggtggatcacgaggtcaggagatcgagaccatcctggctaacacggtgaaaacccatctctactaaaaatacaaaaaaaaattagccaggcgtagtggcgggcgcctgtagtcccagcaactcgggaggctgaggcaggagaatggcgtgaacccgggaggcggagcttgcagtaagccgagatcatgccactgcacttcagcctgggtgacatagagagactccgtcccaaaaaaaaaaaaaattagccgggcatagtggcgcatgcctgtaatcccagctactcgggcggctgaggcaggagaatcacttgaaaccgggaggcggaggttgcagtgagcggagattgtgctactgcactccagcctgggcaacagagcgagactctgtctcaaaaaaaaaaaaaaaaaccctagctcagtctcctgggtgtatggtcagccttaacagtacctgctaattgattgatacctttagttagagtcagcattttgagccacagtcatggccaactgagtgttttccagattgcacctttaatcaggtcgttgtatctgcgtagttttctcatgttgctgctgctgcctttgtgtgtgcatcatccttttttgtcccttcttcttctgatttgttcttactgtgccccttcataccaggggagtgtcatttggcagaagtttattgattttcttaaaaaaaacaaaagatgttgattgtctcttatgtgctgtttaaggaactgggcatttagcagtaaactagacatacaaggcctttagtagattttgtttagttgttgttactgagttataacttacataaagtacacaaatcttaagtatatagcttggtgaattttgacataaatgttgcttctgtaactacccagatcaagtcttggactttacattctagtcgaaggaaataaacaataaagaacaagcaggagggcaatgcagaaagcagtaggatgattagattaagtgtgactgtggtcagaaaggctgttctcaggagggaaggtttaatctgaactcaatgacaggaaggagccagtctttcaagaatcaagagggggccgggtgtgggtgcttggctgggcatggtggcccatgcctgtaatcccagcactttgggaggccaaggcagtggatcacttgagcccaggagttcgagaccagcctggggaatccgcatctctaccaaaaatataaaaattagctaggtgtggtggcatgccccggcaatcccagctactcaggaggctgaggtgggaggatcactcaagctgaggctgcagtgagttgtgatcgtgccagtgcactccagcctgggtgacagagtgagaccctgtctccaaaaaaaaaggagacgtgttcccagctgaggaaccagctaacatgaaattcctaggatagggatgggcttgatgagcccacagaggcagaaggcagccagtgtggttcggcctgggagtggcagagtgaggttggagagagaggagggagcagatcctggaaggctgtgtatgctgagattgagagtttccattgcattctgtgtgtggcagaatcattggagggctgcagacagggaaaggacaaacggtattttaaagaaaattattctgggtttggtttagagagaaaattggctggggcaagagaaaaagctgttgtccaaatgagagatcatggctgcttgggccaaggtggcgtagtagaggtaggaagaagtagatttgtatggctttcattttgaaggtagtgtgaataggacttgctgatggatggggtggaagaagtgaaagggaaaaaaagaatcaggatagcaccgagacttttggcttgagcagtttacttacgtaaaaacaacaagaagctaagtaaaaatgactcgggatagttgagtcatttttgagttgaaactgatagcacctagtgtgtgccaggcattgttctaggcactggggatgcagagataagagagtaaagttcctgcccacaggttgtttagaacacagtaagcatcaaggctgggcgcggtggctcatacctgtagtcccagtgctttgggaggctgagataggaggatcacttgagtttaggagtttgaggctgcagtgagctatgattgcaccactgcactccagcctggggcttgaggttttgccagatggtttggtagagttggagatgttagcaagaaagggattacaatgtaatcattacaatggatctaagccagtgagggagttcagaacaggggaggtgagccaaggtgagaaggtgttagggtgatgaatggatggaagaaagtgtgagctggatgctaggagggggtggttgcagggcacatacttggctttgggattgaagagagacatggttactaggaatgagcaggtgtagtgctgaccatggacgtgggagcctgagatgggttggatgacagggtctttggaggagaggaggtccgaaagctgagaggtatgagggtcccaaactgagggtatggatgttgaaccagcaagagttatgatcaaagtagcacacacaaggtccttaggctagtgacagctggctggagccaaacgttaagatccagattggtggctccaggccctcactcaggactaagctcagctctgtgccacgtgtcctttctgcacttacaggtcgtctgaaatgctctttatgcatagggctcctgtactgtggttttcttctttttgtgtcttccttaccaagctttaagtttctggatggcaagraccatattatttatcagtatgtatatccttagtgtctaaaacagcgcctggtacttagtagtgtgtgtcgaattgagctttccctagatctgtatgtggatttgaaaaccattgaaatagatcctttgaattttcagactgagggckcctgaaggcaaggagcttgtttaatttagcttttgctttccctgtgaccagcactgtctgtgatgttcaggagatgccatctgtatctcttactctctctcttttttttttgagatggagtctcactctgtcgcccaggctggagtgcagtggcgtgatctcggctcactgtagcctccacctcccgagttcaaatgattctcctgcctcagcctcctgagtagctgggattacaagcgtgcaccaccatacccagctcgctgcaacctcctcctactggcttcaagtgattctcctgcctcagcctcccaagtagctaggattacaggcacaagcttccatgcccagctaactttkgtatttttagtagagatgaggttttaccatgttggccaggctggtctcgaactcctgacctcaagtgatccgcctcccttggcctcccaaagtgctggaagttacaggtggaagccactgcgcctgccctatctttatttgcacatatctccctttctctctcattgcattgtgctttgatgacaaagatggctaaataatcaccatgttttgtttttttcctttgtttatttcttgcttgcagtcagagtacctctcagcttttcccttcctcacggatgactacaaaatatgatctgcaacattatttgccatggtttggtaaatagggggtcctcagagggctcttgacagacattctattctacccttaattaacagcaatacatctgtytgttgtgtgcttcccccaagtgataggtactcttagactgtcccttggcaatctcctgcaatatgttttcagctcaagcagtgacaaactagaagtaaatttgatgtggattaacatccagtgaacttaaattttcataccggatatcatttataattgtttgacaagatatttctttctttcttttttttttttttttttttttttttttttgagacggagtctcgctctatctcccaagctggagtgcagtggcgggatctcagctcactgcaagctccgcctcccgggttcacaccattgtcctgcctcagcctcccgagtagctgggactacaggcgcccaccaccacgcctggcttattttttgtatttttagtagagacggggtttcaccatgttagccaggatggtctcgatctcctgacctcgtgatccgcccgcctcggcctcccaaagtgctgggattacaggcgtgagccaccatgcctggccgatatttatttctttgcagggtatgtgaaaaaattattttagtgcaggttgggaatataaattatctgtattgttataatagtgattttctattaaaatcaccatcaatccaattgcacttttttttgcctgatttagtattatttgataaaggatggatggttagggttttttccacatttaaaagtaatttgaaaagtattttgaagaaagtactgcaaaggataaagtagaatatgaaaaattactaataatcctatcactaaaaggattacaatgaacattttgatgtatttacttttttttttttttttttttttttgagacaaagtcttgctctgttgcccaggctggagtgcaatggcccaatctcggctcactgcaacctctgcctcctgggttcaagcaattctcctttctcagcctcccaagtagctgggattacaggcgcccaccaccacgcctggctaattttttacatttttagtagagatggggtttcaccatgttggccaggctggtctcgaactcctgacctcaggtgatccacctgccttcgcctcctaaagtgctgggattccaggcatgagccactgtgcccagccaatgtatttacttttaatctttttctatgtttaggtatgtatttgctgtaataaggactggttatactgcttgataacattgtcactcaaacatatatcaagagcaattttatgccatttaagtttttttagcttttcatgttgaatgcatgcgtagaattcccagtgtatttgatcagtcctctgttgattgaaacgtaggatgtttttcccttttatcaataatactggaatgaacatacaaatgaatcagtctttgagcacttccttgaatgtttccttaaaatagattcctaagagtagaattcctgttcagagttttaagcttttattgtattaaattactttctagaaaagaatgtaccagtttatattctcagcagtaatgtgtgagaatatccgtttgcctttccagcactggatgaaaacaaaaattggtctatgtgatagctacttctgaccccctgcccaaggaacagaaaataaatggtatctcagtgttttaatattttttattaggctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtgagtagttcctgatttttaatatatgttctgtagttttcaggyaaaatttcctgaagattgctcatgtgaaataagtgggcatttaactgtataacrtaacagagttgagtattttgaaaattaatgtgttttcgttagtcatagtaaaagataggctggarttctgaaatcatcttgaatgttgcagactcctcttttcttagccagtgagactttatttccgaggcagatgactttttatgtgtcttcccagcccctatgtagattaaaataaactaatagaaataatgctgtggagtagcacatcagttttgcctggccagcatttcttacctagcattcttcactgctgtgtcccaactagtgagaaagagaaattctaaaagaaaagccagaggaaaagtactggatgggtgaatgtgagcaaagaatggtcagctgtgcaagaatgcagctttgccatggcaattgagtttgcaaatgttaacatgacaaagcatcaactaatctgagccactgcatattgtaccytggattagtctctgatgggtctggttggatagtcaaatctgattgcccgaaataaggtactggtttctgttagatctgctgacatttgctatttacctgtctgctctgtggtattcttagaagttgaatagcattcaacagatctgatatatattgtaattaatgtctacagaatattaagagtcacatttaatccatagctcaaacctccatcctgaaatcacatggccaccactaggaaagttttcatgtggattccgtttttttttgttgttgttgtttttgagacggcgtcttgctctgtctcccaggctggagtgcagtggcatgatctcagctccctgcaaactaccacctcccaggttcaagctgttctcctgcctcagcctcctgaatagctgagattacaggcacacaccaccacacctggctaatttttgttatttttagtagagacggatttcgccatgttggccatgctggtctcaaactcctgaccacaagtgatccactcgcctcagcctccctaagtgctgggattacgaacatgagccaccacacctggcccatttcgtctgtattaattagcaagaatgttctgtcaggagaaacttcccttcagttcttttggttacctggtgatacagtttgtgtaggaaaggcaggatccctttccgaaataataagttggtttccaatcatccttcagtgatgaacaattagttttttttttttttagtattatttgaatttatgatttaaacatagtcagtgtgtttcacatcattgcagttattatccggatttgttgagaactttccttctgaatggatgttgaactttgtgaaatgcttcttttctttctgttaaaatgatcccttagtctttcttctttagtttgttatggtgaattatgtttttttgtttgtttgtttgttttgtgtatttatttatttagagataagttcttgctctttcacccatgctggagtacagtggcacgatcacagctcactacaaccttgaactcctaggcttaagggatcctccatgccttccatgcctggctaatttttctcttttctttttttttttgagatggagtcttgctctgtcgcctgggctgcagtgcagtggcgtgatcttggctcactgtaagctccgcctcctgggttcacgccattctcctgcctcagcctcccaagtagctgggagtataggcgcccaccaccacgtctggctaattttttgtatttttggtatagacagggtttcaccttgttagccaggatggtctcgatctcctgaccttgtgatcctcccgcctcggcctcccaaagtgctgggattacaggcgtgagccaccgcgcccagcccatattggttgtttctatctcctttcttttgttaagtctggctagaggtttatcttattttattatttgtattttatttttaaacttctcagagattcaacttttgctttaatcagaaagccttaaaaacacttttcttctctaatgtatacgtttaatgctgtaaatttccttttaagcttgctttactgcacgccacaaatttggctatctttttgttattgatttctaacttaattgtgtaagtattggaaaacagtcattatgaaattgtctttgaagttttcaagactttattgtctaatgtggaagataaatatctcagaaccattagtatttgatttacatttgataagaaatgttaatatttgaggctttttggtaagtctcgctttgttgccttggctattcacagctgctatcataagcactacagcctcaaactcatggcttcaagtgatcctcctgccttagccttctgagtaactaggactacaggcgtataccactgcacctggctgagttttgtttttctttatttcaggtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacagtgagtattaaatgggctagtaactgaacgataaatgaaatattttgtgtctggcaccacctctttccrtttaggagaagagggaagcaggctgagcttcagtaagtcttggaatacctcttctgattcctgactacagagtgtaataacctgagaatcagccagtttgggttaaaagttacaggaacagcagttcttgaaaatttctttcttgcgtgctaacctaataaaacaactaagtgtttaccagattatatgcagtttctaaaattatttttatgcttaaaaacctaagaatgatgatgttttctttcttagtctgaccaaagccttccgtctctcaaacttatttcttcagctactctagttttaactatttttcaacattattaggatctcttttccttcattctgggtatctgctttctctggaccaagcgctgttctaactgtggttgtgtcagtggacaacatgagtccttcccttgtggacagtcacttcttcatcccaatccattagcctattcttcactccctattttgtccatcttgtatttcatagtccctcatttcagcaatactctgccaatcctgtactctccctcccagcttctgagtagcgaaatcctgctgtggaagtcctcccaccagagcccattacctttctccatagattcagaacccaaatctcaaatgggccaatgacttagcctggcaaccataactcatctctcttacaaccttactaatatttaagccttctctactatctttgagactcctgacctccttcttccaccaaatgacctcatcatgtcacagaaaaaatgggtacccttactgacatttgtagccattctgtactcttgaccacctgttataatgtcttgccttctgcctgtggccagactttgctcacctggcttggaattccacccttcctgccttcttttttttttttgagacagagacttgctctgttgcccaggctggagtgcagtggtgcaatctcggctcactgcaagctccgcctcccgggttcacgccattctcctgcctcagcctcccgagtagctgggactacaggcgcccgccaccacgcctggctaatttttttgtatttttagtagagacggggtttcaccatgttagccaggatggtctcgatytcctgaccttgtgatccgcccgccttggcctcccaaagtgctgggattacaggcgtgagccaccctgcccggccccttcctgccttgttagattcacagtgcattgccagggttcttctgttccttcactcttttgtagagatagcttcttcctttgaactgcttccttcctttggttttgaaacttgttccagtcttctgtttttttcatgtaatttcttttaaaggatattttaaattgttaatacagtgcctgctttttgtatcaagtgtaccttatgcagatgtctaaagaaaaagtaattccaccaatacttccatctctcttgaggcaagcagtgtgtgcgctgttcacgttgctgaaatgtttcctccatastcacacacacatgggtttttctgcacatggactcataaccagcggtgcttcgttaagctccattctggactcagaggaatgctaagcctcttgaggtgacggtctggagctcaccttgtgattagtgtgttgtgcctctgggacttgatattggtctctgccagagagactgagttgccttctatccatctgttcttgtttccgcttaaatgaacttttcaaaatgtaagccttaccatgtcatgctcctgtgtgcggcacggtcactctgtgtagaatgtcatcgctgctttattcccctgtagcagttacccccattcattctgtatgtttagctgttgctgtccctctctgcccacaggaatataaattccacagggagagcgtctgttgtggtccctgctgtggccccaggacccgtggcaaagagtaggcatgcagtaaacttaggtgaaaaactgaatgaaacccccggctgaactgaaattacctcagtgaarttgtgaacaagagctcgctgggaccttttgacatttgattggtgggtccagttagcctagcacaaatgccagctcccttcctggtgcctgcagggaaattgctggcctctgtcatctaattatacttgacagaatgctgtggtggagattagtgctaagtggttgcctgaagatcagtgcrgtgaaaatgttacagctgtgattggaaacgtaaccctaactgtgataacagcttcaccttcttcgcaggttttaaagtgctgtttgcctagtcctattttgaatgctgattaaataagtttgaattggttaaattgcttgttttctcctcctttaattgtttaagaattggcaaaattaaaaaagtgttttctgtaaattatctccttggggcttaataccgagtaaaaagaaatgcaagttacctaaaatgtttcctatgtcttataaactagaactagagaatctttaaggaagaaaggttttggtttattttgttttactattatggcatccatttcttatttactatctaggtatggtatagacgcttaacagaaaagcaaatacagtgtcaacaaaaagtgacagcaggtcattctgccctttctttgaaagggggtcatagggattttctgctaaagggatttaaaattgctaacaggtgttagaagattggagatgattgtctgaaatagatctttaagattgcattggatttggagaagtgtttgtgggggctggggggagggggacaagacggggtggcccagttagcacagtggactgggcttcctctctcggtggcacttagctgatggcttggcctgcccattctgatgtcagtggaatgctgtcaaggctttgcacctgcagaacctggcaggtgcttgttcaactccattctggattccagagaatgctaagcctctgaggtgatggtctggacccacctttgtgaccagtgccctgtgcttcagggacgtgatagtggtctcctctggaggtactgaattgggtactgcattggtctgcaacaggagagtctcattcttcatacacagagaaggggcagtacatgtgtgggaagagacacagggagagcagggctggtctgacggggagggacaactgcagaggaaactgacttcaaaatatccttctctatttttacttgatgtttgtaattttgcactttctcctttttgctttagattcagagaattgaatgttttaagcctctaaaattaaagtatgtattaatagatctgttagttaagcttacagttggaaataaatcttaaaataagtaaaagaaggaaacattattaattacagcgttattattattattattatttttgagacagggtctcactctgttacccaggctggagtgcagtggtggaatctcggctcactgcaacctctgccgcctcggttcaagtgatcctcctgcctcagcctcccaagtagcaggaacaggcatgtgccaccatgcgcaggtgtgcaccaccatgccactagctgattttagtatttttagtagagatggggtttcaccatgctggccagcctgggctcaaactcctggcctcaagcgatccgcctgcctcggcctcccaaagtgctgggattacaggtgtgagccactgtgcccggcccagcattatttgtaataatgaaattattattattattattattattattattatwttaggcagagtctcactctgtggcccaggctggagtgcagtggcatgatctcggctcactcaacctctaccttccgagttcaggcaattctgctgcctcagcctcccaagtagcagggattacaggcacctgccaccacacacagctaatttttttgtatttttactagagatggggtttcaccatgttggccaggctggttttgaactcctgacctcaagtgatccgcccacctcagcctcccaaagtgctagggttataggtgtgagccactgcacccagccaataatgaaaaattttaagagtccttaagtattcagcagtagataggaaatggctcagttattcaatatcaatttgagcaaatgttgtatactatgaaaaacaattacaaagatcatgtagaacaagtgaaatatgaaaaatgaaaggtatcagaaatgagaaaatatgaaatatatactgtttacagctatatgaaatatgtacatatatatatggagagagagagagagacaaaagagaaatgactaacaaaaatggttgtgtaatactttttaaatgtggaacctgacagcatgcttctaaaatttagatggaagagcggaaggccaagaatagctaagacactcctgaagaacagctaggcaaggagatttttcctaccagatgtcaaacttaatataaagtggtaattaatatagtgtcctttgggcaaaggaagatgcagagggatcagtagggccaaattgcatgcattgaaacagacatgctgtagtcggcattgcagctcagcggggtgggggatggacttggcaatgatggctgctgggatgcttgggtagaaaagtcacaagtggaaataattatatgagacttctatactatacataatcacaaagcaatcccagtgaattaaagattaaatgtgaaatgcaatactttaacaattttaggactaatataggtgaaaatcactggccttgaacctctggcctaaggagagatgtcttatgacacaaaaatcacttatcgtaaaagaaaagatggataaatttgtctacatttaaagtagacaaactttttccttattaaaagataccataggccaggcgtggtggcttatgcctgtaatcccagcattttgggaggctgaggtgggtggatcacctgacgtcaggagttcgagaccagcctgaccaacatgatgaaacccatctctaccaaaaaatacaaaaaatttggccaggcatggtggtgtgcctgtagtcccagttgctggggaggctgagacaggagaattgcttgaaccctagaggcagaggttgcagtgagctgagattgtgccactgcactccagcctgggtggcagagtgagaccctgtctcagaaaaaaggtaaaagataccataaagacagtaataataaaagccgcaacctggaaggtttgtcccacatgtagccaatagaaattaatatctggagctgggtgcagtggctcacgcctgtaatctctgcactttgggagaccaaggtgggcacatcccttgaggccaggagtttgagaccagtgtggccaacatgtgaaactccgtctctgctaaaaatgcaaaattagccaggcgtggtggcgcgcacctgtaatcccagctactgggaggctgagacaggaatcacttgaacttgggaggtgaaggttgcagtgagctgaaattgtgccactgcactccagcctgggcgacagagtgagactccgtctcaaaaaaaaaaaaaaagaaataatatctggaatagataactgtcagtaagaaaaagacaaaccagtataaaatggacaaaaggcaagaaaggaatttcacagaaggggaaataagaatgccttataaaaatatgaaaagttactgaaatcatttggtcaccaggaaattataaattcatatcacaatgaaatgtcattttatagacatcagatttcttttgttgttgttgtttgagacagagtctcaccctgtcacccaggctagagtcagtggcacgatctctgctcactgcaagctctgcctcccaggttcacgccattctcctgcctcaacctcccgagtagctgggagtacagtcgcccgccaccacacccggctaattttttttgtatttttagtagagacagggtttcaccattttagccaggatggtctccatctcctgaccttgtgatccgcccttctcgccctcccaaagtgctgggattacaggcatgagccaccatgcctggccactagaattattgtatttcttaagctaattgatagatacatggatgtttgatttattattatacttacattgtcttatatcttgtaaatacccttgtatgtgtgtttttaaaataaaggcttttaaaggaagcaaaacaaaaatctgaaacttaatcttttctaattttcatccttaattttcttcattccaaccagtatatacacagatcccttgttttatgttttgttttgactgagcttagcaattagacaactgcttacttttgtgttaaatagtttaacaagtcaggatgggctggatgcagtgactcccacctgtaatcccaacacttttggaggccaaggcaggaggatcacttgagctcaaaagtttgggaccagcttgggcaacatagtgaaaccctgtctctatttwaaaaaaaaaaaaaaaggtcagcatgctttttaagataaaggaggctgggcacggtggctcatgcctctaatcccagcatttttggaggccagaaaaagtgggtgcatcacttgaggccaggagtttgagaccagcctggctgacgtggtgaaaccccgtctctactaaaaatacagaaattagctgggcatggtgtgcctgtaatcccagctactcagaggctgaggcaggagaatcgcttgaacccgggaggcaaaggttgtagtgagctgagatcgtgcccctgcactccagcctgggtgacagagtgagctttgtctcaaaaaaagaaaaaaaaaagataaaggagctgacttaaggaaatagaaagcaaggctgactcagcattgcaaagaagtgggtcatagggatttatagagactgggtgttgtagttcactatccatgtaaatgacccctagcaatgatttagtgttgctgctcccactaccactaatgatggtaataatgggtagatgccgtttattgcgagctttattgtagacacaggctcttccatccccacttagtcatgaggaaaacaggagctcagggtgcccagaacaccatagccagttcttggcagagctaggatttgaacttaagtgttatctgactttggattttgtgctcttaaccctgttatgctctacagagacaatcaggtgagtttagcctacagatcatataaggggagacaggatagatttagatgtctgaaaattaaattgtagaagggggttagaatttgttctgtgttatatactagaggcagtggtgacaaacacaggaaaacagatttcttctcagtgctagaaagaacgttttaatccttaagtctctccagcatctgtttatgacagtgcttcagcgcccatgacacggtgggctctcagcgagtaggtggtcatttctttcctgaatgaataaatgagggaggctggggtaagcatcctcatcactgaaactaaaacaagcagaccctgggtatgcttctgtttgggccactacagaagaaatcactatgtggcttaggaagctggactaaacaccttaagtccttttcaacaaacactcagctccaactgtccgaccctagttaggattctgggttccttaacccattagtaaatgtatttgaacttaatctttaggaagccttttgagcctatactaaaatcattataaaaactagaatgaatatttttgagggcaggtctcttcttttttactgctgtattcctagtgtctagcatatgcttgatgcatagtgtaaaccaaatctgcattgaattaattactgtgggagaaaaacatactgtggaagaggcaaaccaatgaaggcaatgaggatgtggtgttgtagagacttaagaaatggattatggtgggcacagtggctcacacctgtaagcctagcattttgagaggctgaggcgggaggattgcttgagttcaggagttcaagaccagcctgggcaacttagtgagaccccatctctaccaaaataaaaaataaaaaaatagccaggcttaatgacttgtgcctgtagtcccagctactcaggaggctgagatgtgtggatcacttgagtcaggaggttgaggctgcagtgagcatgattgcgccactgcattacagcctgggtaacagagtgagaccccatctcaaaaacaaaaataaaaaacaaaaaaaaaamcagatcaagtagtaagggtacaagttggttttaattatttttttattttttatttattttatttatttttttgagacagggtcttgtctgtcacccaggctagagtgcagtggcacgatcatgactgactgcaacctctgcctcctgggttccaagtgattctcgtgcctcagccacctgagtgtctgggactacaggtgcctgccaccacaggtggccaagttgtctattttattttatttttttagtagagacggggttttgccatgttgaccaggctggtcccaaactcctgacctcaagtgatccacccatcttcgcctcccaaagtgctgggattacaggcttgagccacagtgcccagcctaggtgttaagtatttttaaaaattcattttgtcagtgcctactgcagcaaggaaaaaaaaaaaaggacattctgtttgactttttaaaagtaagttttggccaggcacagtggctcatgcctgtaatcccagcactttgagaggccaaggaaggcagatccagttgagcccaggagtttttgagaccagcctggccagcatggcgaaaccctgtctctatacaaaatacaataattagctggtcacagtattgtgcgcttgtagtcccagctacttgggaggctgaggtgggaggatcatttgagcctgggaggcagaagttgcagtgagccatgatcacgccactgcactccagcctgggcaacagagtgagaccctgtctcaaaaaaaaaaaaagaataatgtaagttttggttttcattattatatccctgaggagtgacacctttttgcctttgacactagtagccaccagaaagtgtgacagagtaacccagcagtaatttattgacctgtcagaaggctagtgtggaactgttttttccctctataaagtcagttatcatgaacgtgagcaagaagcacttcatatatgtgataaattagtacagtagaataatggaaagcttccagtaccccttggcttcgtgacaggcattgtgcatggacgcttccctgcatagctcactcagtgttctgaacaaacccgtgaatttgtagcctgaaagagatgcaaataatttcacttggatctttgagctaattcagtcattttccccacagaccagagtgaactccgagcaggaacacttcctcattgtcccttttgggcttctttacagtgaagtgactgcatccagtttggtaagaatgtccttctctttggcagcttgtatgtgcaggtcatgttaggtcattcaacatcttcagatcagctaaatatgtaaaacccaagaaacaagaaagagcctatgttytatgtggtgtgttcagttagagaaaaacctttgagagaagttacaaatattgtaatcttgagtttgaatagtttctagttagggtaatttgaagtcctcttgggctggggtgcagtggctcatgcctgtaattccagtacttaagttcgagaccagcctggccaacatggcggtaccccaactctacaaaaaaataccaaaattagctgggcatggtggtgggaggattgtttgaacctgggaggtggaggccgaggtcgcaccactgcactccagcctgggcgacasagccagaccctatcaaaaaaaaaaaaaaaaagaaaagaaaaaatgaagtcctcttggtattttacatttttatttttttattttcaggttaagatcaatctacaaggagatatagtagatcgtggaagcactaatctgggagtgaatcaggccggcttcaccttacactctgcaatttatgctgcacgcccggacgtgaagtgygtcgtgcacattcacaccccagcaggggctgcggtgagtggctgccctggtagcatctcaaggtctaaagctgctgagtgaaaggcactgcacgtttcctctgaattgcccttgttgtttatagtcagtaaaactaattttgttgaatataaaaaaaaaggtgtaccactaagtttgactttcttaaaataattttttttccttttaaggggtccatatatcccatttaatttggaaaaacatgtaataagtctgaaaatgcctattagatttaacaattggccgggcatggtggctcatgcctgtaatcacactacttcgggatgctgaggcgggaggattgctgagcccaggagttggagaccagcctrggcaacatagtgagaccccgtctgtacaaaaaaaattaaaaaattaaccagtgtggtgcgtgcctgtacttccagctacttgggaggctgaggtgggaagattttgagccaaggatgttgaggtttcagtgagctatggttgtgcctctgaactctagcctgggtgacagagtaagaccttgtctcaaaaaaataaaataacagtaaacaaaacaaagtcatagagaattgagggagaggtaagatttcagggtgttgaagactgtggggacgtgcaaaatgacatcagtaagcaggcatctcgttcgagaagaatgggaaaagaaggagagggcaagctggggtggtgggtggagggtgctgtgggctcggggaagggtgtttggggtgtgggagacttgaacgtgaggacagtctgtggggacgagctggggaaagggagaggttgaggcctagaaaccaacctgtccagctccccgcagccaaccagcaggacccaggctggattgtgacggggaagaagaaaaggagcggctgggagaggagacacaggcagtgcaggctgttacgaggcttagcttccaagctgctcaggaaccctcctcctcagctgtgcaccaagccttaccccttctggtgtgaatgggccaccctgacaaagccccagacccctccgtatgaaagtgcacgtgcaggctatctgctcaatgtcatgtgaaagcacagtacttgagaagtatgctttttatcaccaattttatataaggacttttggggtttattgtacaacagatgaccttattgattcagtaatgctgtattttttttttttttttgagacggagtctcgctctgtcatccaggctggagtgcaatggcgcgatcgcggctcactgcaagctctgcctcccgggttcacgccattctcctgcctcagcctcccaagtagctgggactacaggtgcccgccacctcgcatggctaattttttgtatttttagtagaggctgggtttcaccgtgttagccagaatggtcttgatcgcctgacctcgtgatccgcccgcttcggcctcccaaagtgctgggattacaggtgtgagccactgcacccggcccagtaatgctgtattttaattgatcttggttttttttttggagatggagtcttgctgtgtcacgcaggctgaagtgcagtggcgcactctcaactcactgcaacctctgcccctcgggttcaagcagttctcttgactcagcctcccaagtagctgggactacaggtgcacaccaccattcccggctaatttttgtatttttagtcaagatggggtttcatcatgttggcctggctggtctcgaactcctgacctcaagtgatctgcccaccttggcctcccaaagtgctgggattacaggcatgagccaccacgtccgacctgatattgatgttttaatgtcatgtgtgttggattatttggatgaacattacctctggtttgtttcactctgaacatatggttcttatgtcaacatcgtggttttattagatacatcattgtgtgaatgatgtgattttttttttcctgaaagaatgcatgtcactccagccactaaaatgtttatggattttaaagaactattaaaggtacctttgacagtatggttatgaacagctatcacgtaacgtgtttttgtttgtttttctgagacaggatctcaccctgtctcccaggctggagtgcagtggcacgatcttggctcactgcaacttgcatctcctgggttcaaacgattctcccacctcagcctcctgagtaggtgggactacaggtgcacgccactgcacctggctaatgtttttattttttggtagagacggggtttcaccatgttgaccaggctggtctcgaactcctggcttcaagtgatctgcccaccttggctcccaaatgactgggtttatgggcatgagccactgtgcccagcctctttttaaaattatcaaaataattttgcttggtaaggaaatttcttcttgtatgagagctgatactttggaaggagttaaatgtggtattgtctttttaggttaacttttctctatggaattgataaagatagtttttgaatctttgaagcctgttactttagggtcataatgttgctgtctataggtcttgtctttagaagaccttcaaaaatggcatattctgaggccactctggggaattttaggaaacttaaggactctatgaacacttagatttttctctttgagagtcaattttacttaaatacatgtagagaaattatataagaaattatatataaattgtatatatataattacattatatatatacaaacttgtataaatttgctttcacctaatttttaggtgtttcaatgttatctacaacctaagataaaaagtacagaaaaactttagagcacttggaaaacctcctcctttttttttttttttttttttttaggagatgagggtctcatatgttgcccaggctggctttgaattcctgggttcaggattcctcctgcctcagcctctagagtagcctcttgactacaggtgcatgccatcacatctggctaatttaaaaatattatttgtagaggcgggggtctcactttgttgcccaggctgacgtcgaacttccaggctcaagtgatccacctgccttagcctcttgagtgttgggattacaggtgtgagccaccatacctgatgggaagccttcttttgaaatgcactgagtcctcagaggagtctgtggtctgctccttgcactagatgcagtgctcattgtataattaaatccaggtttacatagcacttatatcagtgggaaaaagtctagaaagatgtggattttcttttgaggctctcccagtttaggggtagttttgtttttaagtgtgaattgttagcactggaaaccaagtttgtcttaagttcatagattgattttcaagaagaggacaaaaacatttcccttcccattttatttctgtgaggaaagcatttaccatatcatcagtcattgtgtaaccccaggttttccttcttcatggcgaccatttggtctctaggtctctgcaatgaaatgtggcctcttgccaatctccccggaggcgctttcccttggagaagtggctwatcatgactaccatggcattctggttgatgaagaggaaaaagttttgattcagaaaaatctggggcctaaaagcaaggtcagtaggcatctaatctggtatttaaattacagcagaaagaagaataaagcaaaggaccagtcttcctgcccagctccacagagcattcatgcttcccctcaggttcttattctccggaaccatgggctcgtgtcagttggagagagcgttgaggaggccttctattacatccataaccttgtggttgcctgtgagatccaggtaggggacagccattccagtcactctgcagtttatttagatgtgtctggggttcacatagatttttttttgatacttatcgagtaggagaggagtctttgagcaatctctttgccaaagataagctcatggatttgggacttgatcaggacaaatgctgtttcactgattgaagttggcaaaggattactgggcttttcatttctaatttttaaattttcaaatatgtcagtcactaccatttatggagtactggtgtgtataggcctggcatcaggtgcttagtgtgtgtcatcgcatatgtgatgtcacgtgacccccacagtactctttgaaaaagcaggtatacagaagtagagactcagagacttgcctgcagcttacagctgtgagttcccctccgctccgtcagccgttagttcacgttctcccctctgcttcttgacttatgtctgtggcgtagtgaagtcccaagtcctttgtaggatcctgaaaggtgctgtgttttctcatttctctgccaactttggtgcccaatatttttgtcatgctaaagaaatacttctgaaagtaactttgtgatcagtctgtcactatccattctacattttttattcttacactctagagatttggtttcttttgaaacctacatttttattcaagtcatctgaccctcttgatctcagtaaggaactcaagccatgctgtgtgtgttttggaaaaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggawtttgaagccctcatgcggatgctcgataatctggtaagaatggtgccaccacttgatgataaaccttttgttctaaaagcatcagtgttggtgttcttacagcaagtgcgattgctgtcttttatgcagtatctgaataccttcaccttcaaagtcatgaagaagcactagggttgtttaacttctgaggtaaattacaataaaatgtagaggtgaaggattcctggtattgttttattttttaaagataaccttgtgtttggactcagtggggacaagagcacagagaatgcgtaggcagctggatgaccagctgtgtcagctcagtccccaccatcccacaagcaagcgagagaggtggcacttttgaaatcggtcagtcaggtatttaggcttttgtcttaacagcaaatcctggctgtctggggcctgatgactgtgttccatgggtatccactccctgtccacagcgtgggagcccctcagctgcttattgcagggacacagagcccggcatggtccagaaggcgggcttatggggcctgcagcacacagggaaagtgagcccacactgtgataggagggcagacacacaggatgtgttctgtgttacagggttgccgtgaagaatttcattcttttgcaaggactggagagaaaattttatgtggaaggtagcccttggaaatgacctcaaagaataggtaggatcttagcctgcrtttgaaagcctggaaaaaaacaggatgacaggatgaagaggccacagcacagctgcagacaatgggagtggggagatgggaacatgcaacgtacggtgcacctttcaggttcatcttgactttaccaggatcattaaatactcagttcttagagctgtattagaacactgcccttggggtctcagtcccgcagccacatcatcagacacagggctctggaacagatcccttccatgctgcacatcagacctcttagatgggggtcacgatggtccgtcctaacgccacatgacctcaagtggtgtagatgtgaggacatgtcagtgtggggaaagaaggcctcagaggggccagtatccttgtatgctgccagccagtactggacaagtgggcacgttccagcctaagacaggcgtggcccttggaccagatcacagatgagatgggtggcttcaggaagcagggtggcttcaggaggcaggaagtttaactttcctgaaggtttggaataaaaagtattcataggtctgattcaggctatgttaaatgttcttactgaaattctttgcacttgggatgaatattgtccgctagaaaggaggaactgagggttttctgcctgggcgcgatagtcagtcagtggagtagactcaatcagtgacacagggacgaacagagaaggcagagtctagcgtaactttttgagttcatataatcagtgaggttgattgcattaattgactgtctactgttgagtcatgaacaggacacagttcttgccctcaggagtttatgacctaataagagagatggacaaacgattcccaaatgagccctgcccctgtgatctgtgcagtcataggcatgatgagagcttgcaggcagaggtgggtgccgattggtcaaggaggtaggaagaggagcaaaagctcatgaagaaggctgaagaagcagttagagttgggtggccagccagggtagtgaagctgcagggactcatagatggagaaagcttgagagtggggcagccatggcccaggtgtgcgtcaggagccaggtcatccagcatggctgtgcaaggtaaggagggctgaggttggcccagtcacacagcccctgcctcctggtaaatacggcgacattttgctgctcttctacttacagtcagtgtgagggaggagagaggggggtcagaatgcacagcagccaccaaagactgtgctgaaagcacatcctagaaggcggagagggggaagtcaaaatcaggtagaaactctgatttggtagggaaggaagataaggatgaatgattaataagtaaaacattcattacaaaaagcatgatgaatgtttactcagtgtccttaatgtgtacagattgttttaatattagaaggccatatagtttataagaaataaactagacagcaatcactaatcatagtccatgttttaatttagcatcggggttggcatatatgttgtttgctaataactgagtagagaatagttgccaatttccacactataatatatgttgcagccgagcacagtggctcactcctgtgatcccagcacttcaggaggctgaggtgggagaccaggagcttaagaccagcctgggcaacatagcgagattcctctccacaaaaaataaaaaaatttcaaaaagagagataatatttcatttgaacttctacagttagaaaaaaaatgctaaattgtcccccccccaaaaaaaatcaagatataatttcagtttctcaaagaaggaacaaatccatatatattttctctttctttttttttttggagagacaggatgtcatcatgttgcctaggctggtgttgaactcctgggctgaagcagtcctcccacctcagcctcccaaagtgctaggattatgggtgtaaactaccacgcctgacccaaatccatgtttttaactacaagccagatagtagttctgaggtctgagtattacttctggttttggtttaacagcatttaaaggggaagaataaagaaaaatccatatggtttcaggataaaatgatgttgatgagtcctgggtggtttattctgaagttgtggagattactgagttctggctctttaagcaaaaggaaacttgaattaataagaactgtgtttttctgcagatagtctttatggcagagtcattctcttttattattcctcaacaaagcatgctcagaaatgggaaaactgccagtacacacatttaccttatctttctgaggacaattatgaaaataaaacccaaaacaactccattcatgattgttattacctttttaaaaaaatgtaggccggtcacgatggctgatgcctgtcatcccagcactttgggaggccaaggcaggtggatcacctgaagtcaggagttcaagaccagcctggccaacatggtgaaaccccttctctacaaaaattagccaggtgtggtggagggtgcctgtaatcccagctactcgggaggctgaggtagaagaagcacttgaacccgggaggcagaggttgcagtgagccaaggtcgagccacagcacttcagcctgggtgacagagcaagactccatctcaaaaaaataaaaggaggccgggcgtggtggctcatatctataatcccagcactttgggaggctgaggcaggtgggtcatgaggtcaggagattgagaccgtcctggctaatacagtgaaactccgtctctactaaaaatgcaaaaaattagccgggtgtggtggcacgtgcctgtggtcccagctattcaggaggctgaggcaggagaatagtgtgaacctgggaggcggaggttgcagtgagccaagatggcgccactgcactccagcctgggcaatggagtgagactctgtctcaaaaaaaaaaaattaaattaaaaaaataaaaaaaatattgaaagagtgattagtaatgaagatggcccccaaaaaagagcagtacccagaggggagagagaattctgaattgagaggactgtttctagagtaccacagccagcagggcacaggccactgaagtgtcttgtatgtctgaccctgtgcagtccctccaagtcctgattctcttgtgatgtattgtgaaggtgctgtgagtgacttggttcaggtgcgaatctgttaggttgttgagcagacagctcttcagcatcccccgtattacctctctgtgctgggcaacaaatcactacaggcctggtggcttcgaacagcagccatttatttcctagcttctgtggggcaggagtccaggcacagcgaactcaacctagggtctcataaaggctgcattcagggtgttggctagggctgggttctcatcaggagacttgactcagaggatccacatccaggctcttctagactggggacagaattccttttcttagggctgaagcattcttggcagctttacttcttcagagccagcagtagagacagagactcttataagataggtgctaaactcttctgtgatacagcccatcatcaccttttgtgaattccgctacttagaagcaagtcagagatctcacctgtgctcaaggtgggaggggattacaggagctgggggcctggggccactgtgaagtctgtctgtcacacttaccaagtgtggccaggagagatgcagaggacaccgtccatgcccttagagatgctgtctgtgggaggactctgcagatgagttggtccagtagaggcatgaagtaagtggggctgtcttttaccacagagcacatggtcatgaggcagagctggaggtgaatttgaatgttgttgtattcagacgtaaagtaattttgctgagaaccagttgtcatgaggtatacttacttaccttacttacctaaagattatcacagtatttaaactgtaacttaagaggtaaaagtctattaagtatgttgatgaatataacctgcacagtggctggcagcaagtaaaccctgtttgggtgttcaactttaattttttgttgaaatatgtaagcaggagagtgcacctaccgcaagtgttcagtttgttcatttttaaaaactgaaccccctgtataaccagcagtcaataagagcaacggtagcagcacctcagaacacccccagcacctccttcagttcacttgtcccatcccaggggtgacaactgtcctgtctcccaggacaaccaaaacaaaggttgttttgcatcttctgcacttttaatgaatggtattacatggtgtatgttctttgcaggttggtctctttcactcagcgttgccttcaggagagtcatccacgtggttggtttagagcacattgtgtcactataagccttcttatgaagacactagactatccatctcctatatggatggacttttgggttgtttccaattgtggtttacgaggagtagggttgctgtccacattttagtacctggtttttggtgaacacatttgcttctgtggggtgtaaaattaggagtggaattactgagtcatagggtatgcatgtgttcaacttttgtggatgtttccacatgattttccaaagtgaaaccctgttttgagatctggaatattgactgtctttcactctccttggaccctagggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaakggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctyctaaaacyatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgygtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcrtcagcctaccttatgacccagattcagctgggctttccagatggtggttttccatcagtcatgactttgacttccagcattaactggtctttatgtggctgcatcctgctcccatggcgactctgctragtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaaggtgcgtcctgcgtcggcactcagcgggggcttgggtgtgggattggaagggatgccagctgctttggggggagcgggtgcttgcttctagcagagggcatctgctgttgttgccactgttgcagtgaagccatctcttcacaccgctgctgttctaccaccagtgtgaagtatgagcagcagacattttttgggccctattgattcttgaactgatgtttgctcacgatgtttgctcaccggtcagaattggaagctgcaaaacctgttcttagcaagagcagactgctgtccctttcagggttcgttcaaagacttgtgagtggcatttggtgtatcagagcaggagccctgccagtgctcacatcactagacgatggacatgcagcgagtgtttcccccaagttaatgacagtgagagataggtgtcctgcccaagcatctggaagatgtggggagctgggaatagtctccatccctgcagacccacgccccactaagcaggcatggcggtcactcagaacacatggggccatcctgcctgcgtggggcagtgggagagctgaaatgtagcttccatgtggctggggcccaagtgcacaagcagcagggctcccaggcagcatggctgctcaggactgttgatgtgtgcctctccttcccaccctcagatccgagagcagawtttacaggacattaagacggctggccctcagtcccaggttttgtgtggtgtagtgatggacaggagcctcgtccaggtgagagcccagagtgtctctgactttagtgggtggtggctgtgtgaccgcctgctccaaagttattctgaaattgagagagtgactttatgaggtaagtattctaggcaaccagttacctttgttaaaaccttcatgatgagaaacggttcaggcacttttcsttgagttctagaaggagcgagcatgctgagggctgtgtccacccctctggtcatgccccttgtaatgcatgcatatgtgagggtggcacatacaccaccagctttggggctcagattcggccygggttcagcagcgttctgtgtaaggcgctaggagagggtgggtttagggactcttgttctggtacatattgctgtctgcaacaaagtgctgcttgggttgcagaggggtgggtgcctgtaagtgtggtgcacatttacacacatttctacaaaatgactctaccttgtggcacattgaagataattgtgtaagtagttatctctgaaaactaatatgccacctaatgctttaacacctgactctgcaggggtagacgattgttggatttgtccagccgtggtcctggtttcgtgttcagtgtctgcacgtcctgccatcatcactgccacacttactgttgacagctgtccctgctgcatgctcttagccagctccatcctgtgctctcagctgatatttcacaggctgggcctggtgtgctctggtgactcagtttactgtttcaggatgcacctctctctgactgtacggaaactatcgaagggctcgagcttacagagcagacctttagtcccgctaaatctctctcttttagaaaggtactcactgccctgtcctcactacctgtctatgcgccttgctcccctcccctcccccctccccgtctcctctcttcaggcattgtcttagttactgaagtagcttcaaatggatctttaacctgtttgtgagattgtacagaaggttctgttctayctacttgattctttaattaaaacatttgctatgaggtgtgataacaatttccagcattcgaagttgttactgagaaatggccagtctgagcaacgtggtgcatttctgcagttccgcacgggactttggtcagtgcgtgttttgggtttcaraatttgccttttccatgactctgactgcagacagcctcttctgggcagtctgttgctgttggcagcggccactcccgagtgcccttccaccctcgctggttcaactttgactgtaaatgtcatgaatgtagccactagaggtcatatcattgaaagatgtcatttcagaggaatgggaattcagacagtctttgtcagcccttgataaaatgtatttatttgtacctcaaaaaaaaaaaaaaaaaccctaaataacatttttaaatgccacagaggagaaagacttaggagagwctgaaacccctcactgtgattccctctgtgtgcgskcatctagtatgtggagtaggtggaagatctgtctgaacccacccacgtagaaggaaatcctccctaagaatctaggctgctagtgtgcaggagttggtgccacgcagaaaggggctgaccgcatggttgaagagtcttagctgagaggtatgtttatattcttgtcaaaggaaatttccagaactgtctctttcacttgtcacaccttcattgagatgcatgtgtcactttagtggtgttccagttcccacatagaagcaggtttrtagcaaagattctgtattcctgtctgtaatccctgctaataacattattttgcatatttacttattaattccacagktcctgtttttccctgtgcttagagcatccttccagctgccattcttggaagagcttctcagagcaggggagaaagatgactctgcctgttgcttgtttttcatcttttggcactttgttgcggtcttgtcagttattctttctctcaggtgtgtgagggctgtgcaggccatgagcccagctggcctcctgtgtagagcccacgtgagggcagcactgaggaccttgttagggctctccagaaagcagcctgggtcgccgtgttcaaccaccagttacagctttgtgtgctctgtcccagtgatattcagatgtgggtgtgtgtcactgtcacctgggggcttcctgaacgatagaggtagggtccgtaccttctgaacaccatgctcactgcgagtgctgcatccaggtgtcattagcagagaataccactgtacgctgaccccagaggaagagagcttgaccacctggacagaaatccttgttccacctttgtgttttctctacctccttatatctgaagtttacttttgcacccttgatctttatcccactctggctaaaatatccctctttttggtgagaatgtgctttggctccatgggagtcctttactgggcaattgttccacttcctttcatgtgaacctcaaagcacagacagtcttgctccttttggaacatggagctgcatgttgagaagttgagtttttccttgaccaagcaaggacgactgtgtcccacacactcccctccccagtgaggcgagtgcgtggatgcctgcttcccatctgagaacctgaagaatgggtatttgggacttagggagctggggcttttctggaaaggactttcctttgccttccatttctccctcactggtgatggccattcccacagtgcaagtgttgccttctgatagaagaaggaacagtaatcacagttcaaacaggagttcgcagcccagccgaaggctgtgttgactttgttttgggcagcataacatgtaacctgaaatacatatatatatatatatattttttttttttttttgagacagggtctcactctgttgtccaggctggagtgtggtcgggctgtcttggcccactgcaacctccgcctcccgggctcaagcagtcctccctcctcccatctcagcctcctgagtagctgggactacaggtgcacatcaccacacctggctaaatttttgtatttttttgtagagactgggttccgccacgttgcccaggctggtctcaaactcctgagctcaagcagtccacctgactcagcctcccaaaatgctgggattatagggtgtgagccaccgcgcctggcataacctgaaataattttggctgccctctggattcaattgcaagtgaaatgaaggattagagatgaagatgtgagtctacactgcaagctattcagcccagggaaggactcttgtgttcccatgtgcacctcaccaggggctgtgttctccaacacccttcatgctgtgtggtagaaatgcagaggggcagtaagctcaccccttggactctctcagtgacctgtgttgagcacctaacctgtgcatggtccagcactgggaatgccagtccagatccaagttggccctgctcgtagatgaaaatctgatggtcagagaggtcagccrctagtgcaggttgcacagcctcgggtggagctcttgttccacccaggttgcctcagtcaagtatggaaagttactgggcctgtgttttgctttagaggcttgtcaagtgacagggaggtgaggggagtggcaggaggggaagctaggcacatcttggtttcttgtctgggttgtccatgagtggcgtatgtttctctgcatctcagtcattgctctgtgtcctttcttgcagaggaatgtgattctctgttcccataactggtcttgacagcagcttaacccttagctgtggtctgtggaggagggagctctccaccactggggacctgctgcgctgtgcctcgggcttcagctgtctcagtatgagagagccccgcttgtcctttggggcatcaaaattgggaacaagggttttgatgtctctgtgccaatggatttttatttgtatttttatttttattttgagacagcatcttactctggcccatgctggagtgcagtagtgcaatcacagctcactgcagcctcgacctctcaggccaaaagaatcctcccacctcagcctcctcagcagctgggactacaggtgcatgccaccatgcttggctaatttttaaattttttgtagagacaaggtctcactatgttgcccaggctggtctcgaactcctgggctcaagcaatccttctgccttggcctcccaaagtgctgggattataagcatgagctgtggtgcctggctgatagtttattctttgtttgtttgtttgttttgtttgagacggagtcttgctctgttgcccaggttggagtgcagtggcgcaatctcggctcacctcaacctccgcctcccacgttcaggtgattcctttgcctcagcttcccgagtacctgggattacagatgcccactaccacgcctggttaattttttttgtatttttagtagagacaggttttcgctgtgttggccagggtggtcttgaactcctgacctcaggtgatccacccgcctcagcttcccaaagtgctgggattacaggtgtgagccaccatgcctggcctgatagttgattcttgatatttgattcctttactaattttaaccacttgatttaaatgaacttaagcatttctcttgtatcaccttctcatttcattggcagtgatatcaggatgcaggtgcagccagccaaactgctgttgctgggataccatctctagagtgccatcatgtgagggctcttagcagtggccagcccagcagctcctccttcagatagtgaggcaggcctctggtcagggaaagacttggctcgggccacagcgctaagacatggcagacaggactcagcttcctgtcttggtgaggcagggcaacttcttaacgaaaagccaatgggcctcgagtcagacctggttcagaagagggttccctttgacttgttgactgtcgagagtctccaggctcccgggcaaaggttgcctgttccagcagcccatctgtccctctcggagctctgtgtcactggtcagcactgggtacgcagcatgctaggtggtaacccctcagcccatcccagtcagtccaagttcccctgtctctgcttgaggagcggtcggcctgtgtgagttgaatttcccgagtcagcccagctaggacgctctccatctctggtgttcactccgcactgagagcagcactgaaggaccaggcctggcatccaaagaattgtggtttctcctgtttctatttggttttggaagctgtcagtcatgtgcatgtgtgtaagtgctggataactgtcttagaagtgagctccagggtagccgggcgtggtggcgggcgcctgtagtcccagctactcgggaggctgaggcaggagaatggagtgaacctgggaggtggagcttgcagcgagccgagattgcgccactacactccagcctgggtgacagtgcgagactccgtctcaaaaaaaaaaaaaaagaagtgagctccagggaattaggggacattttcctgcccctgacccaatcaggctgcactgtgggcacagcgctgtgctggggcaggtggctgtgagtggaccgcaccccctgatgcccacccagcccactgtgctggcctgcaggctccacctcctgctttaagattggtgtggtctgtgagccgccttggtgcttcgctttcttctttttttctttggtacaaattttcagagttttccaaattcctcagctaaacactggtgtcttggggcatgttgtcatctcggaatgttttgggataagctccaggaactagttacaaactaaccacagtcaaaagaacagaacttacctgtgctcttagaatatgagcaaagctctgagcatgccttacgctgagtgctgtacctcgtgacagtttctgatgtcatgaggaaaacttactgacttttaaacagtaacaggaaagggcctcttccccttctgctccacagtgaggagtgggcaccctccctgaggtgctctgtgctcttgggtctgcattgggcttttgcttctgaaacctggaaggctctgtaggatttcttttgtggttaatatctgttcatcgtggcactgacctgtgtttccattatataccactgaaggctgcagctcagcctaggcctcgggcccatggcagtgcagtctcaggggtctctgctcctggaaagcctcctgcccccgccctgcctgcagcctgcctgggaggagggagagtccccatcgggccgggctcctgcagaccagatgtgcctttcatccacagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctstgaaggtgagtgcttgtggtcctgggcacggccactccagaaggtgaaagtgctctgggagcttctttgtggtccaggtgctggctgtgggtggtgataagaatagtcacatgcatcaaagacaaaccagaactttatccagtactcatttccaacctagtcactcaggccagaatggaagaaattgctggccgggcacagtggttcatgcctttaatccagcactttgggaggccaaggagggcggatgacctgaggtcgggagttcgagaccaacctgaccaacatggagaaaccccatctctaccaaaaatacaaaattaggctgggcatggtggctcacgcctataatcccagcactttgggaggccgaggcgggcggatcacgaggtcaggagatcgagaccatcctggctaatacgatgaaacgccgtctctaggaaaatagaaaaaaaattagccggatgtggtggcaggcacctgtagtcccagctacttgggaggctgaggcaggagaatggcgtgaacgtggaaggcagggctttcagtgagccgagattgcaccacggcactccagcctgggcgacagagtgagactctgtctcaaaataaatacataaatacatacaaatacaaaattagccaggtgtagtggcgcatgcctgtaatcccagctactcgggaaggctgagtcaggagaatcgcttgaacccrgggggcggaggttgcggtgagccgagatcgtgccattgcactctagcctgggcatctcaaaaaaaaagaaattgcaaagttaggcacacttgtgagtggccctggctaggagggagacgtgtgtaaatgacratgtggaggactagtggtggccactcacaagagtctgygcgccatactaagacacaccggggcccctctgccaaaacgaggctgaccccgaagatgtcctgccgtggtcccatccagcagctgtgatgagaggagacagcaggaccgaggggcaacccacagaactctgggctggagggcattggtccttctcccagggaggtttctgtccacatggagtgaccagacattcacaaaagaattcactaatttggatcagttagtgggaaagccagcatgcatattattattattattattattattattattattattatttttgagatgaagtcttgctctgtcgccaggctggagtgcagtggcacgatctcagctcactgcaatctccgcctcctgggttcaagcaattctcctgcctcagcctcccgagtagctgggactacaggcatgcaccaccatgcccagctaatttttgtatttttagtagagatggggtttcaccatgttggccaggacggtctcaatgtcttgaactcgtgatccgcccgccttggcctcccaaagtgctgtcattacaggtgtgagccactgcgcccggccctgaatattatttttaagagacttttgtctctctctctcttttttttaaattaattatactttaagttttgggatacatgtacagaacgtgcaggtttgttacataggtatacacgtgccgtggtggtggcacatgtatgggtggcacccatcatctacattaggtatttctcctgatgctatccttcccctagccccacacccctgacaggccctggtgtgtgatgtccccttccctgtgtccatgtgttctaattgttcaatccccacttatgagtgagaacatgcagtgtttggttttctgttcctgtgttagtttgctgagaatgatggtttccagcttcatccatatccctgcaaaggacatgaactcatccttttttatgattgcatagtattccatggtgtatatgtgccacattttctttgtccagtctatcattgctgggcatttgagttgtttccaactctttcgtattgtgcatagtggtgcagtacacatatgtgtgcatgtgtctttatcatagaatgtttataatcctttggttatatacccagtaacgggattgctgggtcaaatggtatttctggttttagattcttgaggaatcgccacactgccttccacaatggttgaactaatttacactcccaccaacagtgtaaaagtgttcctatttctccacatcctctccagcttctgttgtttcctcgctttttaatgatcgccactgtaactggtgtgagatggtatctcattgtggttttgatttgcatttctctaatgaccagtgatgatgagcttttttttcatgtttgttggctacataaatgtcttcttttgagaagtgtctgtttatatccttcgtctgctttttgatggcattgtttttttcttgtaaacttgtttaagttccttgtagatcgtggatatgagccctttgtcagatggatagattgcaaaaattttctcccattctgtagattcccttttcattctgatgatagtttcttctggtgtgcagaagctctttagtttaattagatcccatttgtcagttttggcttttgttgccattgcttttggtgttttagtcatgaagtctttgcccatgcctatgtcctgaatggtattgcctaggttttcttctaggatttttatggttttaggtcttatgtttaacccctcttgagttaatttttgtatgaggtgtaaggaaggggtccagtttcagttttatgcatatggctatccagttttcctaacaccatttattaaatagggaatccttttcccattccttgtttttgtccagtttgtcaaagatcagatggttgtagatgtctggcattatttctgaggcctctgttctgttccgttggtctctatatctgttttggtaccagtaccgtgctgttttggttactgtarccttgwagtatagtttgaagtcaggtagtgtgatgcctacagctttgttctttttgcttaggattgtcttggccatacgggctcttttttggttccatatgaaatttgaagtagttttttctaattctgtgaagaaagtcagtggtagcttgatgggsatagcattgaatctataaattactttgggcagtayggccgttttcacaatactgattctttgtatccatgagcatggaatgtttttctatttgtttgtgtcctrtttcgctgagcagtggtttgtagttctcctcgaagaggtctttcacatcccttgtaagttgtattcccaggtattttattctctttgtagcaattgtgaatgggagttcactcatgatttgactctttgtcaattattggtgtgtaggaatgcttgtgatttttgcagttgattttgtatcttgagactttgctgaagttgcttatcagcttaaggagattttgggctgagatgatggggttttccaaatatacaatcatgtcatctgaaaacagagacaatttgacttcctctcttcctatttgaatacactatatttttttctcttgcctgattgccgtggccagaacttctaatagtatgttgaatacgagtggtgagagagggcatccttgtcttgtgccagttttcaaagggaatgcttccagcctttgcccattcagtatgatattggctgtgggtttgtcataaatagctcttattattttgagatacattccatcaatacctagtttattgagagtttttagcatgaaggggtgttgaattttattgaaggctttttctgcgtctattgagataatcatgtggtttttgtcattggttctatttatacgatggattacgtttattgatttgcatatggtttttttgttatttggtttttttttttttctttcctgagacggagtctccctctgtcacccaagctagagtgcagtggtgcaatcttggttcactgcaacctccacctcctgtgttcaagcctcagcctcctgagtacttgagactacagacacacgccaccacacccggttaatttttgtatttttattagaggyggggtttcaccatgttggccaggatggtctcgatctcctgaccttgtgatccacctgcctcagcctcccaaactactgggattacaggtgtgagccaccgcacctggttgatttgcatatgttgaaccagccttgcatcccagggatgaagccaacttgatcgtggtggataagctttttgatgtgctgctggattcggtttgccagtattttattgaggatttttgcattgatgttcatcagggatattggcctgaaattttctttttttgttgtgtctctgccaggttttggtatcaggatgatgctggcctcatacaatgagttagggaggagtccctctttttctattgtttgtaatagtttcagatggaatggtacctaccagctcctttctgtacctctggtagaatctggctgtgaatccgtctggtcctgggctttttttggttggtaggctatttattactacctcaatatcagagcttgttactggtctattcaggggtttgacttcctcctggtttagtcttgggagggtgtatgtatccaggaatttatccatttcttctagattttctagtttatttgcgtagaagtgttcatagtattctctgatggtagttcgtatttctgtgggatcagtggtgatctcccctttatcattttttattgtgtctatttgattcttctctcttttcttttttattagtctggctaaatggtctatctattttatcaatctttaaaaaaaaccagctcctggattcattgatttttttttgaaggcttttttgtgtctctctccttcagttctgcactcgtcttagttatttcttgtcttctgctagcttttgaatttgtttgctctttcttctctaattcttttaattatgatgttaggatgtctattttagatctttccctctttctcctgtgggcatttagtgctataaatttccctctaaacactgctttagctgtgtcccagagattctggtacgctttgtctttgttctcattgttttcaaagaacttatttatttctgcgtgaattttgttatttacccagtagtcatttaggagtaggctattcagtttccatgtagttacgcagttttgagtgagtttcttaatcctgagttctaatttaattgcactgtggtctgagagactgtttattatgatttccattctcttgctgaggagtgttttacttccaattaggtggtcaattttagaataagtgcgatgtggtgctgagaagaatgtatattctgttgatttggggtggagagttctgtagatgtctgttaggtccgcatggtccagagctgagttcaagtcctgaatatctttgttaattttctgtctcgttgatctaatattgaaagtgggatgttaaaatttctcactattattgtgtgggagtctgagtctgtttgtaggtctctaagaacttgctttatgaatctgggtgctcctgtattgggtgcttgtatatttaagatagttagttcttgttgttgcattgatccctttaccattatgtaatgccctgctttgtctttttaaatttttgttggcttaaagtctgttttattagagactaggattgcaactcctgctttttttttttttttgcttttcttttgcttggtaaatattcttctatccctttattttgagccagtgcatatcttcgcatgtgagacaggtctcctgaatacagcacagtgacaggtcttgactctatccagtttgccagtctgtgtcttttaattggggcattttgcccatttacatttaaggttaatattgctatgtgtgaatttgatcctgtcattatgatgctggctggttattttgcccgttaactgatgcagtttcttcatagtgtcgatggtctttacaatttggtatgtttttgcagtgggtggaactggtttttgctctccatatttagtgcttgcttcaggtgctattgtaaggcaggcctggtggtgagaaaatctctcagcatttgcttgtctgtaaaggagtttatttctccttcacttacgaagcttagtttggctggatatgaaattctgggctgaaaattcttttttttttgagacggagtcttgctctgtcacccaggctggagtgcagtggcgtgatctcggctcactgcaagctccgcctccagggttcacaccattctcctgcctcagcctccccagcagctgggactacaggtgcacgccagcatgcccagctaatttttttgtatttttagtagagatggggtttcaccatgttagccaggatggtctcgatctcttgtcctcatgatctgcccgcctcagcctcccaaagtgctgggattacaggcgtgagccactgcacccggccgaaaattcttttctttaagaatgttgaatattggcccccactctcttctggcttgtagggtttctgcagagagatctgctgttagtctgatgggcttccctttgtgggtaacccaacctttctctctggctgcccttaasattttttccttcatttcaaccttggtgaatctgatgattatgtgtcttggggttgctcttcttgaggagtatctctgtggtgtttctgtatttcgtgaatttgaatgttggcctgtcttgctaggttggggaagttctcctggataatatcctgaagagtgttttccaccttggtttcattctgcctgtcactttcaggcacaccaatcaaatgtagctttggtcttttcacatagtcccatatttcttggaggctttgttcattccttttcattcttttttcttttaatctttacactttatttcattaagttgatcttcaatctctgatatatcctttcttctgcttgattgatttggctattgatgcttgtgtatgcctcacgaagttctcatgctgtgtttttcagctccatcagatcatttatgttcttctctacactggttattctagttggcaattcctctaatcttttttcaaggttcttagcctccttgcattgggttagaacatgctccttkagctcagaggagtttgttattacccaccttctgaagtctacttctgtcagttcatcaaactcattctctgtccagttttgttcccttgctggtgaggagttgtgatcctttggaggagaagaggcattctggtttttggaaatttcagcctttttgcactggtttttcctcgtctttgtggatttatctacgtttggtccttgatgttggtgaccttcagatggcgttttcatgtggatgtcctttttgttgatgttgatgctatccctttctgtttgttagttttccttctaacagacaggctcctctgctgcaggtctgttggagtttgctggaggtcgactccaggccctgtttgcctgggtatcaccagcagaggctgcagaacagcaaagatcgctgcctgttccttcctctggaagtttcgtcccagaggggcacctgccagatgccagctggagctctcctatatgaggtgtctgttgacccctgccgggaggtgtctcccagtcaggaggcacaggggtcagggacccacttgagttggctgtctgtccctcagcagagcttgagtgctgtgctgggagatccacygctctcttcagagccagcaggtagtaacttcagtctgctgaagttgtgcccacagccaacccttcccccaggtgctctgtcccagggagatgggacttttatctataagcccctgactggggctgctgcctttctttcagagatgccccgcccagggaggaggaatctagagaggcagtctggctacagtggctttgcatagctgcggtgggctctgcccagtgtgaacttcctggcagctttgtttacactgtgaggggaaaatggcctactcaagcctcagtaatggtggatgcccctccccccaccaagctccagcatcccaggtcgacttcagactgctgtgctggcagcaagaatttcaagccagtggatcttagcttgctgggctccatgggggtgggatctgctgagcaagaccacttggctccctggcttcagccccctttccaggggtgtgaagggttctgtcttgctggcattccaggcgccactggggtatcagaaaaaactcctgcagctagctcagtgtctgccgaaacggctgcccagttttgtgcttgaaacccagggtcctggtgtcatgggcagccaagggaatttcctggtctgtggattgcgaagaccgtgggaaaagcgtagtatttgagctggaatgcactgtttctcaagccacagtccctcatggcttcccttggctagatgagggagttccccgactccttgcacttcctgggtgaggcaacaccccaccctgctttggctcgccctccgtgggctgcacccactgtctaaccagtcccagggagatgagccaggtacctcagttggaaatgcagaaatcatccaccttctgcgttgatctcactgggagctgcagatcggagctgttcctattcggccatgttgcctgtcaccctgacatttgtctctttacgaacacagtatttctgtctgttgaagcttcaccggggagagacctcctttactcagtttgattcattaacactcagcattgctgagcagtcattgtgccgggcacatgcccagtgctattgtgcgtacatctcatctcattctcaaagtaaccctgagagataggtcattttcccccggctggagcagaggaatagggagctcagacagggcggctcgcgagaacgaggttgtgcgtggccgagccctgatttggacagaagcgcactgccttcctcactgagtctttggtcacagcagtcagccccggcctctgtgcagggggacgctctgaacgtccttactgtgcttgtgtgtagggcttggggtttctgacagaaattctctttctccataaaccttgagggtttcctgtgcaggtgtggtcacaggccggagggtgaaaatgctgactgccctggcatgtgcccaggtcccatcaggaatggctggtgcagcctgtacttctcttggtagcccgctgacaaaggcggtcttgtttttgtcaaagatggggcagtcttaaaatgaatacaaataagcggctcaagtttgagaccctcacggagcaggtggtttcaaatgtcaggctttgaaaaggaaatgttgagaactaatgagagaagcaggtctccaaagcctattccttgagggcttttgggcatcagctgcttttcccccaagctccctgctgccagctctcttgtccactaggctctgagcagccttggtgctggcaccaagaagaaccaggggcacagggacccctgccaggaggctcccgccagcatcctcagggccgtaagctccaactcaggtttttactgaaacctcagtgtgcttctcagtcctccggggtcagccttgctggagccaccttgttgtgtgggactgactgttgctctcctgggccgtcgtcatcctgggagctaggcactcctcctaagaggacctcttcaccggtttttgtctcgttctagaccagccactgcattacgtagttgtgactgaaatttgagttgctgaattgtttttcagtgtcacaccgctatttactattcaggccgccacacacaccaggccctgctgctggttgtctccctccagtgaagctttgtctgagccattgctgtaattacctgccttagagcgagaactggaggtagtcagcttgagctgtgggtcatgtggcctcctcctagtttctgtgcacatgtacacagacatgtgtctgccctttggagtctcctgggatctgagtaacctggattgtttttaaaaacaagtcaaacaagatatgtggagtttccccccgatgtgtgaggctccttcagcagggctgtgatggcagctgagtggatggggacaggctctggccgtgctctgtgatcacagagctgtcagcaggagaacccacaggaggtctgatctggcccttggcatgggctgaggggagaatgtgccacaggtaaaatgcaggctggctgccagaggtcagcaccttttcccggttgaggctgtatgctcactcagctaggtggtatggcggcctttttatggacacctggcttctggaaggtagctgccaacgtggtacttggggaggcgagccagctgttagggtgggagcagaggccctgggagctcagaaggatgatgatagctgctggttcaaaatacggacctgctgatcctaagctatkaatcttaaacttctgaaataaagacagagatggaaggagttagaatagtgctggtccatattttccccgaaatgagaagtagacttggaatccttttctatatccaggatcctagttcctgcattttttcctctggttcttattagcatttttcactttaaaaagtaaaaatacgtattacagttgccaagtttaaattattgggataaaatgccctaccacagaattaaaaccaaaataatgctcatgtgatgtcccttaaggtggtgagtgggttcaggaccctcagccacctgctcagcagggagaaggcagggagggaggggtccctactcgcacaggacagcgggggacaggccagggcataccattcgagtccatcacagaagtggctctggcagactctctttggaataagaatagaaataagttttgtatctgaagttggttaagtttctctgaaattcgcatcagtcaacacccaggtcacagcttcctttatcctctcttggagaggatcagggaaagggttgagagagccctgccttctcagagggyggccgagcgggctgccccatctgccatggaggcaggtacaggctcatggcgtggcgtccacagctcctaccatatccttcttgcttctctgcagagaatctggacgaggctagagaacagaaagaaaagagtcctccagaccagcctgcggtcccccacccgcctcccagcactcccatcaagctggaggaaggtgagctctgggtggcagcggccgccactgtgggagggtgcacggctcgtgcgcgctgtggcggaatgtggcgggagtcgtgttaacagcaacacggaagtgtgtgcttgcatcagcgccaggacgtgacacctttctcctcctatattgcttctgtcctgggtaactccaggcaaaacagatttgtatgtgagctgtgaccaggtaggaaggccggcctcgggggtcggaacccaccatggttgctggtgtccacgttgcccattgctcgcacactcctcgtgcygtgttgtcatgcagatgccaccttcggaggtgccctccgctgtgtgagccacacgccggctgcctctcagccaccgtgtgtctgtggtgtgtgatcccgggtgtctgtccctcggtctcgtacatccatgtctctcgtgaagcccgtggccctgcctttcttcttctgtaacctgatggctgtgactgaatgcatagattctctccttgtgcttttttctccctgtggctgcgtcacaagcaggagacggatgcgctagagagtacctgttaccctagtaagtaccgygctgcctccgctctccaccggtgccctgcgctttgcctcattctcctgcttctttgttgtttattaagttttgttttctgtttatttaaaataaaaacagaagccccccttttttgtacccagtcccttggaggccttcctggaagtggttcagtcacctgagtgctgtgctgccttcagcggcagcgggtacctccacgcacctaggtgccatggagcactctgggcctcaggagttcctacctccagcctttgagggtctctttggattgcttggtgggagggttttgccacactggatcagatgtaagtgcagcctcggttcagacagggtggggttctgccacctgccgtgtggggtcagattgccttggacctttgctgaagctggtccaaaggaggtgggcagaggagcggatattggaccctcgtaaagcagtgtgatgttcactcagatgatggcagctctccagagcgagtgccctggggcagcctccgtcctagcatcagccacaccatgcccagcagagcgggccccatctcctcagggggagcggcgcctgtgtgcccatagccctttcccggttctcatgaagcgtggcctggaatyagcctggggcagctggcagggtgggggtgcttccagcttcccaaaggtaaagcactgagagtttggggcctgggcctcctgtgctgctcctaaccactcagctgactcccctggccctgatgtgtggcttgatttttaaacactaaacagcttgtggtgcctaacctgtcagttgctggtaactttgtaggccgtttacgaatggacagagcgggtgcccgggtaagtgcaaggaaggcgcccccaggctgtgtcctcagggccgctgtgctccttcacagatggccactcctgatgctgggtggagtttttgcccccactccttgccttacaggccatctctttccttttaattaacttccagcctaaacggctttgttcttttggatgttgacgtcacacaacgtgctgtgggagttatgcacgattttctactggctgttttgggggagaccaggtgttgtagacccaaatttagacttaatttcagtactactagtacatgcccttagggtgacagggcagacttctcgtcacataatgaaagcgggacgtcgctcctttagtcgtcctcagcttgtgctgcagtctgtctttccggcggggggacccaggcctgggacggagtctggtgttgtcagcacactgcccaccagaaggagctaaaaactaccccgagactgagtctgtattttatgatattagctccatccagccgtacagtagagtagaccatattttaagtttcttgtcttggtaaaaatctgtagagtaaaataaaatggcagtttcgtgtgtggggctcccccatctcaagctgccctttgagatctgggcaggaacccttaatcccatctctcacctcacccactagaccttgtgccggagccgactactggagatgacagtgatgctgccacctttaagccaactctccccgatctgtcccctgatgaaccttcagaagcactcggcttcccaatgttagagaaggakgaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcasgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgacygacgatccctcgaccagaatcagattcaggagctcagtttctttttcacttgggtctctggattcctgtcataggraaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctygacatcrccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtrcaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaagcagttttatattttaatttctttgttcccatgtttgtctcgtgctgaaaagagacctcctaatgttcatgtcttgataaaatgtcacctgcagccacgcgtgcggcaggacgtgccacccagcactcctggtgtccctctccacgggaactcagggtgtccagggaactgctggcctgtccttgtccccatggtcccagtctcactgtcactgtgtgctcatgtttgatggggagggctctgtgctggggacatcctgccagggtgcggggcacactgccagataccacctggccagggctgaccccagccttggaggagcctgcctgagtgagtccccaggctgccactgtgcagagggggaaactgagggtctcaaagagccttggacccttccggtcagtggagccattcattcagctccagctgcctttcctggtgtgggtagaagcacggctatatatggcgaaaggcacttggtataaaacaaacaggtgctttatttcatcatcagaaacctggtgcatagtttaaaaaacaaacagaagccctgacagccttggagtgctgcagctcggagtcactgaaggagtaagtaagtctggaggagctgcctgagcttcctgcttaggggccggcccccacccacagggtctccctggactggcggggggtgggggtcaggcagtgggcaggggcctgacctaggctcccactctgcctggtgcccacagcctgggcacagtggctcagctactcagccttgagcgtctgtgcygggtaactcagcttctgcaggaggaagaaggggagcaaaaagagcccggaccacgtggtgaagcaggcctgggccccggccagccagtacactgcggagagacggtggcgtcacccagtccccgagggggctggcacttgggaggcgagggcaggtgcttggcccccagcctgccccagcaccatcccgcgccctyacctgaagcggccaccaggggccccgcggccctggccagagcacctaggctgcgcagtgtacccatgaccgtgcccttctgccctggtgagcctgtgggaagaggcacagtcaggcaccactgcccttctcccgctcaggtggcttcggccgagggaagggggctcaccatagccagcgaccacggaggacaggcagggcaccacaacggcggcggctggtgggagacatcgaggaggtgcccgtcagcccaggggagggtgcatcacccagcccctgctgcccatcggatcccctgccagggcagggccactcaccaaaggagtagagcagcagccccaggcccagcacgggcagagaacgtccccagccgatgaggaggaaggcgggcaccagcagcaggagggcctgcaggtgggcacggcagcctcagcacagcccgtgccctgcaggactcaggggactgcctgccacccgctttggaggragccccctacccgcttcacggcagcaacttccccgccagggtggatccgccgggcataggcaccctggatggtggccatggtgaggccgatgaggaaaaacatcttcccctgctgtaggctgggagygggtgtgttagtgcagggcacccggggcagggccacccagggcagggccagggcgagagtggctgccaaggcttcctggggatgggggttgcttccctgaagcaggggcgttatttcagggagacagcaggccgtcgccagatggggacccacctactgaactggaagcgctggtgtgtgaggaagctcagcgtgtactccaggcccgagaacaggaagaggtagaggaagtagactaggcccaggcggcgcaggctgctgagccctggggagaggtggcgcgtgctgagaaggcgaccacagcagggaagggcgccgcccggggaagcccaggggagagcaggctccacgcttgggttggtcgagtccttactgtctccagagggtgggtcctggccacgagcgacagccgagaagcgcagcagggccagggggctgagcagatcagccgcatcacggaaccccagggcgatagagggcgcctgtggggatggcattggagagcctgcaggagcggctgctggcctggcaacccacggactgtggcctcaagggtcccaacaccaagagagcggcccagcctccctggcatctggggctggcacacaggggcactttacatcgctatggaatcaagcctccagcccctaggcctgtgggtcccagacyacagccctacccgtttctccaggggcagcgtctctggcaggaagcagaagatgaacagcaggtcggaggctgcgaagagcagggcaaaccagggtgccatttccaggggcagggaggctccgagcatagggcccagggtgaagcccagtgagaaggccaccccaatgaccgcctagggaaaagaccacccgagctgcacagggagacccaggcccagaagtcaccaccaggaccccaaagacccagcctgtgcacttaccatgccttgactgcgggccagaggcgagcccaggtcagcaacgatggccgtggagaggctgacgttccctttgctgatgcccccaatcagcctggaggccaggaaggccgcaaagctccgagaggtggcccagactgcatatgaggtggccacacccatctgcccaggggcaggggccaagaggcaggggcggtcgcttaaggccaggagtggctcagagtagggcttggcaacccagacaacacccctcaaccctgccctatttcgaagcatctgagggccacttgcgttctcagtgccttcctaggggccaggagcagctccttgaaagcctggctctggaacaggagccactggtcccccgagaaccccctccaggatgcgatgagggccaaccagtggccatgaggggcccacagccacctccctctccccacctaaccccatggggctactggctgggtgggaggaggcttccccatgggcacccaggcccaggaacataccaggcacagcagcatcaccgggcgcctccccaagcagtcagaggtggccccagtgagtggcgcacacagaaactgcaggacagagaakgccgagccaatgagacctgagagacagatgtcaccatcatggggctgcctggcaccatgagctgtggtcttggggccctcaaggccaatgtccagccccgtcctgagggtccagtcatgctgggccctacactcacaggccatggcccttgagccgagggggccccaatggagagatgaggaaggatctgaacgtgacacgcggaggcaagggatcatgcccagaagccaggacatgtgggcaagggcaccagacatgccagcccagggagtgggaaggcaaggaccgagaattggggaggggcctgggctggaccacgtccaccaaacaaaggaccgtagagagcccgccaagggcacagagccagccatacctccgaacaggacactgttgtacctcttctccactggcatcccgatggcggtggcaaaccagtccaccccgccctgccaggagccatagagggggtcctaggggatgaggaatcacgataagggctggggaggtctgatgggcctggggggcagggggcactgtgggccgcagggcaaggactcacgtgggcacggccgtggctctccaacagcccgggcagcaggggcagcagcagcgtgaaggccaggaggtccagcaggaggccgagaaagacaacggtgaccacgcggcgctccggcggctgctggtggatgggtgggcgcggggtgcagcctccaccccctccccatcccatggtgggctgctctgacctggcctgggtggggtgcggcgggtcgggttagcggggaagccgagtcctccggggcctggcatacccccacacccgacagccggcgagcaccctaaaggggctgatggcaggggctctggcctacggacgcaggggccgttctggcctgcgcgatgcccccgccccgaacccaggcagcaggaaacgcaggcttcggggattgcacaaaaaatagccgcaaaggcaacggtcctgagagaccagggtgagcacatcgcggacctggccccaccccaccccacggccgcgcctcccacgccctcgtaacagcgagagaaaacttgaagccgcggggaacccggatcccgatcccgatcccgatcccgatcccaaccccaaccccagccccggcccgcgccccgcgattccggcccctggcccggactcggtctccctggcgggggccatggggtgcacaccggacgcaggagcacccccaaccccgcgcgcctcccactccgccatcccgcgtgcgtcccggtccccgcccccaccccgcgcgcccccggtcccgccccccaccctgcgcgtccccggtcccgtcccccaccctgcgcgccctctaacccccacgccgcgcgcctcccaccgcccccaccccgcgcgcccctggtccagccccacaccccgcgcgccccctactcccctaccctgcgcacctctcacccgccccacccccgcgtaccccgggtcccgtctcctcccccaccccgcgcgtcccctgtcccacccccaacccgagcgccccctacgccccccaccccgggcgcccccggtcccgccccgcacctgccgcggctgcgcgctcgggacggacggtcgcacagacgcggaacagggcaccaggcacgccgccaggggcgggacggccacgcccggccacgccacgccccggaagtgacgtacatctctgcacgttctcttccggccggaggcagtggcggggttctcgccggtcctgcgggtcgctgctcggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcgctggcgcagcctgtcccccatcgtctgcgccctgcgggcctggccctccccgtggaaggaccgcgggcttcggggccccacgctggggggctgactcctgccacacacacagcggtggccgcgggcctggggcggcagcacagccattctgctcgggctgcgtgagctgaccccgctctctgtgcacctacttttgctgcgtttggtgctgagcctgaagtcccaggacaggcggctgagggggaaagatggtgtgaattgggtgggcagagacaactgaaagccacaggacccggttggcacctttttggccgcctgcgcctttgcctgcagccccgctccctgggtcacccgaaggaggagctggcgctctttccgggcgcagaagcacccgacccacgctggaggaaacggtccctctgggcaggagaagctttgggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctctgcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcg

SEQ ID NO: 17682 - DNA, 15928 bp, Homo sapiens
gtaatagaatgggaggcaaatttggaagaaaaggttgtatacagcaagagagaaaaagaggttggttgttgtgtcagtggagaacagggaaacatattagggttagttatttaattctgatatagcagagaaagggggaggggggcttctgtatgtccttgagcagggaattgtatgatgaaaggaacatatgaaaggaaatattctgctggctatatgaagaagagactgaagaatgcagaagccagtttaagaagttacttaggcaattctggtagggttaattatggcagggacaaggatggtgactatgaaagtgaaacaaagtgttcaatctgacagatattgcaggaccatgtgaggagtggagagaggggaaacaacaagaaacataatacatattatcctaaatatgacagctggctttctaaatatccaaagaaaaatataagtctatgatactaactcctttaaaataatatatttaactatgtaattatcctacttaatttaaaaaataaagattctaacttttgaagacaaggcagtatgaattgatagccttttgacactaagaaaaatactgctatatgatattaatacggaagagcatagcattaagctaaattttctattattgatttatattagcatggagaacatgtatgatgttaaatcattaaaatttatgtgaaacctagcagacttcattgttctgatgtttatcttacttagtaaaagttatttccaaatgaaacttttatcttttgaaggtgggaagaaatgcttgatttttaactaagttaactttaagttgactcttaagataacaggaaagctttaggagcctaattaaaccatgtatttgctctaattactttcgctggagactgctaggaaacaaaagcagcaaacagacctgttctgtgtgcagcagtcaggcctttgatggttgttttctctagcagaggttttgagtagcacagaagtaaagaagctgagaagcaaagccatcatctacaaacagtggctgcagccacaaatcacagggcagccctcattcctgcatagtgtagaaagcatctttcattgtacatgatttatgtcccaacacagagaagcaatcgtcatcactaacatcattttttaatatcaagggtggcatcacatttttatcagcataattggacgttagctcatgaagcttttagaattaatacttagaagataatttatacgtgggacaagaataatagttttttgatactggttacttttcctcttaggttttattctcttgaataatgtcgtccatatttaatacaacagtttaatttttaaactaaataaatccacacttgaattacccatttygattttagtacaagttgagtttagaatattcatgatcatgtatgtaagaaaagaagcagatgaatttttgttatcactgacaagtcaattcaaacaattgctttcttaaaacaggactcacaggaaattccttttaaaagcacacatcattaaaggcatatttcttcattagttggaattggttttaaaggtattgtggctatttatccatttacattagtttatagccataaaatgccagttacaatgcttgtgttttttatcccttgagttgaattggcaaactaaaacaagaactatcttttaagtcttattatttattatctgttgttttaaaaatctgtatttcagaccctttgtgcagattccaaactttacagttgtaataactgaatatgcaaggcaactttagccttctgggataaactgtcctaaaataaaaacaaaaacgaaaaaaaataagagacaggaatctataaccaagagagggtagagcattaaagccaccactgagtgagttcaagccaaataaaaattctctacattttgcctaaaccatctagatatctgttttactttgcctatgagaatctgacctaaactaaatgactattctatatcattaagttgtccaggaaaatgaaaatttaaatgtatgtcagacaagctctagcatctggtacaattcagtaatgatggtctgctctacagagcttcagtgttgagacaactttaggactgagaaggtttggttgacctgtaggaagaaaataatgttctagtcagacattctcccagtttacaagtactcatgcttgccagattaggaaagatacaaagtaaaattcttctgtgaagcatctcactatagctctaattccacttygctgcagccaaataatataccctgggtacaaagtgatcagcactgttcatctttcactgtaatagtttagaaattattttcacacttctttttttaacacattgattaatgctagatatttccccttaaaatagaaaatgtctcataaagtattatttcagagtgataaataaaatttaactaatttagatgctctcttataatttgttgacaaaagaagaaacctatttctccttttaaaagagcatataagctgaaatatatgagatcttttaaaagaagtttaaaagtgaccatggtgacacttgtatcaacagctccctttcaaactgtgctacaaatcacatcatgcccaatttacatatctttcaaaatagaagaaaatcaagttaaatgtgatttttaaagtcaacagactggggaaaaaaaacttgcaacaaataccacaaagttttaatgtatttattacataaacaagttacacataagaagaaaatactaagaatacaatagacaacacaaaggacataggaaataatataatgtcagtgaatatatataaatgtttaatctcactagttaaaaaaaaaaagcacattgaaagaatagtggaggccaggtgcagtagctcaggcctgtaatcccagcactttgggaggctgaggcaggtggatcacaaggtcaggagttcgagactagcctggccaacatggtgaaaacccttctctactaaaaatacaaaaaatagctgggcatggtggcgggcacttgtaatcccagctacttgggaggctgaggcaggagaattgcttgaacccgggagaccgaggttgcagggagctgagatcacgtcactgcactccagcctcggtgacaggatgagactccatctcaaaaaaaaaaaaaaaaagaatagtggaataccgtttcacccatcttatctctaattttttaaaaataagaatgtccaatgctgacaatcagtctggtgacagggtaaactaatataatatttttgaaaaataatgtattaaatattcatatcttttagcctactaattccagtgctcagtttttacccaatgggaattttaaaaggctgtaggtagaagatattcattgacatgttatttataatactgaaaaaaatgaaaacaacctaaatgccccaaagcagatgattaattacattaatattcatcgattgtgttggataatatgttgtattttaaatgatatttatgctgatgcataataatatggggaaatattgtataatgttcagtgaaaagaacaggatgcaaaattatataaattgtaagcctactgctctatgtaaaaactatatgtacaggaaaaaggacatgaggatttaaaaatctccagtattttcccatttcatttaatattcattttgatattttcaatgtcatgttattactcaaagcactttcaaatatgttgccttatttgtcacatttctctttaaaaaaaaaaagaaaaaaaccttgtgcttggaaagacttataaaatatcctaatgactatcaaacaaaatcccaaatgagagcatttgttatcattttggttgtaagtgcagggaatcttgtatatatgtgactacgcagctgaaatatgtagcagtcacagtcagggatctctcagcatccacactcgttctgcctctagctcccttccgaaaccacggctgcttccagcacctgtgaatatattgcacttataaaccattggcagcagagggaatgttattgaatatttgtaatatctgggggacaacccaaaccaatttctttttctcttaaattatagcatcaaaaaggagccatttattcaaatacgtgtgttctgtttctaacagagcaaattcttaagagggcagaaatatggtttatttttatgatatacatattgcctagtttactgttggattttataaatagtaccctttgccatatcaaccctagagcaagggtgaactgacattccattctttcagagagaaatgctgtatttctctcctcctctccctccattcctctttgcaaacctggtcactcctttgataattcacgacccatctccaccattaagagtctaaaatcctagtcaagtaataactggggtggtgggggagagagggagagggagagggaaagggagaaggagagggagagagagagagagacttgaggaggttgcacttacactccggcagtttttccagaaatgagggaggcagtagttcttacttttgtgatgtcaacttgtagactgaaatgcatcaaagctcctcttcttcttcttgttgacgcgagggatgtgaaatgtgctctagaatatgcattcagcgtggtcctttgttctaggtatgagcttttctttttctaaagtttttcggtctcgctcaaggaaaggaaagcaatattttgagattcttttaaaggcaccttccaaagcatttcccacagaaaaataccttcacagcccaacactggttatttcagtaagaatcgagtccaattttttccaatatggctgtatacattgcaggcccccaaatttgtgctttcatagtcatcgttaatcaaataggcagaaacactgtatttagggaacctgtgtttcgtgggctagaagtgcattctgattaataaagatcatgttcattttgaatgcatcgctgttattcgtgtgcctcagagtcgcgggcttctgtcaggggtgcagcgggctcgggagtgcctgcagagcggtgggaagcagttctgagcgccctggtcgtcaacccgttttcagggggtgccgacactttctcccaagaagctcgatccgccgccttgtgcggctggaaagaatgaaccagactgtgacaggaacagagaatttatgtgattgacagggagtaccagggcacccgactccatcccgggtcaccacggctctgggatttgcacgagtttaccaccaccattaacagctatttgcgtaaggttgtttaccgcctgagagcgccacaagccgacagcgaagccactttgggaccccagccacgccccctctcccctctcccctctcacccctccctcccgccaaactaatgatttcggggctgccttcttgccggaccctcccattggctcctatcccaaccaatcagagccttgcaacagtttcacctggctcccgcttcccaaataaacaaacaaactgtcccgcgactgtgcccgctctgcaccctggcgccgcaggcaggcactgcttgcgctacgccccctcccaccacctcccaccaatggggccccgactgtggcgccctctcccgaccctgatagccggccgctttctcctccgcccctccaggccttctcccgccccctcatgccttcctggactccctgttagaatcagcttggccagagagcccgcctcctcctctcggtcctcccttggcccacaggcctggagattgaccgggaggatttggcacagccggaggtggctccgcctcccgagcccgccgtctcctcccttgctcacctctactggtggccgctcgcgcccctccattgcgccggtagcaggatccgcagcggccgccgcgtgaggctgtggtcacgtgttgttttgcccgctgtcgtgcgctcagagtggagtgggcgggggcgcgggccaaggcaggagggggctggggcgggcagacgagggtagacagcctcttcccccaaccctccctttcctgaattccccctcctcctcgctcaccttaaaaccatcgtgcatcaccatggcgagttgctccttcactcgcgaccaagcgacaagaagactaagaggtgcagcagcrgcrgcagcggcagctctagcagcagtggtgaccaccccgyttctttcctcgggaaccccgaccgcactcattgggaccgggtcgtcttgtccgggagccatgtggctctccacggccactggctcccggtcagactccgagtccgaagaggaggacctgcccgtcggggaggaagtctgcaaacgcggctacctgcggaaacagaagcatgggcacaggcgctacttcgtgctcaaactcgagactgctgacgccccagctcggctggaatactacgaaaatgccaggaagttccggcacagtgtccgcgccgcggcggctgcagcagcggcggccgcctctggcgccgcgatccccccgctcattccaccgcggcgcgtgatcaccctataccagtgcttttccgtgagccagcgagcagatgcaaggtaccgacacctcattgctcttttcacccaagacgaatacttcgcgatggtggccgagaacgagtcggagcaggaaagctggtacttgctgctcagccgcctcatcctcgagagcaagcgccgccgctgcggcacgctcggcgcgcagccggacggagagccggccgcgctggcggcggcagcggcggcggagccacccttctataaagatgtgtggcaggtaatagtcaaacccagggggctggggcacagaaaagagctgagcggcgtgttccggctgtgtctaaccgacgaggaggtcgtgtttgtgaggctgaacaccgaagtggccagcgtggtcgtccagctcctgagcatccgtcgctgtggacactcggagcagtatttcttcttggaagtaggcaggtccactgtcatcggtccgggagagctctggatgcaggtcgatgactgtgtggttgcccaaaacatgcatgagctgtttttggagaagatgagagccttgtgtgcagacgaatacagagcccgctgccgcagctacagcatcagcatcggcgcccacctgttaaccctgctgtccgctaggaggcacctgggcttggtgccgctcgagccgggaggctggctcagaaggtcccgctttgagcagttttgccacctcagggccatcggcgacggggaagacgagatgcttttcaccaggcgcttcgtaacacccagcgagcctgtggcccactccaggcgaggaagactgcacctgcccagagggcgcaggtcaaggagagcggtttcagtgccggccagcttttttcgccgcttagcacccagcccagcacgtccccggcaccctgcagaagccccgaacaatggagctcgcctgtcttctgaagtgtctggttctggctctggcaactttggggaggaaggcaatccccagggcaaagaagatcaggaaggaagcggaggtgactacatgcctatgaacaattggggctcaggaaatggccggggctcaggaggtggccagggctcaaawggccaaggctccagtagccatagctcgggaggaaaccagtgttcaggcgagggacagggatcccgaggtggtcagggctcaaatggccagggctcaggaggaaaccagtgctctagagatggccagggcaccgcaggtgggcacggttcaggtggtggccagagacctggaggtgggcatggctcaggtggtggccagggacctggagatggccatggctcaggtkgtggcaagaactctggggggggcaaaggctcaggaagtgggaaaggatccgatggtgatggtgaacgtggaaaatctctgaagaaaagatcctattttggcaaattaactcaaagcaagcaacagcaaatgccaccacctccaccacctcctcctccacccccaccagctggaggaactggtggaaaagggaagtctgggggaagattcagactttatttttgtgttgacagaggagccacgaaagaatgcaaagaagccaaagaagtgaaagatgcagagatcccagaaggtgcagctcgaggtccccacagagccagagcttttgatgaagatgaggatgacccatacgtgccaatgaggccaggggtggccacccctcttgtaagctccagtgattatatgccaatggctcctcaaaatgtctctgcttcaaaaaagcgccactctcgatccccttttgaagattcaagagggtacatgatgatgtttcccagagtgagcccaccacctgctccgagtcctccaaaagcacctgatactaataaagaggatgactcaaaggacaatgacagtgagagtgactacatgtttatggctcctggagccggtgcaattccaaaaaaccccagaaatcctcagggtggctcttcctccaaaagttggagctcctacttctctctaccaaacccttttcggagctcacctttgggacagaatgacaacagtgagtatgtgccaatgttacctggaaagttcctggggaggggcctagacaaagaagtctcctataactgggaccccaaagatgcagcttcaaagccttcaggtgagggatcattctcaaagcctggagatgggggatcaccttcaaagccttcagatsatgagcccccaamgaataaagctaagagacctaaccgactttcttttattacaaaaggatataaaatcaagccaaaaccacaaaagcccacacatgagcagagagaagctgacagctctagtgactacgtcaacatggacttcactaaaagagagagcaatacaccagctccctctactcaaggactaccagattcgtggggcataattgctgaacccagacagtcagccttttctaattatgtgaatgttgagtttggagtgccatttccaaatccagcaaacgacctctcagatcttttaagagctataccacgtgccaaccccttatctctggacagtgctaggtggccacttcctccccttcccctcagtgctacaggtagcaatgctattgaggaagagggtgactacattgaagtaattttcaactcagcaatgacaccagccatggctcttgctgacagtgccattcgctatgatgctgaaacaggtcsaatctatgtggtcgacccattttctgagtgctgtatggatatttctctctcccccagccgatgttctgaaccaccacctgtagctaggctgctgcaggaagaagagcaggagagaagacgcccacaaagccgttctcaaagtttctttgcagcagccagagccgctgtctctgcttttccaacagacagcctcgagagagacctttccccatcctcagccccggctgtcgcttcggctgcagagccgactttagccctcagccaagttgtagctgcggcctccgcgctcgccgcagccccgggcatcggcgcagcagccgcagctgctggatttgactccgcctctgcccgctggtttcaacctgttgctaatgctgctgatgccgaagcagtaaggggagcccaagacgttgccggtggctcgaaccctggagcccacaacccatctgcaaaccttgccagaggtgataaccaggctggcggggctgccgctgcagctgccgctccggaaccaccacctcgcagtcgccgggtgccaagacccccggagagagaagattctgacaacgacgacgacactcacgtgagaatggattttgccagacgtgataatcagttcgactctcccaaaagaggtcggtaattttagaattaatttccctaaagtgaatggtcattgtctaatgattcgatgcgctacagtctacagtgttagggatactatttcattaactggtgctattcgacatggagtatagaattcagttttaattattcacaaatgcctttttgatctttgcaaaaatttgtttttatctaatcaatttctttatctggacagaactgattatcatttaaacactggttctacttttttaggagtagttaaaacgcagacataaaaagcataaggatacttttaaacatccttccccatcatttaatgataatgtaaagcaggatatcgtaaattgggttccaccaactaattttcaaatcaacaattaaaagctgcttttctgcaaatgcccatatttaagtgtaggaatttaataagagcacagactattaagcagtaataatcaactatttatgtttagggaggataattttctcctctgaaagttactttttaaagagcagtcgttgttgtgctagtttgctgtgatttaccaagaaagttaaatctcaattgttaacgtgaatgtctggggggaacaaaacataaataatccaaaacaggaggtgattaaaagaagacagtatttggctctggaatgtgtttgtgtgttgattttctttttgtttttacacaggataaattccagaaaccttgagtgttccttttctctgtcactagtaatgacaggcaagtcacatttgctgtgcctcattttcttcttttaaccccccacccttctaaaagagggtgtggtgacaacttgagaatggatatgaatattatttcaaaggtttaaaaagcagttaaaacatttaattcatatatcttatgggaaatcaaggaaagcaagataaggctggaggaagacctgactccaggggcagcttaccctggaatggtggaagtttttaaagggctacttttccaaaggaagaagtaaggaagagtaggagctgtcagacttggaaacaagacttagagtaattctactgtgtacaacattgtggaatgttgtcatcagtgtgtcttgaaacattttcaagagatgattgcagaggatgatgtctccatagtctcaactaccttgcctcttaagtagaatatgcttctttcccagtgaagggaagggatggaccccagcagttttcattccagtagtcagtttagtgaagatttttgctttgcttgctttgtggaatgcttttgtgattggatctctgcccactgtgcttgatcaggcagaacaagtcgggcactgatcacaacagtcacctaacaagctccctatttaatgcaggtgtagcccccccacatcccctttttctccctgctatagaaaacttgccatacacaaactcacatttgcagcgtggacacattaaagagtgatcattaaaacaacaaaaggatgctttggcttgccaaaggattcaattcagacctcttttaaactgtgagttccctccccaacacacacacatacacacacacacaaacacacatgatcaccactgctaccataatcatacgtttaaaatatataatttcatttccaagtctttaatccataataagattttcaagagtagatctactttattctgtagaatatacctgaaaattgatctcaatctattgtttgagtctaactattgaagacaccatttataattttgatgtagatgatacacagttgcctgtgtccctgtagtactttcaaaaggaccagttttcatagaggtttattttaagaagtttaagatttaaatagtgaaatcttactgttccttgaataaattctgacttcccaaggaatacctagacacaatgatcattattttagcataaattcctgatttatgactttgtagctattttggagatttaacattctgtaaatgcattgtttattgaggaaattcctagctttattgagtgactttagcaaggaagctctatctcacagggaggcaggcgcttaggttgaaataagagaatcaacgtggaagcactttggaatgttaaagcactttacaaatgtaagatatttttagtgtcattggattaatactgaagtgaaatttcggcagtttaaactgattcagtttcttgcaaaataattgatcttgagggtgattcctgcacataatttgctgaaatacatgaaaggaatggtggggattgccggcgggggggtgcgggggtgggggtggtggtggtggtggtggtggtgttgatggtggtgaaacaacccattgtaggaaatgactttggttagcattttaatgtaaattgtatggtagaatgttgtctgtgaagtgttaagaacaagctgaatgattctgatccttttttattgtaaagctgtagaataattttcactcatttctgatctctattttcctatctaacattaaaacaaaaacaatcacgttaggaaacaaaaacataatgctttgacagaggaacaaataccatctttattagaagttatgtatttcaaaaagtcattttaattgatggcaggtgcttagaacagtgcctggcatatagtaagtactatacatgaattattttacagttattgccattgttattgttgctactgttattattacatttagaaaaacaaacctaaattaagattctccatctgaaaatctcacttttcagttagtctttacttgcatttaaaatactttacattattgttcagttggcatgtttatagattaccatttaagtgaagtgagattataaatctgtgagacagctgttctcatgtaacacaaaattaatatgtaattccatttacctacagtcacattgcgtataagtaagtacagtaaaggaatttactcaagtcgattagaaagaaacacccagaagtataaccttagacatgactgtattaataaatgaaataatttttaatcatttattaaagatgaagtcttcacattttaaacacataggttataggcattagcatttaggagaagaatgttgtttcttatgcagtttagtttgactgttaacctatgtatgactatttgcttctttttctaccttacctgatgtacaattcatagttcaaaatgacttgaggtgaacattttcctggtttttttattcaagagatgggaggatataaaagggcagctctaggaggggtgagagaatcggtcagccaaattagtaatgttatgatggcacttggtattaaaaagcaaaaaaaaaaaaactttagtaattaatttttcagtgttagacactgttatcaccatgaaggaatcatgcttcttttgagtgtactactgccaaacttgttgctatcagttataggcactaagagcacattgtttttattccattgaagttaattattataaaaatttccatatagcagaaatttcccagctaccattgacggatcatttattttaggtaatattcaacacctcaaaattggacagtgtttggactaatgaggtatttgtcctctaacaattaaagaggacttcacttaattaaagttaactaaagttgttcacaatcattattcatttgcattcattctattttaagagtgatgttttcagggtaaaaatttcaactactagcaaaatacttaccttaaacaaggaccagaactttaattaagcacaccagaatgtcacacatgtataaaaattcgaacgagatctcttactttctttttctctccctaatcccctgttttgggaacaaacttaggcttctcagagtgacaaaaaaataattcctgtgggaatagatgtggctgacgagtgtagggagaactaaggaatagtttatgtgatttaaaagggtctattgttaaattgtcaaattgttgattgaggaaatgctttccagttgcagattgccttatagtttgcaaagcacattcacattcattattttactgatggatggtaagtactggaaatgaagcccatgttgagaattttcccaagatcaaaaaggtaagtggcagagctgaaaatctaactcatacatctgatttcaagtccagcactccacccaacacatgacacctccctttaatcaggtgtttagtctgttattttcccactggtgacagattattacatggttaatgattaggaaaaaattacaagtttgctttcacttgatagtagcaaattttgttgtaagtaattcattcagagcattataactgtggactatcttccaggacctgggtaattttattacattgaactgtttgccctggctcttagaataaaagaatttgacttgtgctggaattgaatgttttaaatctgatatagggaggagttggttaatcttcactgcccaaacacaaatagtgtatgtatctatttagatcccacagaaacattgaaaggaaagaaagtgaattgagggtgcattcagtaaatttccattaatggtcatttctttaactgaagttagatttctttgattttcctaataattcattgacatttgggagttatagcaaaaagtcttttcatttaatttcttccttcattataaaatttggtattctgatctaaatcagcacagtaggcaaaacaggataaagtaagacaggtggaagaataagcagtgtagcaatagacgttcttcatttgtttaaaaagtgaacttgcttttggcagtcaggcaagtagattttagaagccttgaaaatcaaactctctccttgggacatagaaatccctgtttacaattaagttcattttgatttagcaccttttttaaggctttaagagtatataaaaatagcccagacgttttattggcagtattggaaaatagcttttgtaaaatgcttaattaaaactttcagtatattttctctaagaggtgctgccagactcttagatagtgaggatcatttactagaaaacgttgcttggtcttgaatgagaaatgagaaatttaagacactgctttttataataatgaaataaatacatcacaaagcactgagtttttgccacaatcattggattgctgattttaaagctattgataaaattgccaagaaaaatgtgcttgccatatgaacttaaaatatattctccagcaattctgcattgattattggtaatgtagctacaggtctcacatttccaccttattttggaaaaatagactcaacacttgagaaataggaatgtttaaagatgtttctagtgtaaattatatactgttttagatatgcatttttagagggtacctttcaacttctggctgaataattaatttcttttagaatggaaaacatgtacttaaatacttattaagtgaaatgagaaagttactgctattttctcttagcttcctgatacctctttcttattggttagggttgcattggttgtgttctgtgagtcttaccctcatgtgccctttgccaaacttgtgcccttgaattcaggcaaacatgccctttcctggtctctctctggctgaaaaggtgagggccactgtgggagtcctgcagggcccatagagggcttcgccagatgttgatcactcccagtacacagccttcttgcacttagcttgcagaggcaaccttccttgtagggatccttgttgtacagatccaaggctgtgctgcctgccctactgtcacttggcacagaagcagctgggccggtgtttaaagctattttcatggttggattgatcacaatatgtttgatgccagccacaccttctggatttaccgaatatctaattccctatatattgtagtcactttagctagttttgacaatttatataatttttctcctatgattaataatttcctacttatagacttgaaacttagaataacagtgaagtttccatctcacaattaatcttgaaaattgctcacatgtgtatccatggggcccttgaaagtctgaccagcaaatgtgattttttactcttgctttttaaagttttatgcctccagtcttgaaagcttaccaaccttgtcctcgcactcagagtcctgtg

SEQ ID NO: 17683 - DNA, 21254 bp, Homo sapiens
cccctagcaaccaccaatttgttttctgtctcttttggccaatatgatattcttttccttttccttttttttttgagaagggtctcactttgtcacccaggctggagtgcagtggcaccatctcagctcactgcagccttgacctcctgggctcaagtgtttctcccacctcagccccccaagtaactgggactactggtgtgcaccaccacgcccagctaatttttatatttgtattttttgaagagatggggtttcaccatgttgctcaggctggtctcgaactcctgagctcaagtgatccacccacctcagcctcccaaagtgctggaattacaggtgggagccaccatgcctggcctcttttccttttttcttttcttttcttttttgtttttttttttttttttttttttagatatggtctcactgtgttagcggggttggtcttaagctcctggccttgccgggcgcagtggctcacgcctgtaatcccaccactttgggaggctgaggcgggcagatcacgaggtcaggagttcgagaccagggtgaccaacatggtaaaaccccacctctactaaaaatacaaaagttagccaggcgtggtggtgtgctcctgtaatcccagctactcagggggctgaggcagaggaatagcttgatccctggaatcagaggttttagtgagccgagatcgcaccactgcactccagcctgggcgacagagctagactccgtctcacaaaaacaaaaacaaacaaaccaaaaaaaccaaaacaaaacaaaaaaactcctggcctcaagcaatcctccacctcagcctcccaaagtgctaagattacaggcatgagccaccgagcccagccaaccaatataatatatctttttaaattattattattattttttgagatggagtttcgcttatgttgcccaagctggagtgcaatggtgtggtctcggctcactgaaatctccgcctctcaagttcaagcgattctcttgcctcagcctccctagtagctgggattacaggcgcccgccaccacgcccagctaatttctttgtatttttagtagagacagggtttcaacatgttggccaggctggtctcaaactcctgacctcaggtgatccgtctgtcagcctcccaaagtgttgggattataggcatgagccactgcgcccggcctatttacaaaatttttttttttaaataatgttttaattttgtagagatggtgtctatgttgcccaggctggtcttgaactcctgggcccaagtgatcctctcttgcccttgcctcccaaagtgctaggattataggtgtgagccactgtgcctgcccaaccaatagaatattcttattatatatgatgcactctggtatttgccgttctgtgctattctgtttgaatttaaaaattggtcaagacccaccaaactgatttccccaccaaggcagtgacacacattagaatgacctggagaattttaaaagatactgatgcccaggcctcaccctagagattctgaagtggtttcaggactttttcttaattaaaagataaatagagatgaggtctcactatgttgcccaggctggtctcaaactcctggcctcaaacgatttctcccaccttggcctcccaaagtgctgggattaaagacgtgtgccaggctgggcatggtggctcacgcctgtgatcccagcactttggggggctgaggcaggcggatcacaaggtcaggagatgaagaccatcctggcttgatctgtagatcaagtgaaaccccgtctctactaaaaatacaaaaaaaaaaaaaaaaaaaaaattagccaggcgtggtggcaagtgcctgtagttccagctactcaggaggctgaggcaggagaatggcgtgaacgcaggaggcggagcttgcagtgagcctagatcgcgccactgcacttcagcccaggcaatagagcgaggctccatctccaaaaaaaaaaaaaaaaaaaaaagatgtgagccagccagttgcaggatttctggaagctcccaggtaatgctatatacaaccaaagtgagaaccactaacctaacgttgtctccccagcttggggaacagtgaaatgagacttagagccagggtgatccaggaacatagagggacacagaaagatacaaaggcaggttcattttatttatttatttatttatttatttatttatttatttaaattttttgagatggagtgtccctctgttgcccgggctggagtgcagtggtgtgatcttggctcactgcaacctccgcctcctgggttcaagtgattctcctgcctcagcctcccaagtagctgggactacaggcacctaccaccacgcctggctaatttttgtatttttagtagagacggggtttcaccattggccagggcggtctgaactcctgaccttgtgatctgcctgtctcggcctcccaaagtgctgggattacaggcgtgagccaccgtgcctggccgatttatttatttatttatttatttattttgagatggagtttcgctcttgttgcccaggttggagtgcaatagtgcaatgtcagctcaccgtaacttctgcctcctgggtttacaagattctcctgcctcagcctactgagtagctgggattacaggcatgtgccaccacacctggctaattttgtatttttagtggagatgaggtttctccatgttggtcaggctggtctggaactcccgacttcaggtgatctgcccgcctcggcctcccaaagtgctgggattacaggcatgagccaccgcgcccggcctatttatttttttgagacagtctcactctgttgcctaggctggagtgcagtggcacaatcttggctcactgcaatctccacctctcaggctcaagcgatgttcccacctcagccccccaggtagctgggactactggtgcatgccactacacctggctaatgtttgtatgtttttgtagagacggggtttcgtggtgttgcctaagctggtctcaaactcctgggctcaagcattcctcctgccttggcttcccacagtgctgggattacaggcgtgagccactgcgtccatccagattcatgatatttagatgttgaaatgtggctttacagactcagacagctctctgaggcaaacaaagagggagatgcaggtaccctcagcacaagccccaaattacctgcaggggagaggcggaaaatcagacaatgtagaaaccgggagaagaaaggtatggacagaccgatgcagataggaggggaaggaaatacctggaaatgagatagagaccggctggacagaccccggggaccctgcaggtcaccacacccttctctttcagctcacctgttctccaggaccagccctrctggggcccaggcccaggctytgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccataycccaagagctcccaaagcctgagaccagggtcatttgtccccaactccccatctggccctgctgttgctagtacctgttatttattacctggaggcctgtccagcacccaccctacccccataaagcattgtttacacctgtgtcttggcctccattattgtgagatggcagggagatggaagaggtccctgatggaagaatcatgtgtcatggtgtttgggggccttgtttctgttttttttttgttgttgttgagatggagtttccttcttgttgcccaggctggagtgcagtggcgtgatcttggctcaccacaacctccacctcccgggttcaagctattctcctgcctcagcctcccgagtagctgggattacaggcatgtgccaccacacttggctaattttgtatttttagtagagatggagtttctccatgttggtcaaggttggtctcgaactcccaacctcaggtgattcgcccgcgctggcctcccaaagtgctggaattacaggtgtgagccactgggcctggccttgggggccttgtttcctgattggacgtggtgtggggtataccaagcatgatgactcaggtgcctgttgcggagggagggaatttgttactgtgtggacagtttgtgacaatctgtgttctaagctcacgtgtgtaaacacgctgatgtccctgtgtttgtgacatgtgtacatgtttccagtacctgcatatgggatgatgtctataggatataatgtgtgctggttgtgtgtgatgctgacagccgtaactgctctgtggccttggtcattgtattggtgaggctggtattgtttgggacatcaaggccaggggatgggaatttggacctataggtgggcctccggtgtgtgcatgtctgatgcctgagagtcagaggcagtgactcactactgcgtgtgtgcctgtgcatgtgtaccccgaggtctgtgtgtgttttggtgtgaatttggctccttttaaacacccatgtgtggccaggcgtggtggctcatgcctgtaatcccagcacttcgggaggccaaggcagatggatcacttgagcccaggagttggagactatagcctgggcaacacagagagaccctatctacaaaaataaaaaacagaaaaagttagccaggtgtcgtggtacacacctgaagtcccagctattccggaggctgaggtgtgaggatcactttagttgggaggttgggcctgcagtgaactatgatcatgccacagcacttcagcctgggcaaaagggtaagaccccatctcaaaaacaaaactaaactagaaacacccttgtgtggccatgaaccctgtgtgtgccctgaggactgcgggcttttgtgcaatcctcacgcatgtgtggataccagtatgcatgcccttgtgctcacgcgaaccgccctacgccctcaggtggcctgcaggggactggtgcagccccgaggacactcccagttgctcgtcgccctcccatctccacgtcggccttcaccgacccggcgggagccttgagtcccagctctccagagcaatggtggagcgggcagggcattcaaaatgaccttatctccttagtctcctaaagtgttcccagctggccatgcaaatgtcttctctgtgtagcgttccgtggatttttttttgtttcattttttaattttgtgtaaagataaggtctcactccgttgcccagactttccctggttctttattctgattcccacaatcgtcccgagggggcaggccggagcgggtcttgaaaatacacatttgcacatcccttctagtccgcgttcccttttctcaagggcaacccgcacttttttgcctccgttataaaagatacttatgtaaattactgacgtgcgaatttacatacatttctcaactaactgcgtagccatttctccgtctctcacctccgttcctggacggcgagaaggaggaggagctgaccatgtaaatgaagtcacgcgcaccgcgctgccgaactcggtgccccgcgctgggcggggggcgggtaggcctgtccatgtaaatcacatcatttgcgtgccccgccccgccgacgccacttgattccaacatgcaagaaacgccccctcccagacccggcccctcacactgcgttccccctcccgcgcaaagggggcggggcggaggatgcaaatgaacctcgtgtaggccacggaccgctgtttcctttctccttggtaggggggttgtcccgaacttcctcgccccgctccgccccgccccgcgcggctcgggcctgcgcaggcgccgtcccctccgcggggcgcggtcacgtgcccaccgggcgaggcggggcggggcgtcgcgcgcggtgggggcggggtatggcgcgctgtgcggcgcagggcggctggcacaaacggcggcgccggggccggaggaaaaagctcggtgaggaggtcgcggggcgagaagggagcgggaggagactaagccggagccggggcgccggcgcgaaccgggcggggtgtgggggcgcgcgccggggcctgccggggcgaccccgggaagggggatgtgggtgcggcgcgggggaggggacgcgcgccggttacgttgggtgccggccgttgtgggggttggggtgggggcggggagcgcgcgccgggcggaggccgagtggagggggaggggagggggtccgagcggcccttaggccctgcccctgtcgcctactgcgctcagaaggggcctcagggcctgccccgggttgggggcgttggggtgccctggatgggggcacctttatctctcgtcctgtctccgggtgcgtgcaccctcctccgtcctttcctctgtcgccgcggaccctctccccgagggcccctcccgtcggtcagtctcgggacctcccttccgtctgggcgtgtgtccgcccccggccggcttcctcccgtcgggctcgggtcgaccccaccgtcccgctccgccccgggtcctccctcccagcttccctccggtctatttttctgtctctgggcccctcgttctctttgtttttggactccccagtttcctctgtcttttgacccccccgcccccaccctgactctccctggaacccccacgtttctcgttgtctttctggaacgccgaggcaggtccctcctattttccaaaccccctcctttcccactcctccacaccacccttttctactccagccctccttcttctgtctttggttaccgcgtcccacaacctgcaccacagtcctctgtcttagggtcatctacccagcccctggcctccagcctctccctatcactgcctcttatctgtcagcggactcccgcacctccagattctcagggtcctctccccgacttggcctcaggttttggggggcctctatagtcaagtctgtcctggtcgtcttccccactcctgcccataccatcccggctttcccctgcctgcctgtctctagtttctctcacatccctttttttttttcytttctctagccaccctgaagggtcccttcccaagcccttagggaccgcagaggacttggggaccagcaagcaacccccagggcacgagaagagctcttgctgtctgccctgcctcaccctgccccacrccaggcccggtggcccccagctgyatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggygcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccrccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaaygggcgcaccaaggtaaggctaggtgggggcctctttggaggggctttgcagcaccctggtttgcagcattcagtgctctgagcacagtgggtttggagacaggcttctgggaggtcacagaaggtttaggcagttcagtggagtgggtatgcttacttgtggggacttgggggggtctttatcctccctacgggccttaatgtgtgcacctgataagctaggagtttgtcctggagccacagtggttcttttttttttttttttttttttcttttctttttttattgatcattcttgggtgtttctcgcagagggggatttggcagggtcacaggacaatagtggagggaaggtcagcagataaacaagtgaacagaggtctctggttttcctaggcagaggaccctgcggccttctgcgtgtttgtgtccctgggtacttgagattagggagtggtgatgactcttaaygagcatgctgccttcaagcatcgccacagtggttcttgactttgccaggaaccctcttaaactcatgagagctgctgacattcacagcgtggaccttggtggggttcatggcctcctggtgtcagtctgtggccccagaccaagcacggggatgtagataggcacacagttcacctggccgttctctgttgctgtctgtccctgtccacatccttccctgtgctcctgtcgtccatccctgtttgctggcccatgtttctagtccatccatcctgtctccaaggcaggagaagcagaagggggagggtggctgtgatgagtgagccctggsstgagggaaggaaaggggtgctgcccgctgggccgagtgcttggccctggactgcattgtgccctgggtccccactgtggcatctgcatcgaggacagtctcctgggggtggtactgggtggctgcctgttggcccaggtggagctcatccccatgtctcccacccttcactgtcccagtccctgccctccattccccctgtcctgtgtgtcacttcctccctacccatgtctgtctcttcctctgcctttatgtgtttgttcttagtccctttttctttttgctttagaacaatagttcttaatggtattttggagcctgggtctttttgagaatctgtcagaggccacagatcctctcttaagacaaatgctcatttgcttggagtttccgggcagttgtcaaggcctcatggcctccagctgcctgttcaggaacctggggtcaggagcccagcacaggacagtggtccatagggcctttccgggctgctgacaggatcattgtcttcatgggtggtgtgggggcctggccttgagtccaaggcttggtgtcctttggacaaggccctgtggggagtgcccactgctcaacacagtgatgcctggctggctgatggcaygggcagtgttgtgccctgcaggcgtgaggctgagctcctgatgtcctctgcctcctcctgcagatcccatcttgggttctgcttctgtgtggctttcctctcaggctggagctggctcagggaccagggctcccccggggccaaggcctgtttcctccccaccccagctggaacttgttctacttccctctccctcccgttacttgatagctgagccagagccggcccctccctgggcttggctcctgtgcgggcgggatcagtggcctccctggctcagcatcttcaccccaggttggctgtcgtcctcgtcagggggagaccagaagggctgagtggcccagatgggacactgctctgagcctcaatttgctgatccacggaatacgaaaaccaggttacatccccagtgagtctggcagtttggggaggggagagtaggagaagatctcttgtgttttggtgcctctggtgcccacyttctatgtggttggggacagggccccagcgaggattggggaaggggcgtgtttggacttttttagccctaggtgaccttgattgtcctagggaagtaaggacaggccaggctggactgagaacataggggaggagccctcccctccccagtgagacagcaactccaggctttcccgcttttagatgggccccatctggactctctcctgtactccagagtaaggctgtggggtgctcaggtgggctgcagcagttgccgtggggacatggatcaccagtgtggctagagccagtagaaacgtgcttcttagtcgttctgagtggagctcctgtgtcatccttccttcccccaactccctggttggggacaggtgctccgttgacctgtaggtgggagagagttgactcccactggcagcaagggctaccagaggggaccccagggagagtccagcttgcttggtttgctccttgaagagcagcttggaggtgggacagtcacaggcttctgactggggtgtgtgtgtagtgggggtggggctcttggcaggcagattgtcaccaatagcctttaagtctttggtctcctggccctggtcccacctgtccctcccctaggtgggaggggtggagagcaagtttcctgaggccttcccctgtgagggcaggaagtagatactttccttggggccagaggatgctttcacccccaaggtgtgtatatgtgggggaagggtggggccctaaagagcaggttcctgtttctgtgtgagtcccatgtgcttggtgggaggcgctgtgtgagaatgtacagggcaggaggaaacatagcagggctggggtgcagaggaggcccagagcagtgcactccagtctgcaggtactgcactgggcactggggagaccaacctggccccaggggcttccctgtggctgccttccagggcagtactaggtaaacaggtgcctgtgctgatgccatgttgctaggagtggaacggacaatcagccggagtactcaaggtgacccttggtctctgaatcctgaataacaaagagggtcagaaggaagagtgtcccaggccagtgctgaggccttgtggtggcgatgagctcagcctgttgaggcatggagcagagtgatgggagaggcacatgaggttgggggcctttgaggctgtggttgggaatttgtattttctcaggatggagtgaagacctggagaggaggggctctggctgctgtgtggggatgaattgtgggaagagggtgcagcactggaccccttccctgccacccatccacgtgcatcatcagtgtaatctctgattggattcctaattggggaggtcttgcccrtctctagtcagtaactcactgtttctaagcctcctggrccatggcccaattcttctcccagtgaggtggttgctcagagtgccgacccttccatagggagtgagcagtgcaaagaaggtgccccctcctgaaccttgaagtgtagccattagggttttccctggggggccttctcactaattgtactctggtgctgccagagagaaggttgtcagcttcccactgctaggtggcagtagatggtggcagccctctctttccagggcaaggtctggtggatgaggtgcacatggttaatgcagagcagcttaacatccaccacagagggtgagccctgggataatgtgttgggaggcgtcctggggagggtgaggattgaagcagcccagtctgctgtggcgtgcgtgcttggcaagcatcctgttgtggcagtggccactgatgtttgatcgtgaatgtttatcttgggactgtcttgctgggccgggcccataggtgtagctgagcattcgtggggaatggacgccagcagagttgtaccagggcagagaggtcagggcagagaggtcaagacagatggtccgggctggggagaagttgaagggtccttgtgccagtcctcccctttttgtgtgctacctcatcttgccactgcagtgactttgggcagagggtgggacagggaccttttaaaatttttaaatggcatttcagcctgtgctccagttctccatgtggcaggcactgtgctggctgtcttcccagacacttgttatcttgttcacttgttccacaacaacctgtgaaatagctgtgagctccattggatccatggatgaggaacctgagaccaggaagtcacctgcctgatgccacagctcatgtggcagcactgagacttgaaccagggaattgtgtctgcagaagtggctgggccatttcctttacctctcagccacctttctgccagctccctgatgacaaacatcccggggccctggccacagcattgtagggctgggtcaggggagtggcaactgtcaggcagaggaaagaaccctgtagacagagaaaccaagccctgcaatgagtcctgttagatctccaggagttggggctccagaacctcccaagttatgttctcagagagattaattgctaccgctgtaaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggarctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctygggtacgtaaggcacgttgacaatccccacggcgatgggcgctgcatcacctgtatctattacctgaatcagaactgggacgttaaggtaggggtgagggtgagggtgagggtggcgctggggctagggctggggcgggggtggcgtgcgtccactccattttccactctcagcccagattctggcattctcctgtttctcttctcaacacacagcgggcagtgcgatctgccggctcttcctgggaaatggcacctcctcctctctagcggactgtgtggtgggaactcccctctttccgggaatggtgctgtctgcccagccccacccggccttgtaatgaacactttcccccttttcctgtctttagtagcttcctgcccatctccatggtgatgcagtctctgggttgtcattcactttgagagcccgaggggtgggagggagtgatgcaggcagacgctgcgcctcctagtgggctcccggggcaccgtgggaggcagcggctcctggccgtaccagctagcctcatcctttggcctgcccccaggtgcatggcggcctgctgcagatcttccctgagggccggcccgtggtagccaacatcgagccactctttgaccggttgctcattttctggtctgaccggcggaacccccacgaggtgaagccagcctatgccaccaggtatgacctgtacttctggagamgcacccaggtgctccccctgtgacaatgtcctgtcagagcctcagagtgactagggagcgacgaagtattgagagggggcctaggtgggagcagaaccgggtggctcaaaaggatggccgcctagtgtgtgtggatatggtagctggaattgcagaaaactaatgtccaaccaccctggtctccaggtaygccatcactgtctggtattttgatgccaaggagcgggcagcagcyaaagacaagtatcagctaggtacctgcttccctcccttcagtccttcctattctgtgggccctcttgggcctgatgccaccccatccccctcatcagcctcttgttaaatcccaccactcatttttcttcatctctgcccaccttccttagcccactctcctggtaccccaacaggagccccatttcttcctggtcctctccccatctccccaggtttcccttggcttctttgtccttctgatgactcactgtctcctgtcccctctcacccccagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctggrggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcmtggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcacacatctgactccatctgcaatttagggcctttattgaccgaggagggtatggaggtttgagggccagtgagcccaccatagtggagcctgacctcagcaggccactggctggagctggaagtctggggggacactgcccaggccagtgcactgcaggtgaggttgatggtgccagggcgtaccacagggagcaggcagaacctctgtaaggtggccrtaaggaataggaagatacccgagtgggccaggcctgtgcccaggcacatctgctttgccgggtacacaggtgcacagtgagcaccaggtaccccagagccagtccaggctggtccccttcctcctctgcctgcacctgaggcaaagggcatgaaagcatcattgccctggaacttgcccttgtccaggaagttggtagggttgaagcagtctgggtctttgaattgagtggggtcccggtgtgcagtcacaagcaggggaatcacaaaagtgccctggggatacatgcaacttgggttacctgcgggcttggtgagcacctgcaccacctccatccaagacgctttttaaaagcccaagggaataggccgggcaagtagctcacgcctgtaatcccagcactctgggaggctgaggacagatcacttgaggtcagaagttcgagaccagcctggccaacatggcgaaacctgtctctactaaaaatacaaaaattagccaggcgtggtggtgggtgcctgtaataccaggtactcaggaggctgaggcaggacaatcgcttgaacccaggaagtggaggttgcagtgagccaagatcatgccactgcattctagcctgaatgacagagccagactccgtctcaaacaacaacaacaaaaagcctaagggaaggcagagctgccttcctgctccaggggtaactgattgtgttttggtctgcacagcgcamacctgctgattctggctgatctcatgcacccgggtcccgcacgggatccccagactcagtgggtacctttgggcagacagtggctgtgcaggtgggtgtcgagggtgagggtgcgcggcagccccaggggcaccacgctgatgaagcactggatctcgagcagcactgcgttggcgtagggcaggcacacgcgatagtccaggcttggggcgggcctccaccctaccacagggtccagctcctgcaccttggctcaggccgggggaggctgtgagctgcgcacttccaggaccctccagccatccccagactgcagcctcccattctgggtctctccgggttgcacacctgccacctctaggtacttaagcagaatgaggagcccrtagcacagggtggtgctcgtggtttcggtgacgccaaaaaaaaaatgcgtcgtcattaccgacgtctactcctggaaatggctstccgggtcctgctgttactgtgggcagaggagatgtgctgccgcgtgccaggcacctgttggtgggcggcatggatagagtttagagagctgggacccatgccttacccatctggtcaagcaatcaatgaaatcgcggggctccgctggctgccgcatctgccagtgtcgttgaatttgctcagagatgacccgcagctccgaaaagtttcggaagattcggtgrtgcgggcccgggagccagtccatgagggacaggcaaatgtacatctggagagacagggtctgtctcaacatgggccctgcacaaggccactaggccttagtttccctacagggagattggactaggactttgatactggatgttctagaactcttccaggaatctgtcccattctaatgatccattgtaggtaggtctgtgtactcgggatttggcataaggctggacgcaccaaggaaagattgtggccggccctctcacctcgccccatctggaactaatgatgcagaagttgtcactgaagaggttcaggagcctcaggaactccgggtccccatagcgatagcggttcccgaagacaagaacagrtaacaytggatacagcattayccagtagccgcacggggtcaaayggggcycctgggggtaggaacaggacggtggtcataacgcgtggtcctgcccccagccagccccatgggcttactggctttcttccacccaaataccttccagtggccccgtcttggcagtgcaagggactctcccacaccaggcccttccgctctcccggccaggccgaagcaatggtggcttgaaattcgtctagcagacaagccgcctcctccaggacgcgcgcctcgacggtccgcgtayccaacccgaacttcttaagcgctccaagtgcaaaattgcgcagtgtccaccagcacggccggttagaaaacaagattcctgtggtggggacgggaaaggaggcgggccggggagccggccacgccctatccaggaagcgccgggtcactggctacatccctttaggggcctccgactcctgcggccggcttcgttccctttgcttctttaccagacctccaagtgccctatccacacattggccccgcctttgctgggctccatccctgacctaggctggctctcgggctttgactcttaggctcttttctcctgttggctgcaggatgaacctccattctaaccttacgctttagcgccgccccgccctctctcggccgtttgcacctcattagctggagtctctattaggccccgcccccatttgcccgcctctaccatttacccgcccagcctggagcgtccgggccggcaagtccagcgccggggcctcactgtttccgcgtgtgaagcgttcgaagactgccatggacccgcggccagagaccgcatccgcctgtagcactaacgcgtcccgcagcgctgcgtagccgcacagccccaccgcagggcgcgggcccagccgcactgtgaacacccggccccagcggccggagagctacgggtagccggtgctcagcgggtgcccatagggttcctcatcggagccattgcccccagctccctcttccttcagacccaggagtcctcgtctcagaccctcattcctcaggcccaggaattcaaatccccagctccttcctccctgagatccaggagtccaggcccccacttccttcttcccttaggacctggaagtccagcttcccagcctcctgcaccctcagagtcgtctcctgggccctcagtactcagcctgcccaccctgaaccagaacagaccccctgctcccctcttcccacaacctgatttcctgctctgggctccttcgttacgacccagtgtcccggccccaggctctccactccctattctcctttcctagtactcagcagtccggagcactcatccttcctgtccttcctcaggatcatagagtacaaaccctcagctgtcttcattcaggaggagttctagtccccagccccaccttcacgaatccagaattccgttcccccattcctgtcgggaatggagtgcgcggtccaggcctccggactgcagctgcaagttccccagcaatgggagcggcctgggccggggaggtagggacccccgcatctgagcgcggcacccaccctacccccaccacgccggcgccagcaccagaagccacaacagcagcgcagcgatacccgcgacatgcctgcaattctccacgcctgcaccccttcacctctatttgatttccaaggggtcttaggggtggagcggggcggagacccgatgtgggaggagtgggcgtctccgggctgctcattccgtggattccccaacccgacgtctccaccccgcccccagccctagtggagctgtgccctggctccccctggctttttttgtgtgtctgcctcagcctgtcttacttagcaactttcgtgcaccagcattttcatggcaacacacctggacaacaggtgcaccctcctgagcccctagcacctttgagtccaatttacttggcctgtaagtgtgtattcctcaatctccgggccacctctgggtcccctgaacgctgtaccctgtacctctgattcctaaatacacaccgactctcaaatacaccacttctgttttttttttttcccttcttagagtttcactcttgttgcccaggctggagtgcagcagtgggatctcggctcactgcaacctccacctcccaggttcaagattctcctgtttcagcctcctgagtagctgggattacaggcatgcaccactaggcctggctaatttttgtatttttagtagagacggagtttcaccgtgttggccaggcagatctcaagctactgacctcaggtgatccgcctgcctcggcctcccgaggtgttgagactacaggccactgcgcctggctcaaatacacttctaaagacacccctggcattcctgtsctctgtgcctgtgattcctaggagctcacacctgagcccttgtcacttccattactcttaggaccctgtgtactatgcttgttccccagatctgccttcaatttccctggcttctgggtgtccatcagtctggcacttctgtgcctctccttagttcttcagggtgcctttctgcatgttgatccccttgtacctccatattatgtcctgccctgaatctaccatctctatccccaaggcactggctcccagatgcccccaaatgttctgtgcccatgctgctgaaccccctggtatccagtcccccaagtccctgtctgaggccaggccatgacgacagacaaacttatccctcattctctcatctatcccccccaacccccatcctagggcatgggctagagggggcagactctggcctggatgggccagggctgcggtggtgggagcagtgaggttggggctgtatttggaacagactgttcaggaatgtggtccaccctcctgcctgtccctgcttggccaaatccagccttcctccaagtgcctggcacagggcccagacctggggagatggtgggcggggggtggactgtgcagagcctaggactggcattgtctctgggagggtctctgtgtatctttgtttcatctctcagtcttgcttgctccctccctccctccctctgtccgtccctccctccctccctccctccctccctccctccctccctcccttccttttttcttttttttttttgagacagagcctggcttctgtcccccaggctggagtgcagtggtacgatcatggctcactgcagcctcaacctcctgggatcaaacaagcctcccaccttggcctcccaagtagctgggaccataggtacacaccaccacgtccggccaatttttgtattttttaaggagacaggatgtcactgtgttgcccaggctggtctccaactcctgggctcaagcaatctttctgccttggtctcccaaactgctgggagtatagttgtgaaccagcgcgcccagcctccctcactctcagtctctgtgtttctgtgttcatctctctctctcctctttctgtctcttcccatctctctctcttttctctcagtctctgcctctgtttgtgtctgttttctgtctctcttttcagtatgtctgtgtcttcccctccctgtatctcccctagtctgtgcttccctttgtctcagcctggcacttctgtgcctctccttatttcttcagcgtgcctttccgcatgtttacccccttgtacctccatattctgtcctcccctatcctgggtcttcctacctgtcagcctttctggaacctggtgactgacaggggttgtggggcaggacccctgctcagagctgctgactccactgacagcgggagtgtggtggggcacagtaagctgcatcctcccccagccctaccccaccctctgtgacaggctttaatggatcctgtttattatggcttctggtttctccccagctcctgactcttcctccgttttgctcgggtgggctgtcctctggaatgtcagctcttcta

SEQ ID NO: 17684 - DNA, 54775 bp, Homo sapiens
tgagtgagttctcacgagatctgatggttttataaggggctctttccccttcgctcctcactcgtctctctcctgctgccatgtaaagcaggtctttgcttctccttaaccttatgccatgattgcaagtttcctgaggcctcccccagccatgtggaactgtaaatcaattaaacctctttcctttatagattacccagtctcgggtatttcttcacagcagtgtgaaaacagactaatacacaagagaatacactgatttcaaagattcttctttttttttttttttttaggtggagtctggctctgtcacctaggctggagtgcaatggcacaatctcggctcactgcaacctccgtctcctgggttcaagcgattctcctgcttcaatgtcccgagtagctgggattacaggtgcaggccaccatgcctggctaatttttgtatttttagcagagatgggttttcaccatgttggccaggctggtcttgaactcctgacctcaggttatccacacccgcctcggccttccaaagtgctggaattacaggcacgaggcaccatgcctggcccaaagagcaatctccaagcaattttatgtagccaatgtagatttagtgcaattagagtagaatgaataacctagattataaactaaagatccaagttctcgccttacctctgctcttgtcatgaaaacaaaacaaaacaaaacaaaacttcttagcctgtctagaccccagtttctctataagatgagaatattagtcacgatttggtttctaagatcctgtctatgtttgagactacagatacctgttgctacatttcccttcatagctctgaacaaggagaattcagcccaattctcatggccttctacacaatccagagtttcagtgccatatgtactacatttagtgtcaaattaagtcaaaggcttcattagcctgaaagctctgtccctggcctgggcatggcaaactgtatcccccactgaccatccccctgtctcccttctccccagagactccagtagcctggcgtcatcacaggggccagacatatccaacatgttcccagcttcctgccactgcactttcagtgtgcctccctcttcagttacccaaatcctgcccaccattccagagccagttcaatctcacccatccaggacccccgagacccccatcgtaccactatagtctaactgtggtgtagaccccacactgggcacattgcgtacgctcattattggctgtgacgtctgattatgcccttctcctggtctggaagctctcggaggtgctccataatacatgaagagaagtagtgctggtgtgggaatagtgaggtgtgtttatccatccagctatccggcaccagcactggtctcagctttctgaggtaacacgttctgagccttagtcttgagagaacataaagaaaactttttttaaaagtagtaaaaagtggctgacaaaagctgaccaaaagcctttcaaaagaaatgctaagttatatctaagaaagtttacccaaggtcaggcaaatatgaaacctaaagctagacgtggggaagaacttccggagagttgcaattccctgtgccccagcatccccaggagggcatgcccacatctgatttagaaatctgtgtaaaatgagtgaaggtttctatttcttgggcagtgtgggcacaggtctttggagaggtcgatggcctcccataaaatccttcctgcttgatggttctggatcctcagccacagctcctaatagccatgaggtttgagcccaaaataatttatgtgtttgttttttcagccccaaaatttccatagaatcaaagtagtcagagctgaatggggctaagagaccgtccattcctgtcttctcatcacacagatgagggactgccacccagagccgtagaaactgtcccatggccccagttcccagacccttcctctctcctacagctccaagttcactgtgcattctaaatgaagatgtaaacataagcagcaacactcaagagtaaaaatgaagtgtgcatatgaaagaaacctattcacatggaccatattacattataatcacagtgtttactgcttgactaccatctgcctggcctagcaagggtgtcagtgaggaagagaggacaaggggtaccaatctgtgaactacacatggttcttgctctcccagcttctctctcccattggcaaggcaacaggtaaacacatgaaaaatcaaataatgctataagagaaaaatgtattcaggacaacaacaggtttgtatgaaggcctttcatcatcgttgtcctacctagaaactgaatgacagggaatcagagtcacaagctatgaagtctaactgggctggtcccagagaaagattcagtgcagtaggtggggctgcagccagccctgggtgggtggaaggatgacatccacataggcaagagggtgataattcacttacgcagctcctcactgcacattgaaccctgctgacttctggcttctctcccgggaggaactgcgactcaacattctgaccttatctcttgggtagcagaatgatggagaaggaaagtttctttttgcttctcgcaggggttaatcatccatctggaatgcctacatttggttgacaatggctcaccctatcatcttcctcctgaaccattcacctaaatgtgccatttctttcctgatagttctcatttgtgtgtgtgtgtgtgtgtgtgtgtgtgcacgtgctcacacatgcatgctgtcactgggtaaacaggccaccctgggcacagttccatctacaatgtttgaagtttactttccagcttctgggcatcatttgcaattataatgctgtcayaggcagaaacgagataggctaattaatcgttgtcaatactgatccctatttgccagatgagattttggagcagcatggctgggaataattggtatagactgtatttccttgctttatgtcactggaaatatttatttaagcatcacggtcgctatgcataaatatcctggaaaatggggtatagctgaatggtgcagattcattcattcatattcagcaaattatgttctaagcacctacttcagtaygtgaacagcactaaactcagaatattggtctgctggggtcctttattagcttccatgattccctgaacttggccaagacccttctggtcggctgcagataggcacaatggatagttttgcttctagataatgtaactgggacattcagcattatctatcgccttgaaattcctctagtcaggtggctttctaatgggtacccagagccctatgactacccagattgatggtgcacccaacaggactttgcatttatgagctgataagtcacagtcactagctgagattaatctgtgtgacaccagaatgtgtctctatctaaaggaaaagggatgaagggtgatatctttggtcacaagtaatgtatttccatgtagtctttgacaaaggatctaagtggattttgtaattgaagaaaaatctatgcactaatctttacagcatttccgtgagtgtacgcaagtcagctcaacaattcaacatttgctctgtggggttgtgctagaccctgtcaggggataactactgctggctggggcccagttcagggaagacttgccaaagaccttcaggaaaagagggaagctgagtcttaggtttcttcctttagagatggtgacagtcctctcaccacctccaagcatctcacaatgtttccctgcctccaagtcatcaaattcatttttgattcctacttcataaaaattacattctcccagcactttgggaggccaaggcgggcagatcatgaggtcaggagttcaagaccagcctgatcaacatggtgaaacaccgtctctactaaaaatacaaaaattagctgggcatagtggcactcacctgttatctcagttacttgggaggctaaggcaggagaatcgcttaaacccgggaggcagaggttgcagtgagccgagattgtaccactacactccagcctgggtgacagagggagactccatctcaaataaataaattaaaaaaaaaaatatatatatatatgtatatattctctatggatgctgaccattggaccctggtttcatctgcacgtaacagagtaagcttggacttgtgcttgtaaattaaagctcgacacctccttttggcttctctatacctgaatattcttactcactctccttaatgtgaatatgcatggaagcaggaccatttcctcaaacactagcagcagcgaaccctgtggaaagtcagtccacatagaataattcaaataaagtgttcagagaaatggggtttcagagcaattactttttccagacctttcacaaatcagtggtgtaggtatgaccagccttgagttgagacctctgtaatatccatctttaataacattaatatgctgtggatgagcaactgatcactggagggagtttagctgcccataggagttcatggctaatgacaatatctgaataaggacaggtgtggagcccaggtgcaggaagcaggcgaaggtctttctgtgagtctcctctgagggaactgggtctttatacatagttactgtttcagaattgatccttctggaatcatcagtcttcaccagtagcttgttacatctgggggtatctcataattcaaacaaagctgacaagttgtaacaatgagcacacactgacttctgcaacaggcgctgtccacttcccatccgcactctaccggcttgctcctggccgcctcccactcgccttcctgggtggtcccccagcagttatacctacctggttgtcgccccctctatcctaccacaattgctcactagcggtttcctgcgtacacagcttgtctccctaaccagagtggaggtgccttggggacacagccaggctcagacattcactcagctcatcatagtgccatcccatcaataaccccttctgagtgatcctgggttagtaaaccgagtgtccctgaaattccactaccgctgattccctacagctgggcagaggcagcgagcgctggctgaagyttccggtgggaaatgggcagtgcctagaagagaaggaaacgatgcatgagaaggttccagatgtctatgaggaacatgacgtgtcctgtccactactctgcttttcctcgtccgcctccccaccactggaggaaacctagaagctggtgcaggaaatcctcctctcaacaacccaagaacactttgcacaagaggggtgcgccctcggaggttgctcttccccagaggcctctcctcgctggggtttcttgaagacagatacttggactcctgctgggaccaggcaggccacccatcctcaggggcagtgactggtcactcaccagacctccctgcatcccccttctctctcctcccccagcacgggctgaaccccgcagccacagattctgatcaggattagggtgtgggtgcaaatccaaggtccaccaaaatggaaaagaagtaaccgatgggaacacgtctccaccaagacagcgctcaggactggttctcctcgtggctcccaattcagtccaggagaagcagagattttgtccccatggtgggtcatctgaagaaggcacccctggtcagggcaggcttctcagaccctgaggcgctggccatggccccactgagacacaggaagggccgcgccagagcactgaagacgcttggggaagggaacccacctgggacccagcccctggtggctgcggctgcatcccaggtgggccccctccccgaggctcttcaaggctcaaagagaagccagtgtagaaaagcaaacaggtcaggcccgggaggcgccctttggaccttttgcaatcctggcgctcttgcagcctgggcttcctataaatggggtgcgggcgccggccgcgcattcccaccgggasctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccggtgagtgcgcggccgctctgcgggcgcagagggagcgggagggagccggcggcacgaggttggccggggcagcctgggcctaggccagagggagggcagccacagggtccagggcgagtggggggattggaccagctggcggcccctgcaggctcaggatggggggcgcgggatggaggggctgaggagggggtctccggagcctgcctccctcctgaaaggtgaaacctgtgccggtggtccccctgtcgggccctagcacccgctgggaagacgtgggaagctcacagatttctttctcctgtcttacagaagaggaaatgctggaaaatgtcagcctggtctgtccaagtaaggcatctgcgcatggggcgtggaagggcgcccagccccgtgcactctcctacacccgggtccctgagggcctcccactctacagggctgagatggcatcgtggtgtgccttgctctgaccccaggaagcaagttccctgagcctctgcccacacccaagggatgccaactctcttctacctggccttctgttctgtcccaaaagttcagcctgggggcgggggagggaagggattgtctctccgctggcctgtgcacactttgaagaaacatcactgtcctgtttatcagtgactagtcattgattcgaagcatgtgagggtgaggaaatactgactttaacctttgtgaagaaatcgaacctccacccccttcctatttacctgacccctgggggttaaaggaactggcctccaagcgcgaccctgtgtgctggagccgcggggcggacttctgatggggcagcaccgccatctagtggccgtctgtcatcactgcagctggactcaggacccagatgttctttttcttcaattgttcagaaaattcctctcaactacagtggaaacctccagaaattcttttctaggagtttgttaagttagttacgcttaatgcttaatgaactttgccttaagtatttggtagtcttagagtcacggaattacggcgtgttcaagctaaaaaagcattagagatagtactatttgcgtaatgttgtcatctcttaatttgccagagggtctctcatgcagattttctgagccccattacttgacacttgtcactcccttccctgtgcctcagatgagatattcaagacatgccagccaatttaaacattagcctcagcaaaaacataatggagaagtcaaatctataaaggaaaattaagtataaagtcaattaaaaaataatttgagttgaattaccatttttaattctctatgccactgcccctctctgcccagaattggctgtccttgggagagctatttctgctatgtggctgacgtatttctccccacgttagaagatgcgacccgattcaagcacctccggaagtacacatacaactatgaggctgagagttccagtggagtccctgggactgctgattcaagaagtgccaccaggatcaactgcaaggtatggaggatgcaggcaggagggacctagagcccacagctttcccccagccctgttccagcgggcgcccaacacgcgaccttcccggaggktgtgtactgagcaaacgcagaacatcccagaactgttgtaatctgatcaaagcactgggactttgcctctgtttgtaagtcagccacattgctgagatgtggtctgcccccaccaaatttcgcaagtcagaagtattttcccgttaacttcccagatgcaataggaatccatgatctagattagcagcagtgtgggtctgtagatttcagcgtgagagaggcccagtaggtgagctatgggaggcaggcaactcggaatcgcactgtgaaatgcagtttttataatttaagtcaaacagaatctgttgctgaaaaatgaatggaaagaagaaaaaaatataaacatacagtttgttctaaaataaaactttgcttattattgagactggttgtactcatgttacatacatgtggagcagatctacaggctgctattggggtttgggtggggaagagaagtcaagctgagcagtcacctttttttagagagtaccgtagctcttgtatgtgctgtccaatatggtagacatgagccacattgggctatttaaatggaatgaaattaaaaattcatattcgttgtcacattagctgcatttcaactgctcaacagccaccctggctactggctcccatattgaacagcacacatgtacaacatttctataaagttatttgaatagtgctggataataagtaggaatccgttgaaactccagctatatgcaaagctctaaataggccctaatagatataaccagttttttgggtgacattaaggagacatttgctgtggaaacgaaggatggccctcttcctgctttctgtttttcttcttcactttcactcctagtctgcagcgcttctatttaaccacagctctttataattaaagtgagtaactttagaaccaataaaaggacatcctccttcccatgcctaggggcaaacttaagaaatgtgttacccgggagggggaaaacgtcagcaataggactaagtctaggttggtgcacagagaacccaggaggcatgttgataaggcatgtggtgttgaggcgcaggcagtggtgttcccagcaccattccctttggtgctctgattagagattaagccctgggcttcaggggccacctctcattcttgatagacaacctcaatgctctgctaccctgaattctcaggttgagctggaggttccccagctctgcagcttcatcctgaagaccagccagtgcaycctgaaagaggtgtatggcttcaaccctgagggcaaagccttgctgaagaaaaccaagaactctgaggagtttgctgcagccatgtccaggtaagtcatgttgtacatgagcacacrcatgtgtgtgtgtccgctgaggtatgaayttgtgtgtttgcaccaggcacggatgtgactgtaagtatttgtattccgtatccatcgtggatcagggaattactgagttttcacaatcatcaaaaagagagaagcattagttamcyttccctagttaggttcctttaattatcattttcatgtgtttctaaaaatctcatgctttaaacttcttgagattataaaactgagatgctttgtttaaacaagtgaattcttatttaaagaactagtcaagactagtgcttggtggtctttggtgtggggtcccagaggcactggctgctgtggccggcacatggcggggcagggtctgttcaccgcagggcagaggagcaccaaggcttcggtggctccccctcctaggctggcattcagccactgcacgctgatcggccactgcagctgcatctctgctgactggtcagggcccatgtcgcacccattgtaaatattttcaacatcacccctgcctcatcctcaatcacagtttgtagggtcctaggtgtgtatgaatacaggcaggatagagttgttaacttggtagcatcagaaaactctgtctgtattagtctgttttcatgctgctgataaagacatacctgagactgggcaatttacaaaagaaaggtttattggactcacagttccacgtggctggggaggtctcacaatcatggcggaaggtgagggacagcaagtcacatcttatgtagatggtggctggcaaagagagcttgtgcagagaaactcmtgtttttagaaccatcagatctcccgacacccatctgcaatcacgagaacagcacgggaaagacctgcccccatgattcaatcacctccccccgggtccctcccacaacacgtgggaattatgagagctacgagacgaaatttgggtggggacgcagagccaaaccatatcaccatccttgcccatttttcagttttgctaaacattagattcagatgccagtcctttcttgccaaaataggctgtgaggcttctttctttcctatgctttattttctccaagacttaactgtatatgagggagaggggtatggtggcaggaggaaagagtggtttattttttggtccttggtcttctccaaatacagaagagactcctgttcttgaaaaggagggctttccatgtttgcatcttcatgactttaactgtcttttttaaaaattgacatacaataattatacatatttattgagaacatagtgatattttgatacatgtaatgtatggtgatcagatcagagtaattagcatacccatcatctcaaacatttatcatttcttygtgttgggaactttctgagagagtgtaggctgtgggagataagtccgtcaccttttcctcctgatgtaaccagagtggctgcagccaggtcctcagaaactcagagagtacccagtgggaaatccctaagaccaaagtcagcatgggcttcagccatggcctgacaccatacaaaagaatgactgtccaacaagtgtatgaaaataagctccaattcactggtagtcaagaaatgcgaattaatgtaacaacaagatatttatctgcttttacccatcatactgcaaaactggaaaacagtgatagcacctgttgctggcaggccagtgaggaaaagtgtgctgtcctgagctgctggtggaaacgagagccatcaggcaatatctactgtaatttaaaatacttaataccctttgacacagatattttagtctttgggactctagcccatgaaaataaaagcagtaatgtgtgaagataggcacataaggatgtttgttttggtattgtttgtgtggtttaaaaaaaatccagaaagagagagggcaaatgccatcaaatggggcaatgtgtgaataaattatatttagccatggaatggaatgttctgcatgcagcttttaaaaaaatctgttagagctgtaccaagtgactcagaaggatttttgtgaagtataattaagtgagaaaaacaagataaaagtatgcataatacaatgccacttgtataaaacaaacaatggcaaaatctttgtatgactctgtttgcactcacccatgtttacagaggattgtatgagtgtgcagaaacaaatggaacaaccactcgggtgtccgtatggggaggatgggcaaagagactgatatgggtggagaacagagcagggctggatgagccaagcaaaaaaagttaaaacacrgctggacctggtggctcatgcctgtagtcccagcactttgggaggccgaggagggagaatcacctgaggtcaggagtttgagaccagcctggccaacatggtgaaaactgtctctactaaaaatacaaaaattagctgggtgtgatggcacatgccagtagtcctagctactccggaggctgaggcaggagaatcacttgatcccaggaggtggaggttgcagtragctgaggttgcgccattgcactccagcccgggcgaccgagcgagactccatttcaaaaaaagaaaaagaaaaaagaaaaaaagaaaaaaaaagaatcaccaaaacttatgtatatgtgcatacttttttgaaaatgtatgtctatgtgtagctatattctatatttacaaataaatgatgtcagaagaacaattggttaaaaaaatatgagaaaagaaacttcagtgccacccagcttacttccagcaagttgtaatggagaaggacatttccgtgaccatcctctctctgggacaggtatgagctcaagctggccattccagaagggaagcaggttttcctttacycggagaaagatgaacctacttacatcctgaacatcaagaggggcatcatttctgccctcctggttcccccagagacagaagaagccaagcaagtgttgtttctggtgaggatttagaaagctgatagcagtggcccttgaaactcatcttcatgtgttagagaccagtcctaccatatacaaagcagatcactgagtcagctccatgactagttacataggaagccctggattggcgtgaaatactggtgcccgaggttcctcctgccccttaggctcactgacagatcatcccaagcaggcttatcaggttgggtctaattttaaaacagtyattgaggagtcctggccaccccacccctgcttttgtttgatgcttcacctgtgtttgctgggttatggtgtaacacagtaaatcctgtgtgtattttaaacaccaaaaataatgggatctgttgctggtctcttttacgaatttcaggtttcactgtgagacagaattcatttcacctcagtcccatgagcacttttgtgtgttctaatttctctacgacacyataatgggagaagacaccgatgcaacctgcggaggcctttctgcagacccacctttaactggttttctctctcccaacttgggctggccaggcactagcaagaccacactctgcataggaagaaaaagaaagtccctcccaaagctagattccttctgctttttctttcacgatccccaccccatccctcccaagtacccaaggatgttgcccgtgttgaatacatgtggttgcatcttcttyctccataggataccgtgtatggaaactgctccactcactttaccgtcaagacgaggaagggcaatgtggcaacagawatatccactgaaagagacctggggcagtgtgatcgcttcaagcccatccgcacaggcatcagcccacttgctctcatcaaaggcatggtaagtcccatgtcagcactgtcgtgcacagcaaggagcatcctcttattaatacaattccagaacttttgagctagtgggcacctttgaggacagcctgccctggctgttttttatacagactagagataggaccctgagcaggcacgggaaggtctgcccaggcttcacggcctgggatcagttgagccaaggcttgagtcaggctcctccctcccagcccagagctctgtctttcctcctgtccttctgtcactggcaccaaactgcctctaatctcatcacttgagagtaatgactactcacctctgagaaggttccggggatggatgtagggcagcaaaaccaccttctgttctyttctgcacaaggactccttgtgccagctccaagcctctggcctttgaagragtcccaagacctgtgttctccccctctccctcatcccatgaagtggagtgacttagagtgctccagcttcttgtccttccacccccagtaccaccctgaccaaacatggccccactgccaccggcctggagcaccctctcctctctgttaactggggccatggagcaccatattacctgagcctgcctgacccctgcaacatcttccctgatatgagccccagcctgtctcagtgaacatgaataacttgggcaatcactgtcatgctgggcgctgttcctggtcattgtccttagggttgaaaacagggagtctgatgaccatgagtgccacagtcagaagaggataatgcactggcttaggggtcttttctgagcatctgctgtttgctcaaccccactctgggcagcaccaaggaagggacagtggcagatgaaccatggaccttcccctcaggatgcttccagtctaatgcaggagccaggtcaataaagtatacgtggtatactcaataaggtgataagctgaacagtgcagacaagaagtcctgggcctgaccaggaaggagaaagaattattcatgtagctcagcgggcaacatttcatggaagatgtggagcaggaacccaaaaaatgcaaagaatatgtaaatgaaagagacatgtaagaatgggcttttgggcaaagaaaagttactgagcaggtgtgtgaggggctatgtggtgggatgggcatgtggaggatacaaagtttagacattgtccagtgagggtggaaaaagaggagtctacagcttgactcagctttggggatgccgacttgttgcaccccctggtctaaatgtcaagtacccagttatcttctttctctgagtttatctagtggtacaggactcctgctcccttctaccttgaaggtaaatgcttttaacagaagatacagggactgatcaaaatgctygtctccaatctctttcatagacccgccccttgtcaactctgatcagcagcagccagtcctgtcagtacacactggacrctaagaggaagcatgtggcagaagccatctgcaaggagcaacacctcttcctgcctttctcctacaagtaggtcatgtgatgcacccctgatttgtcatttaatgggtcagtgtgaactgaacacttctcaagtgctctgttccaggcaaacctgtgcctgggagggaggaatggagagggataaaatgccgcccctccctgtccccctttttaagcgaacaggccatttggcagaaaagtcctaggcatgcaaaacaatccaagaccaacaaaagatatctaagacccattctttaagggctgtagatccagaaaacctgaggatcactgcagggtaccctggttagaaaaggtttcatggaagatttgggatactgactggaaacttgtgtatccaaatccactttgaaaactgataatcaatgaatatatattgagtaactgccatattcttggctctatgttgtggaagatacgaaagaattttgagacattgcactagttcctacctctggccactccagactagtggagagtataaggcacgcatgtctttttgatgggaggataactagcgtgaccaggaagaggtggatgttattcattcagggccaacaatggctggatttacccatgctttgaaagatgggcaggacttgggtagatgcagagacagggaaaaccttcaacatggaaagaatagtatgttctggccatccgtgacatggtgtgcttccttggttaccaggaataagtatgggatggtagcacaagtgacacagactttgaaacttgaagacacaccaaagatcaacagccgcttctttggtgaaggtaagagtttstgtccacatagttgctggaaaatctactcaagatgtgcctatcatggcttagccacttgctgagccctgttaaatgtctgctgactaacaagtgatacagacactggtgttctggctacctctagtgagaaagcaaactcatttcatgatgtcaagttgcaatggcataaaggaaaagaagttcccaaagctacttaggcatttgtaaatagaaaactggaatcctaagtttaacatgacatatttgatagaactgacatcacccatcctgtgataagatccagagctgtcccagacgaggtggaccaagtgggagagaaccttcagagtctggccagatagtaacctcaggagtcagtctttagaggtagaaggaactctaacaatctcaagtccaacccttacccagtattgtattgtatttatatctgtccaaattccttcttgtacattacctcattgtcctttttgctcatagcaacctgtgatgtcaggtggtagagatgtgattttatacctattctacagaggagacagtgacacagagaggcttagagtttgatgtagtcaaggccgcagaatattagaggggggaaaataagtgccaggttgtaatctaagccaggactattctcattacaccacatttccatgatgacttttacctctcttcctggcataggtcacagtaggtggtggagaggatacaaaagtgtctcccctccccacaagctgctggtagacccaattagaagaaatggtgataagcacccatgtgcctggtcccagttgtaaccatgtcaacagtagcacctcctcaccaattatttcaagctaagggtaacctgatgatagactcagacaagtctggattccactttagctctacctcttagaccctgagagctcttgggaaacctaagttgctcatctctgggtcacacttcctcatctctgggtctcatctctttgtctcatctctgggactcagagctgagatccagggatgagcaatttacatggcccaaaaactctgtgggtctcagaagcagggctgaatttatcattaaattgaacaataatgccaccccacagggataggatgatgagtcagtgaaaacaagtcaatcacctatggcagagccagatctagcaggcattgaatacaggatagtttctttcccttttcccctgtgctgatactccacaatttccagcttccagtagacaaagatatggttgagatgaagaaagctagagttcctttgacactttccatcttccaggtamtaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccaggtatctaatggttacagytcaactttttataaaactgatggtaactgactgaactttcaaaccttggccaaatggagaatctcagggaccatttggatatcaatccagttaatcaattagtcaatcagttcatgattgctggatagagaactatcagctgctgcgctgagttccatgaaacacacacgcgcatactgtgttcaaggcagctatgtatttgtgtgttaaaacagaaggagaatagttcccacattttgatgggtaacttttaattcctaggtctattgcaggtgctctccagaagcttataggctggtggagagagaactcagacgaaaaatataatatgatttctctacccttcaaggcactggctttaagtgctatgaaggtgagagaagggactgaggccaggaatgagacccagctaatgttggccaggcatattctgtgtgctggccaaaggactgtgataacagtcttcttgttgctacagatccacagtcccctcttggaacttttctcgattgggcttcttctgtgggtaatattcctaaggaaagcatcatggttctgagctccaagttgggttttgaaagatggttagatttgaatagtgaatgaggtgattaagggctctcctggcagaggacacaccatgagcaatattttatgtgccctgaaggtggtctgtataactttatccatgtctttcttctcagccccatcactttacaagccttggttcagtgtggacagcctcagtgctccactcacatcctccagtggctgaaacgtgtgcatgccaacmcccttctgatagatgtggtcacctacctggtggccctgatccccgagccctcagcacagcagctgcgagagatcttcaacatggcgagggatcagcgcagccragccaccttgtatgcgctgagccacgcggtcaacaagtgagtttccacactgtatttctcctcctaggagcagaggaacatcttgcacctctgtgmatctctgtattaaaactgaacccctccttccactttcaaactctgctccttactcttgtgttttttcttgatcatttttggggtaatgacttgaaataagaaatcagcaaacacaaattgaatttttaaaaatattttctctacattatattataaaagtttttgaacatagcaaagttgacagaatttcacagggaaaacccctagaaaaccagctatctcctactatttaagtgttattatatttgctttatcacatatacatccatccattaattcatcttattttctgaagcatttcaaagtaaattgcaaacatcaacacactttcccctaagtattacagcttgcatattattaacttcagttcaatattagttagcagttttttcctctgaatttttttgtttgtttgttttgtttttttttgttgttgttgtttttttgagatggtctcactgtgtcacccaggctggagtgcagtgatgcagtcacggctcactgaagcctcaaattcctgggctgaagtgatcctcccacctcagcctcctgagtagctgggaccacaggtgcatgctaccatgccctggctaatttttgtattcttggtagatacagggtttcaccatgttgctcaggctagcaggtttttcctttgatgaaattttttggctttttcttttttacatttttatataaatttatgtggaacaagtgtaattttgttacatgaatagattgtgcagtagttaagtcagggctttcagggtatccatcacccagacaacatatagtgtacccactaagtaatttctcaccatccatctccctccacttccacaccttctgagtctcaattgtctatcattccacacactatgtccttgtgtgcacattatttcactcccacttataaatgacaacacgcaatatttgtctttctgtgactgtcctgtttcacttaagacaatgacctccagttccatccatgttgctgcaaatgacatgattttattctttttatggccgaatagtattttattgcctatacatttcacatttttaatccaatcgtccattgatagacacttaggttgattccatgtctttgctattgtgaatagtgctgtgataaacatatgggtgcaggtttcctttggatataatgatttcttttcctttaggtatatacccagtaatgggattgttggatttattggtagttctatttttagttctttgagaaatctctgtattgttttccatagtggttgtacttatttacaatcccatcaacagtgattaactgtttccttttctctgtatcctcaccaacaactgttattttttgtcttttgaataatggccctcctgactcttgtaagatgttatctcattgtggttttaatttacatttctctaatgattagtaatgttatgcattttttcatatgcctattgccatttgtatgtcttcttttgaaaaaaatgtctattcatgtcctttgcctactttttaatgggattatttgggggatttttttgttgagttgtttgaattgcttgtacattccggatattagtaccccattggatgaatagtttgcaaatattttctcccattctgcaggttaccaccctgttgattatttgttttactgtgcagaaactttttactttaattaagttctatttgtctattttttgtttttgttgtctttgcctttgaggtcttattcacgaattctttgtctaggccaatgtccagagaagttttccctaggttttcttcttgcatttttatagtctcaggtcttatatttaagtctttgatccatcttgagttgatttttttatatggtgacagataggagtccagttttattcttctgcatatggcaatccatctttcccagcaccacttaytgaaaagggtgtcctttccctagtgtatgtttttgtcaattttgtcaaagatccgttgactgtaagtatgtgactttatttctgggttcagtattctgttccattgatctatgtgtctatttttatgccagtaccatgctgtttagattactatagccttgttgtataatctgaagtcaggtaatgtgatgcctccagctatgttctttttgcttaaaattgcttcagctattcaggctctttttggattccatatgaattttataattattttttctaattcacaagtttgggttttaagacaaacctaactggggttaccaagtcctgactctcttctcttattctgtagctatcataagacaaaccctacagggacccaggagctgctggacattgctaattacctgatggaacagattcaagatgactgcactggggatgaagattacacctatttgattctgcgggtaatctcagtcttttatatgacatacatcatttcagaagcacttttcctggacaccttttacttccctctcctgcaccctgatgggttcttgtttcttttcttcaatgcaggtcattggaaatatgggccaaaccatggagcagttaactccagaactcaagtcttcaatcctsaaatgtgtccaaagtacaaagccatcactgatgatccagaaagctgccatccaggctctgcggaaaatggagcctaaagacaaggtaaagtccacaagaagaggtctgaaagtgaaagtttattaacaaggatttggaaggtactaggggaatgagactctagatttcatctactgactttattctgctgtttctttcctttccttccttccttccttccttccttcctccctccctccctttcttctttccttccttccttccttctttcgagatggaatctcactctattgcccaggctggagtgcagtggcatgatctcggctcactgcaacttctgcctcctgggttcaagcaattctctctgcctcagcctcctgagtaactgggattacaggcatgtgccattacacccagctaatttttgtattttttagtagagatggagttttgccatgttggccaggctggtcttgagctcctgacctcaggtgatccgcctgcctcagccttgcaaagtgctgggattacaggcgtgagccactgcacctggcctctactgttttctaattgcaaatttcaacaagcctattgacttgactgcctagcagtatgtgacgtgagagaaatacttgactttgctgctatgtcaacatgcagaacgtgagatgtttttgcttcctaccgtccacctaccagattgaccatccctctcatcatggaaaaacatgcttaattttcccccaataagcttaggctaggatagccaacttggccccctcttaggtgcaaagactccagaactttggaaactaccctatttattagccccaaactcttactaccccttctcatctttatcctcacattaaaataacttacgttaaaacaacttgattttcacttagtggtggatctccaaacaaatcacaacttggccataatttatgtgttttaatggaattgaattcaacaggcattccacaggctttttctgggaacccttacttgatagtgctstaggaaacactggcaagaagattcaataccagcatttgaagaacgaytacagagaaattagacctgtgcttaagaaagagctagcagacaatgccagtgtttgccaggcatgttctgtgttctgaccacaggacagtgataaccatctcctcttttgactgcaggaccaggaggttcttcttcagactttccttgatgatgcttctcygggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagagtaagtaagagctattcaccccatataccactgagggccctgagctggaattccaaccctaggttttggcatagccactgtctgcccttgcttctgaaacaaacacttgtgcaaatgtgtagcagatctagacccaaagacttagggtcaatgaaatcmagacattttggtagtgattggaaatccatatttacttggggtgcaagagtcaaaggataataacatggtgtgtcagctcaaaatatacttcttcttatctagtctgaaaaagttagtgaaagaagytctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgaggtaagtgtgaagagtttgaggttctctagcccattttgtacagcatcataaacagagagtccctgggagccaggagctacccagaggaaaactaagaaccaccaggcacttcctaccatgattctgaggctttcttctttccctccttccccgccttcctctctccccgctaggggtcacctgaagcatgacttcttaacattaatagaaatgcaggcctggcgaggtggctcactcctgtaatcccagcactttgggaggccgaggcgggtggatcatgaggtcaggatatcgacaccatcctggctaacacggtgaaagcccatctctactaaaaatacaaaaaattagccgggcgtggtggcaggcacctgtagtcccagctacttgggaggatgaggcaggagaatggcgtgaacccaggaggctgagcttgcagtgagccgagagattgcgccactgcgctccagcctgggygacagagcaagactccatctcaaaaaaaaaaaaaaaaaaaaaaattgaaatgcaaatgtctcgtctttaagtcccaaagccaaggaagcatatgtgctgcctagtcagatctgcttcaaatctcaaatcactcccaactctgaatcctttgttgaattatttgtcctatctgaaccttagctgcctcttctagaaaaaagcaagtaataaggtcaagattctagtgagattttaataaagcagctcctgtgaaatgctaaggtcagctcctggcctgtggtattcaaayacttgtttagataaatggacatcaagagtggggactactaggctggcatacaacaaagaaacctgatgccattttcttgtctgattttctttctcagattggcttggaaggaaaaggctttgagccaacattggaagctctttttgggaagcaaggatttttcccagacagtgtcaacaaagctttgtactgggttaatggtcaagttcctgatggtrtctctaagrtcttagtggaccactttggctatamcaaagatgataaacatgagcaggtgtgtatttgtgaagtatcttcttaaggaaagctttgggtctcaatgcaaaaacaattcttttctaagcatggaagtcctcaaaatactatctaactgaagggataactatggtttttatcaaccagacctgctggggtaagggccagtatcctctgcagttaaagatctcctgaattcagtgtgcccagaaaccagactcacaataagtactctaggataacaagagtatgaactctgggctgggtgtggtggttcatgcctgtaatcccagcactttgggaggccaaggtgggcagatcacaaggtcaggaatttgagaccagcctggccaacatactgaaaccccgtctctactaaaaatacaaaaaaactagctgggcatggtagtgggtgcctgtaatcctagctactcgggaggctgagacaggagaattgcttgaacccgggaggtggaggttgcagtgagccgagatcacgccgttacactccagcccgggtgacagtgtgagactgtatcttaaaaaaaaaaaaagtatgaactctgggcatagatttaattctaacttccctgtcttgaagctgtgcgcacttggggaagttggttgatattatgtgtatctgtttctgtctgtatcccagactactaataacagtccaaacctcacaaggttatttaaagacaatgaaataaggcatctaaaatgccaagcacagtgcctgatgctggcattggttgttcaataagcagacactattacgagttctaaattaatattttcattattattaactgctgtctttggctctcactcccatcagtgcactagcaaatgagaccaaacttccactttgaagctagcaatgagcccccatttaaggagggaaataggttgtatgatctggagcttattcttgaattttttgctacccaaagtgtggtctggtcagaaatacagcttctcatgcttcacccacaatctactgaatcagaagcgcattttagcaagacctcatgtgacttgtatgcacattcaactttgcagagcaaggcagtaatttacccctccaggctcactgttgagcacgagctccatcttctaatttcctgacccccacttgaggccgaggatctttgatctgctttgagtctgtcagtttcacattttttttttcccaatgcctgggcatccatctctgagattcttcttctctctgagaagaacttgtctaggatcaagtgtttttcaaacttctggtgaatttatataacagctacattttcttaagaaacaccttgtagtcttcactggtcaaagaagagaaggctaagcagggaacgggtgggggatagaggatcttctaatcttgaggatcctggcatactggagaatagggacccctcctctcatcccaccacatcttactatgtctacagattttttaattaagaatagctttaggagtgccactatccctgacaagaccttagttctttaatctctgcttagaggaattagcctggacttcagtgtctccctgttcctcacctggagcattttttaggcccatcctggctgcatcagacaggtcccacattgggaactgaaaggtgtttgacattgctgacatctcactggccattttattactaaactctcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatggtaagtcagcaggccccactgggggcccatgagaccagacgttggtttttttttagatcgcccagactcccttacgatcccagctgcacaagcccgaaaagatgcttgtactttcttcagagatggaggtttgccttgaatttcactgaagatgactcttggatcacatggaaatgttaacatttagaaattaagctattcataatgttagctgtatttttaagagcattaatttattcatctggaaaacaatgttcggtataccttcctctacctttgctgaaggtccttttatttttatttttatttttttaattttttgagatggagtcttgctcccaggctggagtgcagtgatacaatctcggctcactgcaactctgccttccgggttcaagcaattctcctgcctcagcctcccaagtagctgggactgtggacgtgcaccagcatgcccggctaatttgtgtatctttagtagagacaagcctgttgacaaccatgtcaggctggtttcgaactcctgacctcaagtgatcctccagcctgggcctcccacagtgctggaataacaggtgtgagccactgcacctracctgaaggtccttttaagattgaaatgatacaatgattataaaagaaagtatttggcaaactataattcactatctaaatatgctataatttttattattaattcataaaaggaaatatataaatgtactcctatggcttgattaaaaaaatgttgactttaagaaaacaggtctcaagctattttattgaaatattatttaaaaaataaaacccaatgcaaattgatatgtacatcatctcaataggcctttggtttcaaaaaattgattttatcataatataatacatttcaagtacaccttcacttacagtcagactccagaacaccagaattaagccatggcatatatgatacttaaagtccataaagctctgaggcccagcaatattcttaagagccttctgagtccacttgaaaatgacatgatatctatctagtgaaatttcttatatcctgattcactgaaaacggtaaaaacatcagtttgatctttatttatcaaactattcagctcatcaaaatatgctagtccttcctttccagataaagaggaattactctccaatgtatgggaggttgtaattaacaaaaccgactttaaaaagacttacttttatttgctctcccttgttgggtctacagattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacgtaagattctgtttgccttttgatttcttaggttattactttcttccagggtgcatttcttgttaaaacatatttaaaaatgtgtttccasttcaagacaaaatgcttcatcattgtaatcacctcattatttttttatgaaaaacttcaagcttccaccagaatgcactacctcactagctccagtagtggtatggccataagacaagaactcagttctctcaacaaatgagtattcctatcatctttttaatctggttttgcctcacgttaactcaggtgctttctagttctgggtagtatactccaactctagagaactgagaactcgctttccttcttccaaacaaatcccagtaatgtttccaaaggtctgagttatccaggaaatctttgcccggaggtgagaaagggtggttgatctgactgacaggggactgaagtatttaatgaatctgaataggttgttttctgacttatagatgcaggctgaactggtggcaaaaccctccgtgtctgtggagtttgtgacaaatatgggcatcatcattccggacttcgctaggagtggggtccagatgaayaccaacytcttccacgagtcgggtctggaggctcatgttgccctaaaagctgggaagctgaagtttatcattccttccccaaagagaccagtcaagctgctcagtggagggtaattctttcagccaagtctgcctagccagtttgaaagagagaacagagaatgtacctgcagaattttgcyaggctaaacagttgattgagatcattcaggtcctgaggaagcaggagaggagtagaaaggaaagattccgggttacctattttaattctagcctagacttactacataactacataattacctttcttctacttttcacattttactaaactgtcctttatctttctgctttgagacttattaagacctactgcttaattagtttttattaagttgtgattttttgttatctatttgttttgagaatgaagaaacaatagctctggagagatcatctttggaaaattaatattttccccccmaaaaaatacctaagaacatattgatttgaggtagctaggtaggtaaagcatgaaactcctaacctcgtgataatggaatacagcctcttttggagagttccattttaagtggcaccctcaaccattgatttgccttagttttcatattttagacacattcatgtgttcattcaaaaataatatttaattggccagccacggtggttcatgcctgtaatcctagcactttgggagccccaggtggatggatcgcttgagccctggtgtttggataccagcctgggcaacatggcaaaaccccatctctacaaaaaaaattaaataaataacaaaattagccagtcgtggtggcacatgcctgtagctccagctactcagaaggctgagatgggaggatcaactgagcccaagagttcaagccttcagtgaaccatgcttgcaccactgcactccagcctgggagacagagcaagatcctgtctcacaaaaaacaaaaaatagtatatttaattgcctaatatataccacgtatgttgagtgagacacacaaggtccctgacctttgaacgcttacattttataagggagacacacaattaagcaagcagtaatcatagagtaagggctaagttatagaaagtattagagtaccatgaaattttatatcatgtagcctgtgctagtcagggaatgcattctgaagcaagtgtacttgacctgataactgaggactgtgtcagagtcatttaggcaaaggagaaaggagtgagtgttccaggcaaaaggaaaagcatgtaatggcctgaaggtaaaggaatatggttcaaggaactggaagaagtgcagaatggtaaggggctcagagatgatggggagaggtaggcaggggagagagcatgcccagctgcgaaagccatcctaaggagtttggactcttttgaaggcacaggagttgaaaaggggagcagaaataagataggggtgatgttttagaagaaatactctgactctagtgtggaagatgggtgagaaggaggcacagctggacacgaagagaccattggacatctcttacgatcctatgtggctaagagctgataatggcctgcagtggagaaaagccaggtatagaaaggagtgagcagattctacaactttctaagaggcagaatcataagtactgggtgattaactgggtatggggacaaggcaaaagaaagaagaaaagaggaaggaggcgcccttcattttaataagaactacagtgggagagcttctggtttcaaggaaagtgacaaattcagttttggatgtgctgtatttgatgtmctcctatgaaacaaccagtttagaaatctagctgtcaaatagacctatggatctgagcccagtaaagaggcttgggctccacatatggatttgggaatcattagtatacagaggttgttgtggttaaacagcaactggtatagagtgagacatgagagatgaggacagaaatatggagaagacaaacatataaaggaagaaggggaataaccagcaatgagttagaagaagtgaccagagaagcagaaggagaaccaaagccataaaaggtcacagaagccaaagagcagccacaggggagatcaccccatgggtaggcgaaagctggcattaggactccagcacatcagcaaagcttggtcttgtggcacccccaacttggagaaacaatacttggaggaaaatgtgctatttcaaagaaagcatccttagaaaaaaccaggccaatgttgaactttcttacatgtactaagtttttaagtacacacttggaaggaaggtgccatcatctcttcagatgtgagaggctccagcgtcttagtctggtcatgagtgcgcaactctatggaaggcttctgggaggtcaaggaagatgaaacctaaatatgcccattggatgtaggagcaaggagggcattagagacattgatgaaagcattttcaggagatggagtgagcagtcagagcacattgggaggaagtagagactgcaaaggcagacaactcttgatggtgaggaagatgagaaagcaagaaaagaaagaaaggagcataggggaggggcacaggggaagagacttgagcgtgcttaatgcaggtggaaggaagcaggtagagagtaggagatttcatatgaaagagacagtttctcttgccctgcattgtaggaaggaaggggcacactgaagttcagccccagtgatcagctatttaacatctctgagcctctgcttctgtaaaatgagaaccataagcctactgttgtggggattacaggtaacagatggaaagaactcagccagaagcttcagagtcactctcatggcttgtcatgttgatgttctttctaatattatttgtttctcagtaaattaaatagttagagataggtgtggactgagggaagacaggaggataagggggtatttgcaccctgagaatttgtgatgtccattttgattcatgacttggcaataactcaggtatttttgttcttcaccagcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccaggttagagatgctcagtgcctgacccagcattttctcaccttccacatcatggccacctagcatggcacaggaaaaaatactctgtgttgtaagaccctgtcactagccttctgggtttgcaccatctttgggtatttaaagcagggtcctctggccaacacattgggtgtcaccttttgcttccttgtgcatgggatgggatcacagcacagatcccaatttgctcctaattcagtgtccatgtttctgagcctccagacccatcgctatgagcttcctggagcccaccaatgtgcttgaagccttcaccgtacttaggtggctccctgtcttcagcccccaagttccagtgcttgttctcagctttgctgaaacaaccagccaactcctgctctgcttgtccaaagtcttgggaatcctggtgtctgcccttgccttgggttcttgtaggactgagggatcaaaaagatcatcttagttaagggcaagagacaatgttaaaataaggaccatatttttgttgcatttgaggctgaattgttttgggaacataatcaccatccttgaaagctctaacattatgcactgtcttcattgtaatgtctttagattagagctggaactgaggcctacaggagagattgagcagtattctgtcagcgcaacctatgagctccagagagaggacagagccttggtggataccctgaagtttgtaactcaagcagaaggtgagtattcaaaacacagctgcctcatctctgctcgcagtctcaggttcagaattcatgaggagaagacatgtaatttaacctatttaacaaataggttaactgagtacccactaagcggcaggcctattctaagacctgggttaactgagtacccaataagcggcaggcctattctaagacctggggctagaacagtgaacaatggagtctctgccttcatggaagttacagtgaacaaccaaacaagttaatatttggaatatcagataagtactgaggaggaaaacagagcgtagactggtctatggagggctaggagtaggagggaggaagaagggcagggaaagcagtgcatttggaataataagggaaagtctccctggtaaagtgagcataaggagacctawcagaaataagaggagaagccgtgtggtaagactgttaacaggcagagggaccagcaagtgcaaaggccctgaggctgacacactactaccatgtttcaaggaaaggaaggaagacagtatggctggagcagaaagaccagggagaaaagaggtagaagatgaggacagagagatatggagaggtgaaggaaggataatctcataggccatggtaagaactttggctttttctatgaattaaacgaaagccattggggagtcctcatgatttgatttatgtttatgttgagaaaagactatgggcagacaagggcagagaaactaatatgtaggttatcacaataatccaggcaggaatcagtgttgttttggatcagggcaatggcagaagagatatgagaaggggatggattctggccatattttgaagattaggctgacaagatttgctgatacagtggatgttgagtgtaagaggaaaaggggaatgaagacaaacctaaggtttttggcccgggcaactgaaaaatggaacttccatttattgagatggaaagggctactggaggagcaggttttagggaatgggagaaatttaggtgttcactttggaaaaaaaattatatagggatagcgaggagcaggttttagggaatggggcacatttaggtgttcactttggaaaaatttttatatagggatagcatatcacagaattaaactaggaagaaaatcccatgatagaaagcactggaggagcagggcacgctggggaaatagtgtttggtaaacattgttttacgaaggatataaaatggaccagcctatggattgaaggacgcccgggaatcttgttacaaagaaagggggagttggggagatggagcccagggcaagggcagcaaggaaccaggacaggcatcttgggtagaaagtaatatagagatgtcgtgtcttcctggcccagaagggctgcgagcctttgctgttccacaaacaagctaagtgctccccatttcagggcctttgcattcctgaccttctgcctggaatgtgctcctcccagaactcagcgtggctccaacctctcttcattctggtctctgcccacatgtgcccttatcagagagaatttctctgaccaccaagtatgaaataacacttcttctatccctttcttttatccttgtatccagttttactcttcttcataacattcattaccatctgacatgagcaagttacttgtttattgcctgtacacctcccccactagaaggtaagccccatgaaagcaaggattccccagtaccaagagcagtgcccagcacacaataggctcataacaggcaatccataaagacttgcatacatgaacacaactgagtttaaaattatcagtaaatgagacccattaaaaaagtttaatgagaaaaaaaaaattcagtaaaatcctgaactgtgtttttgtttaagcacattgattccttggagtttctctaccttttcctctctttccttccaaaacatagcttctttatttatttatttatttatttgtttgtttrtttatttatttatttatttatttwttttttgagatggagtctcgctcttttgcccaggctgcagtgcagtggtgccatctcggctcactgcaagccccgcctcccgggttcatgccattctcctgcctcagcctcctgagtagctgggactacaggcacccaccaacgcgcccggctaattttttgtatttttagtagagacggggtttcaccatgttrgccagaatggtcttgatctcctgacctcatgatctgcccgccttggcctcccaaagtgctgggattacaggtgtgagccaccgcacccggcccaaaacatagcttcttaccacacatctcttgattctcttatacactcgtccaggtgygaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaaggtaaagaaggccgagggtcatctgacctgcactgcaggcctgggtggttcttttcattattcctcttccacttcatacctgaccaagccatgttctcccctagtctacaatcagagtggcagagagagccctcaacaattttttttttttttgagatggagtctcactctgtcaccaggctggagtgcagtggcacaatctcggctcactgcaacctccgcctcccgagttcaagtgattctcctgcttaagcctcccaaggagctggaactataggtgcatgccaccacacccagctaatttttatatttttagtagagacagggtttcaccatattgaccaggatggtctcgatctcctgacctcgtgatccacctgccttggcctcccaaagtgctgggattacaggtgtgagccactgcacccggccaagctctcaacattttaaccctctgcgcatgtccagttggattttcctaccatttatcaggcacttactattcatgtatcaagcacagtgctgggtgctttaaagaaattatctcggtcctcacaataaactgcgaggtcactgtgagttttcctgtttcatggataaggaaatggtagctcagaggggttaaatcatttggtcaaaatcacagagctagtaaatagcagagcaggattcaaacagttttcaaaaaacttctctttctcctaaacctgtttgcaaagtccttaatttgtgctgaatgttggctttagaagttgatgagtttgatctgtggctgtttctctgaaccatccttgtatctggttttgatcaccacawwtggaacttctgtttaatcctgcatatctccattgaaaggacaaaatcattggtgccaactgattttctttaccatagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatggtatgtgtctcttcccctgtgtgagcacttccaaagtaatgcaggtgttgagacctgtggttacaggctgaactagtaccattcacaactatttcctacgtattttcagatgaagagaagattgaatttgaatggaacacaggcaccaatgtagataccaaaaaaatgacttccaatttccctgtggatctctccgattatcctaagagcttgcatatgtatgctaatagactcmtggatcacagagtccctsaaacagacatgactttccggcacgtgggttccaaattaatagttgtaagtatgagtctgccagtcaataaatacatggatataagtgctaattacatcctcaactctgagctaggtgcaggaaggtttccaaagatgtataaggcatgcttccttccccccagggaattcttggggagaaaaaaaaactttcacaagtgtgtmgttacccagttacacaaagctgaatgtgatacatatcaaagagatgctactaagtagaacagttctttgcctagtggtatcaaaggaagcttcaggacaccagctaggaggctgactatgttagacattccttttataaatatggacagtgatcagtgactggcaacgaagattcataattttctgttatttatttttaactttcagtgcattgtccagcttaataattaacttgtcaaatyggtatttttgcctaatgttcattgctctttgaggctcatccaagcccattaccttaaaaatctcctgtcattttgtaggcaatgagctcatggcttcagaaggcatctgggagtcttccttrtacccagactttgcaagaccacctcaatagcctgaaggagttcaacctccagaacatgggattgccagacttccacatcccagaaaacctcttcttaaaaaggtaaaagaagaaagcagcaaggcttcttgaaccatgcaaagtaaatgaaagattttacatagcatgatttagacattttttwaaatttttaaaggaaataatttaagcattttaaggagattaataactatagcacaaacactgtggcatctttgcattagtaaacatgagaacaccaaccctgtcaggaagaatctaagaaagtcattagaggattctggtactttcaccctaagatattttattcartacaacctgttataagcaaattctccctctgactgtgaagaattcagaatggctagwggcgttattgactacaggcttgctgttaagctagagagagtcagaacagccattgagcactaaatggaggcagcattctgagaaaatactttaacccaggcttactgacttccatacctatgttctttccacaaatcaagttgtctcaattcagtttagcaaatttgtatcaagtatcccctatgtgcaaaatgctagactaggtacagtgagaagatagaaactgggtaaggtatagccttttctttcaagaagataccatggagacatcaacaaatgagaaataattaattatataagcaaaattatgacatgctctttgagaaaggtgcaagggactatgtaactgtaagaatgagacaaattggctatgacttaggtgggatggtaatgataaggagtggcccttagaagagctttgtcaggatttgagtgtttgacaggtggaggtaaaagcaaaggggtccaggcataggagtagcacaaagaaaagtgcagagtggctttgggaatggggcaagtacaatattgytgtgaaggtcagaggcagagaactttgaatgactgatgtctgactgtggggatgttatctttgttgttcatttcagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctygagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggtgagctatgctcaggtaaagggtgcaccgggctagttcatggcaggctctaagaggagagcctcctccagggaggaaaggactttggctttctagcagataatcttccttgctacttggaagtcttttattttattcaacaaatagaaatatttattaaacatatcacgtgtattaaatattctagtaggcagtaacagaaagtagacagataagccagcaattataattcagtgtgagaggtgctatgataaagtgtagtatataagtataaggtagagtggaagcactcaacaagggaacctaaacaaagcctgtggtggtcaggcaaggcttcctggaggaatgccttttgctatcagattttatctttgcattacagatggaggagtctattgcacaattggcccagaaaaatggggctttattattgaaagactttcaacatagagattgctctggaaatgtactgcttaatttaaccaatgtcttttcatttttatgttaggatctggagaaacaacatatgaccacaagaatacgttcacactatcatrtgatgggtctctacgccacaaatttctagattcgaatatcaaattsagtcatgtagaaaaacttggaaacaacccagtctcaaaagktttactaatattygatgcatctagttcctggggaccacagatgtctgcttcagttcatttggactccaaaaagaaayagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatawgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcascctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggstggcttcagccattgacatgagcacaaactataattcagactcactgcatttcagcaatgtcttccgttctgtaatggccccgtttaccatgaccatcgatgcacatacaaatggcartgggaaactcgctctctggggagaacrtactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggaygaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatygacaaacmattatagttgtastggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatayaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatcyagcacctagctggaaagttaaaacaacacattgaggctattgatgttagagtgcttttagatcaattgggaactacaatttcatttgaaagaataaatgayrttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttgrcccaccaatacaagttgaaggagactattcagaagctaagcaatgtcctacaacaagttaagataaaagattactttgagaaattggttggatttattgatgatgctgtsaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattcygagagacyctagaagatacacgagacygaatgtatcaaatggacattcagcaggaacttcaacgatacctgtctctggtaggccaggtttatagcacacttgtcacctacatttctgattggtggactcttgctgctaagaaccttactgactttgcaragcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtmgaaatgaaagtaaagatcatcagaaccattgaccagatgcwgaacagtgagctgcagtggcccgttccagatatatatctcagggatctgaaggtggaggacattcctctagcgagaatcaccctgccagacttccgtttaccagaaatygcaattccagaattcataatcccaactctcaaccttaatgattttcaagttcctgaccttcacatacyagaattccagcttccccacatctcacacacaattgaagtacctacttttggcaagctatacagtattctgaaaatccaatctcctcttttcacattagatgcaaatgctgacatagggaatggaaccacctcagcamacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttytaactgctaaaggcatggcactgtttggagaagggaaggcagagtttactgggaggcatgatgctcatttaaatggaaaggttattggaactttgaaaaattctcttttcttttcagcccagccatttgagatcasggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaarcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcrgcatgcctagtttctccatcctaggttctgacgtccgtgtgcctycatacacattaatcctgccatcattagagctgccagtccttcatgtccctagaaatctcaagctttctcttccasatttcaaggaattgtgtaccataagccatatttttattcctgccatgggcaatattacctatgatttctcctttaaatcaagtgtcatcacactgaataccaatgstgaactttttaaccagtcagatattgttgctcatctcctttcttcatcttcatctgtcattgatgcactrcagtacaaattagagggcaccacaagattgacaagaaaaaggggattgaagttagccacagytctgtctctgagcaacaaatttgtggagggtagtcataacagtactgtgagcttaaccacgaaaaatatggaagtgtcagtggcaamaaccacaaaagccsaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcsggaatattcaggaactattgctagtgaggccaacayttacttgaattccaagagcacayrgtcttcagtgaagctgcagggcacttccaaaattgatgatmtctggaascttgaagtaaaagaaaattttgctggagaagccacactccaaygcatatattccctctgggagcacagtacraaaaaccacttacagctagagggcctctttttcacyaacggagaacatacaagcaaagccaccctggaactctctccayggcaaatgtcagctcttgttcaggtccatgcaagtcagcccagttccttccatgatttccctgaccttggccaggaagtggccctgaatgctaacactaagaaccagaagatcagatggaaaaatgaagtcyrgattcattctgggtctttccagagccaggtcgagctttccaatgaccaagaaaaggcacaccttgacattgcaggatccttagaaggacacctaaggttcctcaaaaatatcatcctaccagtctakgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattaytcctgggctgaaactaaatgatctaaattcagttcttgtcatgcctacgttccatgtcccayttacagatcttcaggttccatcgtgcaaacttgacttcagagaaatacaaatctataagaagctgagaacttmatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcaygcttccaaaaagtgtttcagatggcattgctgctttggatctaaatgcagtagccaacaagatcrcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagrttatgttgaaacagtcctggattccacatgcagctcaaccgtacagttcctagaatatgaactaaatggtaagaaatatcctgcctcctctcctagatactgtatattttcaatgagagttatgagtaaataattatgtatttagttgtgagtagatgtacaattactsaatgtcacaaaattttaagtaagaaaagagatacatgtataccctacaygtaaaaaccaaactgtagaaaatctagtgtcattcaagacaaacagctttaaagaaaatggatttttctgtaattattttaggactaacaatgtcttttaactatttattttaaaataagtgtgagctgtacattgcatattttaaacacaagtgaaatatctggttaggatagaattctcccagttttcacaatgaaaacatcaacgtcctactgttatgaatctaataaaatacaaaatctctcctatacagttttgggaacacacaaaatcgaagatggtacgttagcctctaagrctaaaggaacayttgcacaccgtgacttcagtgcagaatatgaagaagatggcaaatatgaaggacttcagtatggagcttttattgaattgaaaccttataccttttgaaaactcattstgattttcttcatctccatacccctttcgtgatagctcatctgtttttctgytttcagggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgaygacttttctaaatggaacttctactacagccctcaggtaaataccacctaatgagtgacacgcccccaagagcgagtggagaattggggcagatacatttaattcaggaccaaatattcagagattccccaaactaggtgaaagacaggcggtaagcaacttcttctctgaggaaatattctctagaaagtattacaatgagtccttgattgattttaatgtttagatgcacacatgacatcccatcagcactattatttattaattctgggcaaatccaggaagatgagggttatacctcatcatctaaatcataggcaagctcagccataggcagggtatatttttcagagaggactggtttctgtagtatttaaaactttaaaattcttccccacaakagaattgctagatgagatacatcaaattcctctcatgtcatttacaagctctgccagggccaaatcaagggtgacattaccagaggagaagaccaaacatggttctatgactgttactaaaagtttgtcatgggcttggagaatgcgtactgatgttgggattctgggtctctgcagggtgggctccaacttgccttttttgctatttcttctttycctatctgtcatttcctgactcttcttctctctcctcttctttctcttccccccactcctcttccagttttcagtcctaggaaggctttaatttyaagtgtcacaatgtaaatgacaaacagcaagcgtttttgttaaatcctttctggggcatgtgataaagagaaattaacaacagtagacttatttaaccataaaacaaacacatgaactgacatatgaaagataaatccctttcagtatatgaaagattctctgatctttatttttaactgctaatgaagttttagtgtactatattgtgtaaytggagtaattgaaaacatgttatttttttttttctctctgtttagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacrtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaaraattccatatgaaagtcaagcatctgattgactcactcattgattttctgaacttccccagattccagtttccggggaaacctgggatatacactagggaggaactttgcactatgttcataagggaggtagggacggtactgtcccaggtatatwcgaaagtccataatggttcagaaatactgttttcctatttccaagacctagtgattacacttcctttcragttaaggaaacataaactaatagatgyaatctcgatgtatasggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcartgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccagrccattgcgaygaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaakaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataccactgaatgtggctcatttgtattgaaagacagtgaaacgagggcattgataaaatgttctggcacagcaaaacctctagaacacatagtgtgatttaagtaacagaataaaaatggaaacggagaaattatggagggaaatattttgcaaaaatatttaaaaagatgaggtaattgtgtttttataattaaatattttataattaaaatatttataattaaaatatttataattaaatattttataattaaaatatttataattaaatattttataattaaagtatttataattaaatattttataattaaaatatttataattaaatattttataattaaaatatttataattaaatattttataattaaaatatttataattaaatattttataattaaaatgtttataattaaatattttataattaaaatgtttataattacatattttataattaaaatgtttataattacatattttataattaaaatgtttataattacatattttataattaaaatgtttataattacatattttataattaaaatgtttataattacatattttataattacatattttataaagtatttataattacatattttataattaaagtatttataattacatattttataattaaagtatttataattacatattttataattcaatattttataaatagttaaaaagacgaggaaaaaattaaaaagacgaggttattgatctcaggaattgtatttgccaagtgagaaggaaaaaatattcacaaaggcttgtacatactttgatcctgaggaacacctctggtgtcttcatgtgccacatagtcttcctcactgactgtctgcctttgcaaggcaaggctctccggtaggcctcgagatgaaataacaagtcctttatttcactcagcctgccaggagtggagaaggaatggctagggagtcctagccccaggggcttcatggcaatacggaccccagatgtctccctggagctctgccaggatccattcaaggccaagaaagtatgattgggagaggaggggtggagatgtagattcctaacaattctgtgacccagcatacatgtatgctctttaggctcttaagcatccttatttttccaaatataatatccaacaatcccaagtgtagtaaaaacccaagggtttctcctgccacatccactcacttcaaactctgattttaaacactggcaatatccagtcagagcctccaagctgagctctagaaagagaaagctgcaaaaaacctgtgcaacaaaacttgcactcatattactgacaagggtagatataaaacagcgcattcttttccatgacactgaagagcaaagaagagtgtaacttgggggcaataagaaattggaggtcaccacctcccaaatcctacatgaggtctatttggaaaagacctccttttttaattcaaaaatccttcaacctccaccattctttcataaagcttcacattctcttggtgaagcccactgttaaaatgcacaggcgttacctggaaaaggaaacacatagccttaacaatattcttctgtactgaactgaagagtgagaaagagtctatggagctataatacggtagtgtatgaatctggtactcaaggaaagtctgttggataatggatggatggatggatggatggatgggtgggtgagcgaataaatgagtggataaatgaggggtcagttttgagagtgagagaaacatggaaattagactcaaatcccaaggcaccacatggaatagttccaggaatagttctgcaagagtttccctgatgagctataagcagcaaaaatttagtgagtgttcaaactgaaaggaggcctggaattgtggcttaatttggagggaaagagggagtccaagattcccagtgcttatttgttgatatctatctagtgctgaaaagaaaaaaaaatagccacaaatccaaaatgattgtgcagtcacatggtacccactgcccagttccttgaccagtgtccctcatacaaagggcccctgatgagctcagaatgtctttgttgtactgaataaagtttgaagaacaagggatccttgtggggacttggactttgcctgctcccttcttaggtcttctactgcatatctggatacttctctggttcaattaatagctacattttttatttgcttgtactcagtgcaacttatttcacctctgcaagcctcagttctcttacctatgaaatggagataatatctatcctgcctgccttgcaggacttttcatgaaaatcagttgaaataacatatatgagagttctgcaacctttaatgtcctgtagagaaaagctgccattatcattagatgattattaaaatgacgttatggcaagaagaaagaatggaggcagggctacgtgtctggttcagtgtgcattgataaaacacctctatgtgtaaggcactgtgcagtggctctatagaggagacagagatcaataagatgcagttcctggaggtctgtctgcccatttatctgtcaaaggtgaaacgtgttttctcatggtggatataaccaaagtactatgagggatttaaaagaggaaagttgtgaatcaggggatttttatagaaaagattgaaatggatctcgaatatacattgactttaataaacagatgagagagagggtggtctaggaagaagacgagtaaagaatgatagttgggtgtgttgtaaggacactggattatctagtttagccaaagcacaggaaaggtaaggagagaggactggaaaggcagatctatagtactgcagagggctcgaatgtcagagtaaaaagatgacactctctttgctgaaggacatccagtaaaagtttttgagcagaagggtgacatgcattgtgatttcggaaaaccaacatgacaacctatagataatgaattgtaatggggtgaatctggatatgagtgtattagtccgttctggcattgctataaagaaatactgagactgggtaatttaaaaagaaaagaggtttaatcagcttatggttcctcaggcagtacagaaagcatgactggggaggcctcaggaaagttataatcatggcagaagttaaaggggaagtaggcacaacctacatggctggaacaggaggaagtgtggggaggtgctacacacttttaaacaaccagatctcatgataactcactcactatcacgagaacagcaccaaaggagaaatccgcccccatgatccagtcacctcccaccaggccccacctccatcattgtggattacaatttgacgtgagatttgggtggggacacagacccaaaccacatctatgaggttgtgccagggtccaagtaacagatgaggagcacctcagtcaagtcctagggttgggaatggtgaggagggtaggatagaagaagattgggaaggcagaattgacagaatcaggtggctgattgagtaaaacacaaaggatgggtgcaaaagctcttagaaatggagttgccttggtaagtcactgaagccgggaactggaggggttgcaggagagagagagaggaacataggaacaaggaagaataggtaaagcagacttcagagttaggaaattccgaacctgtgtaacttgaaggactatggagcctcagtagaaatgggaggaatgtgttgagtgggagattattagtataagacatggactcattgactatcacagctggaatgggactactggatcacatagtgagtttccatttgcaatcatgtgtctaagcagagatatctagcaggccagttggaaatgtgggctagagaaacaatatccaaaggagtagggaaaaatgaggattttaaccaataattgcattaattttatgtttgtataagtatctttagaaacttaacaagaaaacaaagagtttttccttttgtacagttaattgccctattgtcctgggagtaagtcaacaggtacatctgctaagaacatactgtgaggtgacgtggaaagtcctgctataaatacagatattcctcccattaaacaaatatctaaagttttcaaccaaaggagaaatcaaataatggagcccagcccaagtccctggggcttcagaagcatgatcaagctgtgtgctttggtttgactcccaggtcccgcctagagtagtggtgctgtcctcaggataaacctgataagaaatgggtccaatgggactcagcaccaccagatgtcttcagagctacctccattttcttctgctttttacttgaagcccggtcagttgaatagctcaattccccttttttggtgagttgagcaaagccccctctaactccctattctaggtccccttctgaatctaatttatgacttagtcccaattcagtcagagaaggggccaagctggccctcaaatggggcctgcaatatgggagccagagtggacaaacagatgttccctctaaaagtgtctaataaccagagataaatgtgcagaaacagaccctacctcttagctcatctccttgtatgctgtttcacattaagaggtcagctgtaactcccttcagagtgctccatttgttggtgggatggttgggtggtcaccaacaaataacattccagggcctcataaaagttggtggagtaggtgcacatgtttccacaaggagagggccctgcctttattctgctacatagactggctcatgccttccccagatctgagcagtgcttcaagtcaacaatgccagggcactaggcgctaacactgacacttgtgtccattttactccctggactgacaccaccaaagcccattcttggggtgagagggatgactcaggccttgaaggtggactggttcatgaactgaagacctgtgtccccacccttgtttttaaactgtggcttgggctgtcagctgtgcagcatgaacaccaaaccacagtgagcagaggcatccagagtttagattctaacccagaaacagtgcctaaggaaagcacagctggaccaatagcccagctccaccaattctctctccattcctctgctttttcatcaggtggggctcatccaggctggtgccaaggtctttctggagtaatggagctcagtatagctccaggagacctaaagcctttgaagtgggatcagagctagagtcattagaacatttctataatcacatgggatgttggatgatcctggaaagaacaatagagagggccgactgctgccccatagctctgttgagctgaggctgggaaccaaggcagtcaatacttccctcctctcaaaagaagtccccgctctcaaattcaagcttcatcattcatgagttatttaacttcagaaaagtcacttgagtttcctaaccttcagttttcatcattaaaatggagatcaatgagaaaaataggttaagcaactctgagcaggaggagaaagtggccccatcttatgttacagagttgttacaaagattaaatgaggttaacatacatggagcctggcaaacagcgaatgaatgcatcgatggttttctattgacagaagtcaaaataaatgacgtacaattacaattatactcaactacttagaggaatctgaccacaacataatagggaataagaatgcaagtcctggaagatgaaatgcagtgccagactcttttgggttttttggtttgtgtttgtttttatttttgtttttgtttgtttgtttatttgtttgagacggagtcttgctctgttaccaggttggagtgcagtggcgccatcttggctcactgcaacctccgcctcccaggttcaagcgattcccctacctcagcctccagagtagctgggattactggcatgtgccaccacgcccggctaattttttgtattttagtagagatggggtttcaccacattggccaggatggtcttgatctcctgacctcatgatccatccacctcagcctcccaaagtgctgggattacaggcatgagccactgagcccggctgccagactcttttaatatagttaaaatcaagaacaaaatgctttgttttct

SEQ ID NO: 17685 - DNA, 189817 bp, Homo sapiens
  misc_feature (1)...(189817): n = A,T,C or G, or insertion/deletion polymorphism (see Tables 1-2)
acagatgtgcacacactcacagacacatacactcacatagacaatgcatacacacagaggcatacatgctcagaaatacccatacacacagatactcagacacactcagtcgctcacacagatgtgtgcacagtcacatgcagacagacatatacactcacaaatatatagccagacacacacagacacacatattcacagggagttgtttaatggaaacagagtttcagttttgcaagacagaaacattctggagatgggtcatacaataccatgaatagccttaacactactgaattgtaaactgaaaaatggttaagattataaattttatgtgtattttaccacaattaaaattttttttaagacagagatatttactgtaagaaggtgggtacattagttaaatctttctttcctaaggcgagaacagctttcttccatttgcctgccatgaggtgaggcagcccccagcaatccatcactgctcctcgggaaggtagattacaggtgatcgtagatccctggcaagagtgggctatgcccagggaagccaaagcaaagagaaaactcctgccatctgcacctgtccctggcatgggttttcatctttcctgaaagaagaaggaaaagaggctgtgggagacatggtcctgtcttagatcccacgccctattgtggtggcaactgcgatgatgctttataaattccttttaaaatgtcattgccagactttgtgaaaacgctcgtgaggctttgaaaaatatgtgaatggatacagagggccgcttgccttcccccactgctcactactgtggctagaacctgactacaaactgcccacccagcctcccttccatcctctcccccaggacacttccatctggagtggaaagttttctccagctcctacaggatgaagggcagtgcaggagaaagactctcccaagagacgaacttgggtcattcatgtcagagggtctggcatctttgaacaaggccagttgttatttatgtatctactcacctccctctggaattacatctataaccaacaaaatccaggtcttgttcagctggaaaaaaccagcagcgtccagacatgactgggttttttgtttgtttgtttgagatgtgaagttttgcatgtaaatcraatagagtttgccagaaaattcattgcctgaacaaatatggtctgctccttgggtattgccaagtaggagaaagatggtttgtctggagagactgcagagaaaagtgtcaataccatagaaatgaaaactcagaattaaaggatcaaggtaaggggatccggaatccctcctcccacgtattttctgtttactcacaactcccaaagtttactacatatttctgagagacgccaggatcccagagtgatgtgtttaggaatttttaccctgcttcttggggaggcaatggggtgagcccttcagcttcagaagagtgagaaggtatgcccaggcccgtgcagccagagggagttcacgtctccttggaggtctcatgctgagctggtaaggccaagaaagtaggggcagaactggattacccttgtgacgttctcattggagtctcctcgtgctccaggcctattgacatctcatgtgagggactggccatgccatgatgaaagagcacagtgtgttgtggcagtcctggaactgtttgcccagagagcctttcctcaccctttccctgtatggatgcagtaaagagttaacatagcaaacctgaaactggcttagaaagccctacttgcaagcttggcccttgtctggcatctgggaacttggacttcaggagtcttcccactgttccctaactgacaagtggggctggctgggcctaaactgtacaaaaattgtggctcatgcttaacacctgcttccttcagggagtctggaaaatggctatgagctaggtagagggtacctatgtgaccagccccccataaacaccctgagcactgagcctctggtgagcatccctggcagatgacattatatcagtgttgtcacaactcattgccagggttggtaggcacagcccatgtgccttgattaggacaggacctttgggaacttctgcctggtcctccagactttgcccaagtgccttttctctgctgatttggatttgtatcttttcgtcatgatttatcgtgtagtatatatgatatatgtacatttgtatctgatcatagctacgtgggtggccgagtctggtgagtcctcctagtgaatcacagaacctgggggtagccttggggccccagcacaggagtggtggggctaactttgcaggcggtattttccagagtcctttgtcaactgattctagtggagttcagcaaaacggcagacaagggagggagagggagcgggaagaaagggacaagctaggatcattcttccctccctcttgacctcagacagtgtttcttggaattatgggatctaaagctcccaccagacaggaccacacggttccagtgcctgacctaccctcagtcctcccgctacaacgacaccaactcctctctgctgttgctaattgtggagttgattcaccttctcgtgtttggtttcttgtctcttctctcacctgtgtaaccaatcccctgccttaaattccttcttttagaaagacctaaagtggtttttgttttcctggatgaaccccgtctgttacatgccttaaatatttacatggctccacttccatgccaggcagggggcattcagaaataaaagacaccatcccatccttaaggacctcagagcctatgcacctgtggaagttgcatccctagcacagttcaagattcactgtgtgaccagaaacctttgttctgatgtctcagccatataaccatgaggaataccctgtaaaatgaatgggcttcaaccgcattctagggcttggtggcttagacacatttttatcgactttgtttagcacaaggaaagccattgcatttatgatgctcttgaggttagtggtttgggggagtcagaaagccaaccactgtgtgtgtatgttcacaaagccaataattagtctaaggccaaaagtgacaccgtggaggtggttgtgagggtgacaatcctgttctgaatgcacaactcaaccccaagtcccaggggtacctggcatctgcgtaacctcatctgaagggtgcaagggtggctgctcatcctccaaccccacatggatgagggtatcttggaattctagacactcagatttgatgtttgccaggagaactaccagaatatgatcgttaaggattgggggagggtttaaaaaatactgaggagacctgaaattgtatgaatgctgaggggaagcagtgctagacatctttagggtctttctctagcactcagcaagggatgtggcaaagacggcctttggatagttaagtggtcagcagcctctctccagggaactctggctggagtccctacctttttgtactctagtgcaggtacagccaaggaaacagaaaatgatcatgcagtgtgaggagcactacaacaaggcaaactccttgcaagacaactggggagtcagtggagggagactgggcagggaagaaagatggcagaggaagatgatagggaagaaagatggaagccaaatggcagaagcttagtgatgaagaggaggagaggagaaacaacagtggaaggcagggagggtagattggtgttgggggaaggttttttaaaaatactggagacctcaaattgtatggatgctgagggaaagagcagtgctagaggcagggtccagcttgtataggccttgtcagtttcagcttgcaatttatccaaaaagcaaagagaagtagccatataagggctttgtgcaaataatttgatttcrgattttagccctgaaatgctcattctgactgcactgtagagaatggactggaaaggggtacatacacgggtagattcaagggctgtttaagaggtaggatagaaaatatttgctcaaggatcggatttgatgattgagggagagaaacaaggaagcctsaagaatgatgcccatgtgtctggtgtaccacctgcgtgcaaagtgatggtattcattgaggtagggaactcctgagatgcaccaggttttccaggaaagtgatacatctcatgttagacatgatgagcgtgtgttgtcactgggatgtgacaaatgaggatagccagtaggcacttagatacgggaatctgcaattctggaaaagatcttggctaaagacccagatttgggaggtgtcaggatatagatggaatttgaaaactatgggagttcctcagacaatcaaggaatattgcgctgcactggaggaaaccacagagtgttcaatgtcaaggaggcctaggaaaaataccttcaaagacagagttcaatgcttccaaaaggtcaggtaaataagaactgaatcctgtcttttggcctgagcacaggccttggagaccgtgacctccactttcagtagaatgatgaggcggaagccagatggcagatacttagtgatgaaggggaggagaggaggagtaacagcaggagtggggacataggttgggggaggtttttaaaaaaatactgaagagacctgaaattgcatgaatgctgagaagacccactattagcaagcaggagcttgaagctgcaagaggaagagtacrtaagagtcacagcaaagccccggagaacaaggcaacgcagaagcctggtttggagatgcagagggaggagggacctttccaacttcagtaacaagaagaaagaggaaaagatagataaggttgcaggcaggttcatagattggtagcagaaaattgagagaatttctaaccaatggcatctttttttttcttctttataacattgggagattgagtggcagggtcagaaatttgaagacagtaaagaaggttagaaatagccatgtttgactgggtgcggtggctcacgcctgtaatcccaacactttgggaagccaaggagggtggatcacctgaggtcagaagttcgagaccagcctggccaacatggtaaagccccatctctactaaaaatacaaaaattaggcgggcatggtggcatgcacctgtagttccagctacttgggaggctgaggcagaagaaycacttgaacccgggaggtggaggttgcactccagcctttgcaacagagcaagacttcatctgaaagatagaaagatgaaagaaagaaagaaagaaagaaagaaagagtaaaagaaaaaaattaaaattttagggggaaaattttctaatttttgaacatgcactaaaatgattttcagagaaaaccaagtgttattttctaatctgcatggcattattaaagatgtttactcatcttccttggggctaggcatcccattcctgcaggaagtcttgtggttaggcggtggctgtggctctgggatgattcaggaatgcagaccatgccttatttgcacaggagggacacgttgctctcactgcatgcatggtcacaactgtctgtgtgacctgtctgtgggagggcagacccccctcctgccaagccacagtagcagctgacctgccaggcaaaagcattcctttgtaaaggaaaccctcccagaccctctgaccaaaggggacgggtggggacttcctggcactgcagggccccttgcctggtactcccagcaactggttgcggtggggagggcagatctagggrtggggatggggaggagaagtgggaatgggaaattgggagtcagaggggcaagtgggagagaagggcgcacctgccgggataacaggccagatgaagtaaatagaaaatcctctgagctcccctactggctccagctgtggagaagggggaggagaaaaccctgtgggacaggggaggagggtgagggctcctcttaggaagttatttaagagccaactgtcttgtctttcccgagtccgtttgaggaagtccccgaggcgcacagagcaagcccacgcgagggcacctctggasgggagcgcctgcaggtaagccaccgmccctgcaccctatgagccagggmccgctgcgtccaccttctgcacctcggtttcctggttgaaccagcaagcggcttgctctgggccctgtggcgccggtcacaggcagctccacttgcccaatcctggcttcccgcccccaactccgcacctgcccagcccagcttctaagcgggacttctctcaggctctcgaggcagctctcccgaagccgttgcttgcttagaatgccaccaaatggggatgggggagttggaggtgcttccccaagggacgagccccctttcctcagggagcagattatggagctggaacacaaaaggtggagggagtggggccaagtgagaacagcctgctagactggaaccccgccggcttggctccccactcctgcgcgcctccccactcctgcgcatcgcctgcctccrtcccaatttggagctgaactcgagccacttctcctccttagacccgcccagaagcgagggctcctgcccgccgcactcacccagccaggcgtgcacctggggctccccccttctcccccttagcactgtgtctcccgacagcgygccacactgttctgcacccctggcaatgccrcagcctaccttcggtatttctcactagaggatggctctcgcagccttctccctatcattaaccctttttcgctcttctccctcccttcccccstcagctcaccaatgactgtaaatatatttatctatacttatggatacccattcacaccttatgcatccaaacactcctgtctccttctcagaccagacaccttaggcgtggttgtcttttctccagcatgttgttagtgctccacatgtctctggaaccatctctctactctggtggcctctataatggggactcttcacctcttgkgggtgtgcmtggtttttgaaaatagccaagtctccaggagtcatgactgggtaatccaggggatcaagggggaaccttcactgggcccagaaacaaagtcccccttcatttggtcatttggtcaacaagtacttactgggcactgaccgtcaggtgtgtgttgtttaaactggctcagtgcctgcacaagctccaagggaaggggaagcaggcttggggaatgggaaatgttggcaaccctgacttcttaagcctattgatagccctattgaaaattgcatgcccaacctctccacctccttatcctcytccatgtggctcaatttccaaagcagttcctacctcctcacccctaagtggatttacttayggctcttcttgggctccaccctaaccctatcagactataatctatcagagcaaacattctgttttgttctctgatgtatcccatgtacctagatcacagcctggcatgtcataggccctcaataaatattggttgaattaaattgcaaatgtaaaygctttagaagacaacatttrtctggacatgsttgtgtgcgtttattcttaaaagtgacttataatctcataaatctgtatgaaatgaacatagatacagcacatgcatataacaggaaacatttcttgcgaagatgctgctgtaggattatggagggtgggggaatctgggtctccaaaaatcttttaatttttaaatttctttgaataagccccttttcttctgctttccatatgttttgacacatacaaaaatctccccaagatccttggggaactgtattccatcattagactaatccttgctgccacttctcagtttttatttatgcaaacggcaaaatgtgttgctcaagtgctatcacacacagatatatctgtttctctattttggaatccttgtctcaaatgttactcactttacatgccttttctgttgtcttctttttttttttttttctgaaggaccttgtaaagtcaaaaatgtcagaaacttccaggaccgcctttggaggcagaagagcagttccacccaataactctaatgcagcggaagatgacctgcccacagtggagcttcagggcktggtgccccggggcrtcaacctgcaaggtatgagcataccccccttccccaccactctgggtccaggcacagccgggccctggcccctcttccctgcaggtaaacatcctctgtctccactggggttcccacaaaaggaagccccctgccaatctctggttttataaaggaagaaagcaaaagctttcttttaagtggtgaaagcaccgaagacccagagccttgtcccagttctgccccttactgaccttgtaacctcagagaagttgctttgtctttctgcctctcaactatttcctctacaaaaccagagtgctggattagctagggcctcttccagccctactgctcaatgctttagagaattttctctagctggaatattccacttccaaaatattgtggctgttttgattgtctggcttgcacctccttccttctccctcctccctcctccatccattgctgtgaatttcagagccggggagaagtgccagactctgacagtaatagagatagaagccctctatttctctccagagcagcctggtgagctggcaaggcaagctgcttccccagcctcttgcctctgcctgatccctagaaacctgttccgggtacagcagccrgcagctgacctcctctcagccctgtcagtggtgacaaggyccaggtgccagcactggtttggtgatacagacatcattcccctgggccatggsagggacattcagactcatgtccccgagtggcattgagcagggagtcttttttgtcaataacattcatgcaccaaaatctaattttactcctaagggtgttctgtgctgggttycactggggataarcamcyatttgctgggataggtgagcatggtcatgctggagctgtgtggtcgattcccctcattagaaggagacsaatgcctgaaagcccagattgatgcagctctccatatagcaaagggaaaggggaagtgcagtttatccagcaagccagacacttgcccaggtgttgtggactggtgtcattgtgttactgtcacactagatgatwtgatatcaaatagtgaaatcagggaggtatccagtaccatccaagtttgggaaaagaagttcacagaacagaagggcatcttcagtcaggtggtagagtttgaggggctaagacgaacttgtagttctgaaatctgtctcccagctggatgccactctctaaaaccccaccttgacagccacagaactgagtttaagaggacttgctaatcaatgaatcctcatccccatgttatatgttaggaaatagaggctgaaggtaagcagttgatattcactgcttacccagtctacgagtctttttctttaagaatgcaaataaaatgcaaaagcctacagatatcaaattattaagcaggttgcctttgtgtattccatcttctagcaaaattcccctgtggcccaaaagactctgggcccccggaaagggggtgtaggcactggaagaagtgggcagtaagaacaggaggagtaatgacacaaccgtccttgccacgaggagtcaggacacagccacccttgccaggattgggaaaaacgggaacctctacaaaggcagtgcagggaagcagggaagcagagagcagaggcagaagacctggcttcctgttccacatctgccacttcttgctcactctgggaaagtcatattggtgcccaagcctcagtttctccatcagcaaaatggaagcaatgcctacttcacagattgtcgtgagcatctagtgagcagtgtctgtgatcaagtctgacccacagcacgtgaccaataagtgttcattgactgggaatgtgcaacttatcataycccagcaaggtcaggaaagcactccagggaatacttgttcctatgaggaatatgtacgacctgtagcccccataaatctgacatctgaacaaaatgctgctagtaagacattaaaactgtcagagaacatgtgcaggtaggccaattaagaaaaataaaatctgggattactgcttttgttgatttctggaggcacaggtggggagcagcataactgaattactctgaaaaaatcagtcattatttacttggcagacatatgtgtccacaacccaagtgacattctgggatatccattagaggcactggcataggaatatgaatgtccagtgrctgtagaatgaatgaacgaacagtcaatcacttgtgaattgaatgactcatagctctagtggcattataatttattattaataacaagctacagatttcatacatatgcattcatttaatatttttcacagacaagataagtgttacatgctctggggatacggtttctgaagcccagaatcatgacagcaagtcccagatgagaaggacaggaaaaaaactatatatatatatatatatatatatatatatatatatatatatatatatatatatatatatatgcacacacacatagcagcacacaaaccatctgaacaaggaggtctatctcctggttaccttttgcatttcagatttatatttaattgttctaaaagcaggttttctggcactatatatcaagttttctccaagtcactaagggaygaaatttgctaagcgactaaaccttggaaagmacackcatttttaaaatgccatcttcatgcagttcacccagtggccactagtggcctctaagaggccttgtatccgcggttaccaatctgcggatgatgactttggctccaggaacaccagcmccaagttaaaytcttgtctccatttttttcagtggccactcttccagttagcaagctgctcttgtaatactgactgagaaatgcagagaggcaagaagaggaaaaggggggaaatggcggstttttcatttctaatagttctgtagcagtgagtcctgcccatyactgygtgtgatatayacagtgttctaaggtatactgagtgtatataacgcccttaagtcatggctttggtaacatttggttaagaattattttggtaaaatctrtattttaaaatgtataaactcatgtaagtttcctctcatacacaccatgatattcaagaaaaaraaatgaaatatttgaggtaggcacggaaatcccagaggtgggaccagccattcagtggtagcgtttgacatctttgcatgattttaggcatctttaatgtcaccctttgaattcagttgtagccaggaaaggtactgagacgatctcctcagatttggatttgtatcaatttctaatagactgttctgcaggcttagttggtgtttctgaaaaatctctccactgccttcctggtctgaaaggttatgtgtagctggaaatgtaatattccagaagaaaccttatgttgttggtctgctttggctctatattgttaacaataggcgaccatttgtagcagtaattggaatcatttaacagttctattgtattgaattaaaactggaaagcaagcctggccctatttaaaaactgggttctagtagtttttcaggctaatggggtcttatrcctttctaagaatctcctccatcccaccactccttgtcagaattaaatcaaccaattaatgataaacctcctctttgtgcagagtaaacctctctggattgaaggttactgagagactaagaggcattcagtgtatgactgagaaatgctattgtccagcagcagttcctcctttcattcagttcctggaaaaatatacactggttttcacatatgtgtcaggagctgctccaggctgtcccttgggacatgaagttgagtaagttagtccctggcctcaagaaactctcagtgtagaagacaaaataaataaaagatcattgcaattcagtgtrataaagactgtgactgtgatttatgcaaattgcagtgaaataacagaaatcaatgtctagcrgtgtggtggagtggggaagaggatgaggagggcttcctgatgcaaggatattggagccgagacttagaggatgagtatgagtgttcctgacaggcaagcgcrtggaaaagtgtttgcagtagagggaacagtatattgcaagtgaggagggactaaaagatgaaagagaagatataagcctgggaaargatggcaggcatcacaccataccaggccttggggatcttgctttcctcctgcagataatgsgggacttgagaaggattctaattagcagaaatacataatcagaattatgctttacaaagtggtagggagggctgggcacggtggctcatgcttgtaaccccagcactttgggaggccgaggtgggcagatcaccagatcaggagttcgagaccagcctggccaacatggtgaaaccctgtctctactaaaaatacaaaaattagcctggkgtggtggtkggcgcctgtaatcccagctactcgggaggctgaggcaggagaatcgcttgaacctgggaggtggaggttgcagtgagccgagattgtgccattgcactccagcctgggcgayaagaccaagactcygtttcaaaaaaaaaaaaaaaaaaaagtgtaaggagaaaatggagaacaggagatatgtttggaagctgtagagatactccaggctagaagaggaatagaccagagggrttttagcccctggaggtatggggctcatttctcttgttscagcttcctctgagcacctgagcaatccttcaacattataggttccaggatgtattaataacaacactttataaattaagccacttaagaaaatgcttttaatcattctaattaaggacatgttaaaattctgggtacccaaaagaaatgtgagaaagagttatttttcctgtttttttttaaataaataaaccagtttctcatggatagcatttatgcttatagttcaataayaatattaccaaaaattgcatggagaattcagttcactagggaattcctagtatataaacctaaacatttaacttatttcaagatcccatctgtgacaggtataatcattctctgaagaatattttacaacctagggagacaataatttacattttgttcatattagasaaaaagyaggaggacagggaggcagttgctcctccggagatttttttcttttctttaacagtccattttccgatatgtttggaattaggctaaattgtgttaggtagacagtttgaaagctgtcactttgaaagagcgagctgccaagtttctagctacmgtatttaaaaaaaaaaaaaaaaaaaaggcggcttagcaatgarctgttccattttgccaggaactaggcttggacaggggaagcaaattcatttcctgtttgtggcaaacggagtctggatgatgataagactttttccatctaaactgccttgtkaacccagtaaacaaagcaaaaatcaatatgctagattcatcaatgcttgctggaacacactccatggcaagggacatttcctaggcaaaatggacaatggaatgaacaatgatatttttatgtctatgttcatattttatacagtcatcttcagagtctttgatactatcagctgttataagaaccaaatacttggttgacctgtgtgtggctgactcatgggcaatgaaataaattttgttgaatcagtggtattggggacctcacctctatccccaatactttggacaacccattaagcttsctcatgtcttttccatttgactacagtctggaacattatttctttaaactctcaacctctctgtgtagcttttaatcttccccttcttagccaagttttattttttttttatgaaatgtctttctttgtttaaatcattttaagacagactttttttgtttttgttttgagacggagtccggctctgtcgccaggctggagtgcagtggcgcgatctcggctcactgcaagctccacctcccrggttcaagcggttctcctgcctcagcctcccgagtagctgggactacaggcgcccaccaccactcccggctaattttttktwtttttagtagagacwgggtttcaccgtgttagccaggatggtctcgatctcctgatctcgtgatctgcccctctcgcctyccaaagtactggaattacaggcatgagccaccgcgcccggcccccaagacgcacttttaagagattatacaggaaagttttacttatcactgccttagtttttccccacttatagtaccactgtgattttatgtttttcctgaggcattggcttgttgaagtkatattgcaacagagaatcaaaagatcacttagaaaaagtaacatgttagaaaacatcatgcttagaattaaatgtctaaagtataccagtatagatgatataatttaaaacaaytgataytatcagctgtcataagaaccaaatacttggttgacctgtgggtggctgactcatgggcaatgaaataaattttgttttatacgtataactttatatatatgtaactttatatatatawaaaaagtttgcttatatataatatatatacacatatcatatataaatatattgtttataatatgtaaacaatatatacataaataatatataaaaastatatattatatatgtaaacaatatatttttaaaamccaaactcatgggtttatagttttttcatagtgaaaacaaacaaatatatagtttgcttatatctattatatataaacagtatataatatataaagatataaataatatataatatataaatatatatttgtaatatattatttgtttatatccatcatataatataaacacatgtaatatatataatttatatgaacaatatataatatataaacaatatatgtttttatatattatatgtaaacaatatatgtttttatatattatatataaacatatatattcatgatatatatgtatgtttgtttacactatggaaaaactataaacccatgagctggggttttgtctttttttttttgacttaggttttctattctcaaaggcattaatcagcaccctttttctcacccttygttatcaacatataagcaggctagraagacagtattttattccratgtgaaacaaaactgctgatctggagktcttatgttataaattcccacatcataccttcaactatatatatgtcctgaaactagcatattttgagaataaaatggkaaatgacatttaaaggacacctatggttaatcctacagtaaatgagataatttattttgaaatgaatgatcaactctacgctccaaattttcacgtaaaaggtgttcaggtgaaaggaggcatatttgctgtggcatttctgcacactgccccaggcactatagcaagataattaagacatggtccagtcttcaaggggattacaatcccatggctaaaaaatcacctatataaagataatacaaagagacratgatacttttttttttttaaaaagaagacagatgtttcctgcgaatcaagaggagaaatgctttctatttacctgtggaaattcaaagcaagcctgtctgctcagaagayaaggagtataaaatggcatgcttccctgggaaggctggaaggccactgctaaaaagcttcccagggacmttctttaccttgtgacttccattgctcagattccagcctcrcaccatgccttctcagatacctgactacttaatgattggtcctaagggccaatccaaatgctcagtgctattatgattattattgccatcaatttctgagcatttaccatgtaccaggccctaggatagagcactcggtgcattttctcatttaatcctcacaccaacttcattttgcagatgagaaaactgaggcacaggacatttatgtaacttgccaaggtcacaaagacagtacgtgagagttgggatttgggttcaggcagcctagctccacagtctatgctcttactatgctcttctacttctcttaataataataacaacaacaataataataaacatttattaagaatgtacttgstgtcagccactctataagataggtacttcattcccatattaaagataagaaaactgaggctcagakagattaaataacttttctgaggctgcacaatwagtaagtagtgaagcatttccaaaaacatattctgaaaaatgcagatctccaaagaaaaaagtttccatagtcatttacrtttggaaaccattgcccctctgagatatctgtggtatacatcagcatattaaagtctcacatgaatgcttcagtaaagaatcctgatcagctttggttaggcyagcattttccacactggtttaaacatggagctctaattcttccaatacctgtcaatatcccataaaactagcactatgccatgatggactgactctaaccagtctcactagacattaaccaggtacactaggctaggaggtaaagctggaaagccaggttttcatttgcaatgagaactaggatggatgagacataccaatgataccaaagaaatactcgaatatttctccgtctccagccttactttgccttgtaggtagagctgcttgggaagccaaggcaggactcatttcagggacacattatcatgcagggagggagggtaggaatagagaaggcaaatccaggagtaccagaggagcagtgccttgaacccctacatgcaggctaaactcacgtggcccctcacccagaacactgcaacagcttcttaactgggttcagcttccagctttgccccttccaatcccttttccactctgccaccagaagcagtttcaatatatatataaatctaatcatgtcagtttgctgtttcagattcttcactggatccaccatgcaattaaaacccaaactccttcgcatggtctccaaggctcgtgtgatgagcaggctcctccttactcttccaccgtggctcccactagtacatttcagccaaccatcatctttcaatttcttaagcaactatgcactctcttgcctcagtcttcacctatccttctttctcygcctgaagcattcctctccacccccctttccacatggacaactgactcctcttttgctcactgcttatgtctcacttccttcagagaaattccttattttctaccccctaaatgtgggttaggggctcctccctgatactcccctcagttctctttacttcctttgtcagagatgtctgacactgtgtcataattatctgtccacattttagcatctactgctgtgcgtttacttagttagtagttattagacagttgcctaatcaacatttatacccatgtcttgagtggcaacataaaatagcacacttataacattcccagaggacaagaagctagggagaatattaaatatattaaatgcatacttaggggttaaaatgatcttaagagcatgggacagtgagccaaattcaataagaagaaatttaacccatgcaaagtcttaatatcgaactaaacagaagaaaacaattgcacaaataaatatagccaaatagcaacatgagtgggtgacttgtaggggcctcaactgaattttgatccattgttgctagaaataacattagaatgtgttttaagggaggctgaggcagggggattacctgaggtcaggagttcaagaccagcctgaccaatatagtgaaaccccatctctactaaaacaaaaacaaaaacaaamaaattagccaggcatggtggtgtgagcctgtagtcttagcaacttgagaggctgagacatgagaattgcttgaacccgggaggcagaagttgcagtgagctgaaattgcaccactgaactccagcctgagcaacagagcaggactctgyctcaaaaaaaaaaaaaaaaaaaaaaaagaatgtgttttaagggttttgctttatcagatgcataatataaatcaacagtgagttaagagtatccaagacactgacaatatcttgatktgaaataatagactgtttattttaaaagatgtaatggtctcttttttttttttttacagaaaaaccacaactagagtaatgtacttaattccagaaaataacacttcaaaagagaaattgacaaagtggaaaatattccaaaacagagcgttggataaaagttctagaaataacttcttaaaaacagttaaataggctggatgtgatggctcacgcctataatcttagcactttggaaagccaagccggcggatcacctgaggtcaggagttcaagaccagcctggccaacatggtgaaaccccgtctctattaaattttttaaaaatacaaaaattagcggggyatggtggtgagtgcctgcaatcccagctactcaggaggatgaggtggggaggattgcttgaacccaggaggcagaggttgcagtgagccgagatcgcgccactgcactccagtctgggtaacagagcaagactctgtttcaaacaagcaaacagttaaataaatgaagaatgttttactcagaaaaaaaaaaaatcctatgagcagtctttaaatacctagagagtgccagctaaaatgaataagaggacttattctatatttatctagaagtcagaacgaggacccatggttagaaaaattacaaggaagcagatgtcagtttatcttaagagaagttttcaaataattagagttgtttaaaaatggactgtttgccctatgaaaaaatgagttccctgttcaaatggaagctagaagcccaagtagtagggctctcatgaaaatgtttcatgcagggtatagtagttctaccagatggctgagaaaatgctattgctgttctgtgagattctgtaaggatgtaatatcagtatattccttccattggtgctggtaaacggagaactgatgaaacccatttctaaggactttggtgtttagctatttttaaaaaaaaaaytttaaagcccctgtgctaagaaagaggaccagaggagttgattgctaagctccttttcaacaggaacatttgtgctcctccagctcattcttgggctggtttatcacggrgattgtggtcttaataagaccagaggacttaggagaaaggcagcttggaatagagaggtctagagaattaaacatctttagctcacagcataatgsaaagaaagtgcccttcaggggaacatgtatacaacagggttctgagaagaggtaaaaataaaactgcatcctgcactttctgcttgccgtaatgctgcagtcagggtaacccggggagcaccacgccctgtgaaatggctgtcacagtttaggggcagtgagccacagtaagcctaggacccactatgtgccaggcatagtgccagacccactgcaccgttatctcattgagccttcatagaccttctcagggtattagtatcctcattttaaaataagaaaattcagattctgaaaggtaaagtaccttaacgcagtaattttgacacctgagattcaaactcaggattgcctgaactttgaattgctcagcagtgtttcaggaactcctggactttaggaccgaagaggatcttaaagagcccaacttcttggttttgactatggaacacaatggggtccaaagggaccaggcatcctgcacaggatttatgtgtggaggtaaaggaagccattcgactatggcaggagatgccccggcatgggtacaagctcagcaactgtgctttctgcgcacatggtgcttatagccatgaaggcaaatcatgcatcaggcaggggcagggagggggagggcaagaggccagggcacccctgccgacccttctaccctcccaccccaccttctccccaataactctttacaatgccaaatgcacatgcagaaaccagtctctagactagatcttctaaagtacagtgaggacagggagttaggatgacccccactttcagtcatcattcatagaggggaaggggaaaagggcaggaagagagctgactttcatgtgtcagaccctttgctaaatgcttgcatacgtgtcatctcatgccgtctcctgtcacattcctgtaagaagtggaacatgttaggctatgaaatgaatattagtgtctccattctatgatgaagaaatgaatttaagtcacacatacaaagttagacaactaagaaacatgtgatttacgtttacactcctgatgccacaaatcaaaagaaaaacctgtgaatgttggcatcagacagtccaggttttgacttttgaactggcccattagtagctaaggaaagctgaggatagtttctgtgtcactgaaaacaatcacacttayctcatggaaatcttagtgtcctttctccagacctgctccctctctttcctgcatttgagggatgagatctacttttagaattacagagggaggaggcatttgaccctttttgaggtaaaaggagaattttagattaatggctaactttgtccttcgaatgtccccttgaggctttgtcagatttgattccttcctttggaaagataagaaaattgaagtggctattccctgcttctgcctggttagtcacagagtgaggcagtgacatgatgggaagcttctaacataacgaaaactagcgtgagactgagaacctgaagacttcaactctggccctagcttctctgtatttggatctcccagacaggcatccatctatcccacagtgagtgccttgtggtctgaaacgagatcaaaggtggaaaaagctttaaaaagctctcttcaaaaacaagaatgtcacaagaggctgactctcgagactgtgttcccctacccctgcctcctacagagtttcattcagcagaccttgctacctgccttcttcagggaaaataatcttgtttttgagtttatgtttaaactaaagttagttgattattttcttcaacccttgtttttcttgttcatagagtttcttaatgtcacgagcgttcacctgttcaaggagagatgggacactaamaaggtggaccaccacactgacaagtatgaaaacaacaagctgattgtcygcagagggcagtctttctatgtgcagattgacytcagtcgtccatatgaccccagaagggatctcttcagggtggaatacgtcattggtgagtgccatgtgcaagctccagtcttgacaccatgggttgcattgtagagagaggtgggtacaggcacagttgtgtgatttcctagtgtcatatgtcaacagtgkcaggagctggaatgacatscagcccctgaattaccctgtgctctaagactggtctgtatagtgccaaatattgataacttgggcccacccaaggagaaaatctcatataaataaaagtaaaactggtataatgtgttgcttaactaaattattcttcctcaaacaaatggttttggcatcctatgattctaacttttatctccatgatttaattggtctcgtgctgaaaatgtttgtaaatcttagcatgcaatccaagtatgcattccgaaagttgattctgctctgatctagtcccatgggatggcccgtgaaaaatatagtccaataaacttcactaaacactttgtactttaatcacccttttttttttttttttttttgagacagagtcttgctctgttgcccaggctggaacagtggtgtgatctcagctcactgcaacctcttcctcctaggttcaagcgattctggtgcctcagcctccagagtagctgggaccacagttgcacaccaytacgcccagctaattttatgtatttttggtagaggcagagtttcaccatgttgtccaggctggtttcgcactcctaacctcaagttatccacccacctcagcttcccaaagtgctgggattgcaggcatgagacaccatgcccagcctttaacctcctcttgaagattaacgatgcacattagcttcaaaggtctggggaaggaccatttaactttggtctggtgcttcttaaattaatttgatcatggaacccttttattaagttatagctattaacttttgacacattttggtaaacatttctataggaatttataagattatcaaggaaatacatgcacagagaagcaggggtggcacaacataggaaatctgcccatataatcctatgcacaaattaaaggaaaaaattaggcaatcaaatcagyagtcacagaaaggtacatggtaaaattcagcatccagttttaggaagagtttaaggggaaaaatttagaaaaaaaacacctcaatgataataaagattgcttacatcaaaacaacaacttttgatatctaagtggaaaaaagttaacaaatttcactgtaatcagaaattagaaagaaatgcctgctatcatcattccctttttaaaaagaagtactttaaaggytttagtaaatgaacaatgtaagagatacatctgctataaatgctggaaactaagaagtaaaactatatatttgctaatactatgattgtgtatgtagaaaacccaacagattcaagggaaaaaagcactgtattaataaaactttgtaagttggctagatagaagataaatatataaaaatcaataacttttatcttccccagcactaagcacccagaaatagacataaaaaaatttcacatgaccaaaactataaaatgtaggactaaaacctgaacacgcaacctatataaaccagctattaaatcttaataaaaaacatgagaaaccaatgaaaagtcaaacatgttcttgagtgggaagtctttctgtatacatttttagtctcccaaggggttggtcaaagaatacaaaatttcagttagatggaaggaatgagttttagtgacctattccacagcatggtgactatagttaataataatgtatatttccaaattactaaaagagtagattttaaatattctcaccacaaagaaatggtatgtgaaggaatgaatatgttaattagcttgaattaatcaatccacaatgtatattttgatcaaaacatcacatattgatcaaaacatcacatcccaaaaccccataaacatatacaattatgattgtcaatttttaaaagcctcccaaaattaatatgtaaatttaatgcatttccaattagaatcccagtggagttttgagttgtctttggctttggttttggttttttggacttgtataaaataatcttaaagttcatttgaaataataattacctggtgataaccaaggaaatcatacaaagaaataataagtaagagtattttctttctgaagcggctatcagaacatactatgaaaaatatttagtaggacataatagagaatccagaaatggatttcagtatatgagttaatatgattgttggtttcatgaagtaagaagaccatatgagattttawctgtttgcttgtttgtttttacataaatgatgcagaaataactgactctccractggaagaaagtttaaaaattgaccctcatcttrtcccatatacagtagtaaatctcagatggaatgagtattaatgtaaaaaagacaattttttgaggaaatttaacagacttaactaaaaactggaaactctgacactgtagaagaaagcaagaaccatgtacagttatgtgccacatagcaacatttcagtcaatgacagatyatgcataggtgatcttatgagattctgatggagctgaaaaattcctgttacatagtgatgtcatagctatcataatagaatagtgagattacttatttttttaaatgtactgtagcctaagtttatagtgtttataaagtctacagtagcatgcagtaatgacctaggccttcgcattcactcaccactcacccagggctacttctggtcctgcacgttccattcatggtaagtgtcctatgcaggtgtaccattttttacttttyatattgtatttttactgtactttttctatgtttatatataaatgtttctatgtttatatataaatacttaccattgtgttacaattgcctgcagtgctgtattcagtacagtaaaacacactatgagtctgtaacctaacagcagtaggctctgccatatagcctaggtgtgtagtgggctgtaccatctttgtttctatgatgttcacacaatgacaaaatcacctgcctaacaacatattacatcccgtgcatgacaacaaattcacgtttgaagctctggaccacagttctgctgcaattatgagggaagttttatctccatctttaaagccaaatatttagggtggggagaagaggagagggaagcttcaattctgaattggacttgtctgaggtttgaaacactctcataggccgttcagaaaataattatgataatggaagtcttagaaaaactggtaagatgaatgtcttagatcgggttactaggaaataaactctgagaagaagacttgtgcgcagaaagtttactggggagatctctcaggatcaacatctgcaagggagtggaggaatcactgttggacagagggaggagttgaactgcagtgcagacagggcccccgtggatctcaaggtgaactctagctatgggttggatcttcagagttgtctcgccttgagccaagggcatgggcctgttataccttttataccttgactggggttacagccttggtgtaattggttctctgtggctgagggtaacccctgaaagcaactaaatgaatgagaattgtcagccaccaacactcccaacaatgggaaaggtccaggcagcccaccacagcatccattacagtgaacattttaagtcctcttttcttttttacacaagaaatactattacttttgttccctcaataaaagagggggaaaagcatagctaatttgtttttgagataaaatctgtatatttttaaaccaacatgtattctaaacctttcagaacccatgatgtgtgcgttcagagttaagctgtattctagtatgtgtgggccattacagggccacatgtatttgaagattttctattataggtcacacacatttgaagatgtttcattgcccaacctgttgtagatacaagaaaggcaagtgacaaaattccacactctactatttagtgtagaaattaagcacacttcgaggggcgtggaaggacccatggtagaggatttatcttgatcagagtcatttctgcatctcacatcattcaggaagttacatgagagcctcaacttcatggctgccatagttgtaagacaggaagaaaaaagaacattgctggggaaataattctcttaaaattcagtgcctgtttcaataggactgaataaagccaaggaaattagattttaaggctaattgctataatgagaagagacaagtatagaacgtgaactagaaatgaaattaagtgcaaaggtttctatatacaggtgcacctcaatttccagaaactcagaaggtaaaagtgatggtttaaaaacgaaaaagaatataatttctattcatttttaaaaatctggcaacaccatttcaagagaagatccattttagctaacgttttacaatcagctaaatgtctaaacatttgagatatcatttactattaaaagtgaaccaaaatgtaacataaattaaaaaaaaaaacagacgagaataaatactttgttaaaaataaagggcacttaaaagaatctcggggggaggagccaagatggccgaataggaacagctcaggtctacagctcccagcctgagcgacccagaagacagtgatttctgcatttccatctgaggtatggggttcatctcactagggagtgccgcacagtgggcacaagtcagtgggtgcgtgcactgtgcgcgagcygaagcagggcgaggcattgcctcactcaggaagtgcaaggggtcagggagttccctttccgagtcaaagaaaggggtgacggacggcacctggaaaatggggtcactcccaccccaatactgcacttttccgacaggcttaaaaaacggcgcatcaggagattatatcccgcacctggatcagagggtcctacgcccacggagtctcgctgattgctggcacagcagtctgagatcaaactgcaaggcggcagagaggctgggggaggggcgcccgccattgcccaggcttgcttactgaaacaaagcagcctggaagctcgaactgggtggagcccaccacagctcaaggaggccagcctgcctctgtaggctccacctcagggcacagacaaacaaaaagacagcagtaacctctgcasacttaaatgtccctgtctgacagctttgaagagagcagtggttctcccagcacacagctggagatctgagaacaggcagactgcctcctcaagtgggtccctgacccctgacccccaagcagcctaactgggaggcaccccccagcaggggcacactgacacttcacacggcagggtactccaacagacctgcagctgagtgtcctgtctgttagaaggaaaactgacaaacagaaaggacatccacaccaaaaacccatctgtacatcaccatcatcaaagaccaaaagtagataaaaccacaaagatggggaaaaaacagaacagaaaaactggaaactctaaaaagcagaccgcctctcctcctccaaagaaatgaagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaagcaaggctcgagaactacgtgaagaatgcagaagcctcaggagccgatgcgatcaactggaagaaagggtatcagcgatggaagatgaaatgaacgaaatgaagtgagaagggaagtttagagaaaaaagaataaaaagaaatgagcaaagcctctaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggttgggttaccctcaaagggaagcccatcagactaacagcggatctctcggcagaaaccctacaagccagaagagagtgggggccaatattcaacattcttaaagaaaagaattttcaaccccgaatttcatatccagccaaactaagcttcataagtgaaggagaaataaaatackttacagacaagcaaatgctaagagattttgtcaccaccaggcctgccctaaaagagctcctgaaggaagcgctaaacatggaaaggaacaaccrgtaccagccrctgcaaaatcatgccaaaatgtaaagaccatcaagactaggaagaaactccatcaactaaygagcaaaatcaccagctaacatcataatgacaggatcaaattcacacataacaatattaactttgaatgtaaatggactaaatgctccaattaaaagacacagactggcaaattggataaagagtcaagacccatcagtgtgctgtattcaggaaacccatctcacatgcagagacacacataggctcaagataaaaggatggaggaagatctaccaagcaaatggaaaacaaaaaaaagcaggggttgcaatcctagtctctgataaaacagacttcaaaccaacaaagatcaaaagagacaaagaaggccattacataatggtaaagggatcaattcaacaagaagagctaactctcctaaatttatatgcacccaatacaggagcaccaagattcataaagcaagtcctgagtgacctacaaagagacttagactcccacacattaataatgggaggctttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaacggctcaactacatggaaactgaacaacttgcccctgaatgactactggatacataatgaaatgaaggcagaaataaagatgttctttgaaaccaacgagaacaaagacacaacacaccagaatctcagggacgcattcaaagcagtgtgtagagggaaatttatagcactaaatgcccacaagagaaagcaggaaagatccaaaattgacaccctaacatcacaattaaaggaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctaacaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaatttctggacacatacactctcccaagactaaaccaggaagaagttgaatctctgaatagaccaataacaggatctgaaattgtggcaatgatcaatagcttaccaaccaaaaagagtccaggaccagatggattcacagccaaattctaccagaggtacaaggaggaactggtaccattccttctgaaactattccaatcaatagaaaaagagggaatcctccctaagtcatttcatgaggccagcatcatcctgataccaaagccgggcagagacacaaccaaaaaagagaattttagaccaatatctttgatgaacattgatgcaaaaatcctcagtaaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggccaaaactggaagcattccctttgaaaactggcacaagacagggatgccctctctcaccactcctattcaacatagtgttggaagttctggccagggcaattaggcaggagaaggaaataaagggtattcaattaggagaagaggaagtcaaattgtccctgtttgcagacgacatgattgtatatctagaaaaccccattgtctcagcccaaaagctccttaagctgataagcaacttcagcaaagtctcaggatacaaaatcaatgtacaaaaatcacaagcattcttatacaccagcaacagacaaacagagagccaaatcatgagtgaattcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccagtgactttcttcacagaattggaaaaaactactttaaagttcacatggaaccaaaaaagagcccgcattgccaaatcaatcctaagccaaaagaacaaagctggaggcatcacactacctgacttcaaactatactacaaggctacagtaaccaaaacagcatagtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaattggatcccttccttacagcttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacaattttacactgttggtgggactgtaaactagttcaaccattgtggaagtcagtgtggcaattcctcagagatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcacaggtgggaattgaacaatgagaacacatggacacaggaaggggaacatcacactctggggcctgttgtggggtggggggaggggggagggatagcattgggagatatacctaatgctggatgacgagttagtgggtgcagcgcaccaccatggcacatgtatacacatgtaactaacctgcacattgtgcacatgtaccctaaaacttaaagtattataataataaataaataaatttttaaaaaaagactaaaaaaaaaagaatctctaccagtacatctttaagagtgtttataacaagagacttaccaacaaagattgacttactgtcactcactatattagtcagtgttctcttgagggacagacctaataggatatatatatgtgtgtgtgtgtgtttgtacatatacgtgtgtgtatatatatatatgtgtgtgtgtgtgtgtgagtgttgtgtgtatatacatataaaggggagtttatttaagtattaatttatatggtcacaaggtcccacaataggctgtctgcaagctgaggagcaatgagagccagtccaagtcccaaaactgaagaacttggagtctgatgttcaaaggcaggaagcatccagcatgggagaaagatgtaggctgggaggctaggcccatctctccttttcaagttttkctgcctgctttatattcactggaagctgattagcttgtgcccaccagattaagggtggatctgccttccccagcccactgactcaaatgttaatctcttttggcaacacctaggattaatactttgtatccttccatccaatcaagttgacagtattaaccatcacactcactatatacttaaaaaaactttttttttaggttcgggggtaaatgtgcaggtttgttatataggtaaaaacatagctgtttcataaagcaagctattattatatttaaaatacagaaaaaataactttatacttagttgcttccaatttgcattcagtttttttgttgaggttgctctctcattccctgtgcctgtatagatgagctgagatatgttagtacactggagtttccctatgttgctgttctcagaacctaggtcatgggatttatttatgtgattctgccttctaaccaatttccttctctccctccctccctccctccctccctccctccctccctccctctctctctcactccctccattccttccttcctccctcccttcctcccttcctcccttctttccttcttccttctttctttctaaatatttaaataaatagggctcttggatggtgtgctgggctctgagtagagaaggtgagcaggagagctactgccttacctggccacggcttgatgagctgtgctgcaggggttctttgtgctttgataactgcgttcatgagttgctggcagagcacagctatctctgtgttaggtgggaggtgttaatgaatctgaggaggtgggtgtggctgaaaaatgccctgggagtctgcagggccttctctctctctcacctctgagcctgcagcctcgacaaatcatgaaaggcaaggaggggagtggtaatcacaggttttactaacctgtggctgagrctgtgaaagcttgggagcagcttctggtgttaatttgctgttactttgacatgggcccctgcttttttgatacccagttgagggtgaaatcccaagctgtatttcttaccaggtctccccctcaaaacggcagaggtttcactccctgaggagccctccgaagtgacagtagggtccatgagcaagtttctttctccctggagttcaaccacaggaacctgggggtgtccaggtcagcgctttggagattctcctgacctttccctcaattctatgatggccctcacagattcaagcttcacatttctggttacagcagaaagatgaggagaaggatggcattagcatgccccaccccacttatcaggaaaacaaaagctttcccaggcacttctggcaatcgtttatgtttcatttgctacccttagctgtaaggcaagctgtgaaagtattccctttttccagtctcttcagaggagagggatggggcagagctgaaagtgggtgctggtggacccgcagtcatgtgtgctgggcatcccccctagctgggccatcctgtgagtataaaagtgctgtcctaatgctggcagccttgaggcaggttgttcatcacccgctcaagcatttctaggactgggtcaactgcacatgttctgcatcacaaaccctataaaacatggaaatgtcatcagcaacactttaatatctttctttcacttatttcttgagtagcatttatggaaagccagcggcggtgttggatggtgttttcagggtgggagtgacatggatgattctcatttgagatagcttgctctggcccacttcagggaatcagggtaattcaggataggagaggagatgatcagaagagagaggatgagaaccggggttatggctgcagttgtagacatggacaggagtgacagggtttgagaaatayttaggaggcaaaatctgcaggayttgtgttggggagtctgtgaggggtggaagggaggagggtcaaggtcracttccaggtggctggcttatgtgactatgatgacagatgctagcacttccaaatgagataaagaatgcctggaattccagaggraaaaaatcgagtgtggaaaatgctaatggaggtagtagcttcattgataactcattggcactgktgctgtgcagaggtgctgtatgcctcccatttaattgttcaagcagccctctgggcattggactatggccatctccatttttcccatgagataatggttgaaaggattaagtaatttacccaggtcacacctggaaagtgctgggacctcaatttggacccaagcagcctcttctacttacaatgcttactacctccaccragggagcctccaccaaggagatggtggaggtatgaatatgcttctgtttgaattgatgagtgtgaattasttgagggactttcaggtaaacctgtccaatagayaatatgagtctgaagcttcrggaggaggtttgggttggacaggagataatttggatatcatacacacgtgggcaagctcactcagaaaaaggtaaatcaagtcagcagtggactgaggcttaagccctggggaaaacaacttctaaggcatcagtccagaaactagagcccctggaggagacaaagaccaaatgagcagataaacagaaggaaaataagggggttgcagtgtcactcaatccacgagagttgtgtgtttcaagaggaaagcatgaccaatgttattaaatataactaggagatgcagtgagataggaacttcccactggagtcaacagttgggggacactggttgaactcgggtagattccaaattttaatggtctaaaagtcaaggagatgtgaggaaatgggtgtagtcaatttggatgaatctttaaagaaatttgaaggagaggaaaagaaaatttgggtggtaactagagaggaatgtgggtgagaggaggggtgtttcaatttcagtatttgtttcaggattggagggactggaacatgtagcaggcagagagggaagaatcagtcaaggaagaattctgaagattcaggagggactggaggagaagcatagaggacaggggcacgggtgaggggctgagtaggaaggaaaattcctcatcttccaaggttgtcgagaaagaggtgaaggagggtatgactgccgtaggtggagaagtatgaactaagcctcatgcctgacaatctcaagttatttaaagatgtaggtggtgagcaggtgctatagggtcttagaggggcagatgagtacccttacatctgaaaacatcatccatatcctttaagactatgtcttcctatggattttgtttcagaaagtccaggtaaaatcatcatgctgatgtgtgattttcacatacataacatactttctctattgagaaatgtcttgccccaaactgtgcagcttgtaacgtgtagataactatttcttagcctrtactctttcaactattttgtgctgcattttggtgaaaatagacagcctatttcatcattttgaagcaacatttatatagaatgtcatttcagatttttgctcctatgggtttctgcattgatgatcaacgtgtttatttttaagcatctctgtgaagtgactaataatggcatctaagaaagtaggacagtgtttcccagagtgtrttctctatgaacacctgtcatgtgagattctccttgggggaaaaaagttccatcrtcaaatayagttggatcatgctgtgttttgtgtctcttctcatagaggcccaaggcacattaatatataaaaggctatgagtagacacgtagtcaaaaaatgaatcttgtttagcccaataattcccaaaattgttctactataaacactaccctaccacatttttatttttataataccattgaataaggtgcagaactcattccaggaaatgctgaactatagaggcatattacctctattccatacaacactgaggcaggtggctgacagaacttgaacagatttgtagtctatgtgttgtgataactttatatccattttttctttttgacacttaagattttgtgcaaacattgaaataactattaatttggcattcatatttagtaacttttcaaaaataattgttaagagtatgtttttatatttatttttcagatatttatttggcttctttcaaccataaagcctatttattttctttttgaatgtgcttattgaactcttatttaatactttgtatgtgcaaagcaccatattgggattagagtagtaagatatgttcatcccttgcctccagaggatttgttgtccagaggggacagtctgagtaggaaaggctgtgttcaatgccaaccttttgaacaaaatgcttagaagctactttggagggagtgactgatggcaagaatagttgaaagaatcctccagaaagtgctatttgaggcgggtctcaaaaaacgaatagaaattgacccaggggratggaaattgtatacattctagaaaaaaaaaaatagaaaagttcagtggagcatgacattttggaagcacactgatgtctttgtatgacttgataagaagtttagatgtaattctataaacagccagaagcctctgtagtagcattttaggtagagtattaagatctgatttttttctactttttagattactatagcagaagtgtggaagataaattggaggamcgagattttgttagggacattagtaagagactcaagggggaaaaaaatctcactaataaatgataggataaatggatgctgcatgagtttgtatgatttttcccctcctttttttcccccaaaggaacttatgtttacttctataactagaagtagtaaaatgtgtgtgtgcgtgtgtgtgtgtgtgtgtgtatttgcatagtaaaatgggactcacctgtagtgaagtaacacactgtggtctgaggactaacaatatgccccagtggctggccctctgccatttgtaggccatctcagggatgacagctcacgtgattaaagggctaaatgaagccctttttggtggggaaagaggsggcttggactcaaggcagtgcccagtcagaacccgagctccaccatggatagcagtgacagaatcactttaccccaccccccatcacattactgtttcctcacctgcaaataaggactatactatttattttaaacagccatttatgggttaaaggagataatgtataggaaaccacttttttattctcacaataaactgggaggcagggaaggtagaaataaaacttattaaaaacatggaaaccaatgttcacagggattaagtgatttaccccaggttgtgggcaaaggatctgagcaaacatttctcaaaagaagacaccaaaatggccaactggcttatggaagaatgctcaacacctctaatcatcagggaaacgcaaattaaaaccacaatgaggtgccacctcatacctgttagaatggttactaccaaagagaatgataacaagccttggcaagaatgcagggaatagagaaccctatacactattagtgggaatgtaaattaaggcagctgttttggaaagtcgtgtggcagttcctcacaaaactagcaatagaactaacgtgattcagcaatcccacttctgggtatgtatctaaagaaaattgaaatcaggatgttgaaaagatgtatgtagtctcatgttcatttcagcatcactcacaataaccaagatatgaaagcaacctaaccaatggataaagaaaatgtggtatatagacacaatggagtactatacagcccttagaagaaggaaaattctgccattctcaacaagggtagaactggagagcactatgctaactgaaataagccagrcacagaaagatgaatactgtatgatctcacttatatgtggaatctgaaaaagtcaatctcagaaacacagtagaaagttgtttaccagaggctggggcttgggggcaaggaatgaggaaaaagaagatgttgatcaatgggtacaaagtctcagttagactgaaagaataagttttagtgatctactgcatggcttggtgaccacagtttaaaataatgtattgtatatttcaaaattgctaaaagaatagatttttaatgtcttcaccacagttacctttcttttttccatgtacatagaaaagaaaggtaactatgtaaggtaataaacatgtgaattagctgattgaatctttctacaatgtatacatagatcaaaacttcacattgtatcccaatagattccccataagtgattgtctattttttaaaaaacatctacacacgcacaaagaaaatgcttccaaaagcaaataggagggcattgctctcatgtcttttgtctcctggtggcaaagacaaccatcactgaacctcccaacagaaatacccagtctccttgttacatccattctgacagcttcattagtcacataggggctctgacaatccacaggccaagttctgcctggaattatttgcccatagttctagctgaagtgacagaaacagtttaatctcaaagtaggtgggattgccatccatattttggtgccagagaccttaccatgtgcttcctcagccctgccctgtcacccacatcatgtctgcagagctggagtttcccagtgaagcttatggtccctagggtaatagagtcgctgatgtctttgtcacattaagggtgccacacagagcacttatgaagggccatgggtatcggaatgagaacactcagaacatccacaaacgcttcctccctgactgcctcctgtgctttctcccctctttcctattcccctaatttgccttcacccttgctcctatgtctgtttctctctgtcttcacacttgtatcttatgatgacctctttcacttacaagaattcataaacgtggctcatttgcacccacataattgaaactgtactccaccagaaagcgctggtctgaactcagggaggacggactgtgggcattccctggcttttccacataaattctaagacattcttgcagcatatgaagcaagaggtgaaaaaggtgggggaaaatatttaatgaaaacaaatgtgcccactgcgataacttgctcttgagtctctaatctaaaaagagagcatgcaagtggaattacagcccactaaagaaaggatccaaatggactaaatattcttcatctttgccctccagttactccagaagcatgttgtaaggattaatgagggaataactggaagctctttgaactgcttcgtgatagttccttcctaataagatgacccaattaccagscttattttcaatattgcaactatgtaggaaagctaaattcttatggtattccttaaggaaggataaccttcataaaatgctactataacagcagccagagccagacaggtattacacaaccataagacaggctataaatagctgtacctctctcttgctaccctcttcaccctctttcttctcagtatcttggcctcttttctgatcttttctcttctttcttaagatttctattactttcatcccggcctgtctgtttctgtcttgctcttcctctctgtctgtctctcatgcatacatacacactgtcctgtggatgcacgtctaggtgttagtggcagcaaatgtactggagtcccacrgcaccaaagtatgttagcagcagtgaatccayatggatctacagcagcctcaattcttgcctcctcataaggcaggagagactggggcaagttttagagcaggagtgaaagtttattcaaaagctttagaacaggaatgaaaggaaagaaaatacacttggaaaagggccaagtgggtaacttgaaagacaagtgtacagtttgactttgacttagggtttttgttcgtttttttgagacagactcttgctctgtcacccaggctggagagaagtggcgcgatctcagcttactgcaacctccacttcccaggttcaagtgattctcctgcctcagcctctccagtagctgggattacaggcacttgccacaacacacggctaatttttgtatttttaatggagatgaggtttcaccatgttgaccaggctggtctcaaactccttacctcaaataatccatctgaaagtgctgagatgacaggcatgagccaccgcacctgactgacttcaggttttacctgttggcatacttctggggtcttgcgtccctactyctgtgattcttcccttaagtggtgtgtctgcgtgtgcagtggcctgctagcgcttagaagcggagcatgcacagtgcgtttactastgttgtactcgtgaccacttgatgcattttttccttaccagttgagtgtccctggaggaaggccacatactggttaaattccgccattttggctcttagtgcgcatgcctgagcccactcacccaactgctgaggttttattgggaagctgctgatcaccagtttcaggtatttctgtttattgggagactgcccttccctagcactggctgggaccaattattattttagaaggacagtttaacaatgaccgtcacctgatggtcgcctgccattcctggtgtgtgcgtagtgggggaagccctctcctcccctactcatgcctgactaggtacctactgtagcataggtatttactcatttgttagagaagtaatgggagttacccttgggaggtgggtctgaccgtttttgtgtctgttcatgagcatttctttagccttcaggaagctggggctggatgtgctaaatgtgctgcccatctctggctaaagcctagcttagccattgggatgctccttctctgcactgttggaggttttgctttggcttcttcaacttccttgtctatttcctttccaattctgtttacaaatctctataacatcttgtcccatgtctggttcagtgaatttgtgatgcagaaacctctgctgtgtccagcagtttgtgacaccccagagggggtttaagaggaatgaaagaccccatctctgtcttttttctttttgagttggagtctcgctctggtgcccatgccggagtgcagtggcgtgatctcagctcactgcaacctctgcctcccaggttcawgtgattctcttgcctcagcctcctgagtagctgggattacaggtgcccgccaccaggcctagctaatttattttttgtatttttagtagaaacgggatttcaccatgttggccaggctggtttcaaacttttgaccatctctgtctttaaagagcttactgtagttggagtgagaggaattccacaaacaatgaacacagtcagagagtatataattgagctatactgatacagttgccttccagaaatgtgtgacacgactggccgaagtgactctgggcagtcaagagcaagaggatcagctagagttgaagggtaaaatctcagaaaagggcagggaggtcttgagatgactcttgaggaactgggagcattccaagagggctacgaagtatgtaccctccatgcaaggaggacggcattcttggtagtccaggagcttattgttctgctgatgcaaacaagcttctagtgagaaggaaatatttccctgaatcaagtgtctggctgcatttggagtttggacaccactcagtttcaaggctctggagttgtaagaagcttgcagcggcaggaaaggcccatcaggcaggcccatgaggaatgtgctcccctcatgcaatcagtctgctgttattgcttggttagtgcccagggtggacaggggccttttgtattaaagcaattaattttacaaaaagaggaagaaacccttatgtttctgtgactaaaatgacggaaatgaagtagtggagacagctgcagtggcattttccatcaaacagcttttctatttgtgcaacatatttctaagtgatagaaaatgacacactctctccattacttcacttccatcatttccatcatttcaaccttttctaactttcatatttgtgaaacaaattgctttaaacatgtcaaagacatttgagtggagtgttagccaaattttaaaaataaagatgattcataaagacagtgcttgtgtttatagccatcaagacaaaatttcaggaaaaaaaatcacagtcctaattactgaaggcgcatgcataaggtaatcatatttggaagttagaaacaaatctctttttgctctctgcctcttttcccttagatttatatgggttggtaaacctggccttgtggtactcaatcatccttgcttcagtgattcactaagtaaccccttgcgagttgatttctccagcctctggatttatttgcattgttatgcaatgggtggaacacctcactgctgttctgctcctcagcagttagttctatcttctcttacagctgatgcttcttgaggggaaaggccaccttgtgtcttttgttagagataggatgttgccaagggtagggcaaccaggagggtatcccttagcatgtaactttgaagaatcaagattggtgctccacacaaagttcgttcaaaaatgtttctcttaagaaacttaaaaacctacatcgctgatggaaaaaaaaaaggaaggacatgaatatacaggataattgtacaaaaattgggtacatgtattgttgttgtttaaaagttttttttaaatttcgaaacaaactccactttacagaaaatttacaagacaaaccatacaaagaactgttttttcccagaaccgttattagagttgtcaatctgatgtctcgtcatccctgaatactttagtgtgtactacctatgagcaaagacattcttctgtgcaaccatmaaaataaggaaattaacactgatatttgatggtagtctaatctttagaacacatttgagtttttctacttgttcagtaatgtaccttatagcaacagaagctagtccaggatcacatgttatatttagatgtcatgtctcatgtctttagttttctttaatttggaacagattcataatcttgctttgactttcatgatttgacacttttgaacattacaaggcagtaatttttagaatgcccctccatttgggtttgactgatgtttcctcacttgatgttaaaatcaagtcacrtatctttcacaggaagattgcagaaatgatgctgtgttcttcttggtgcctcctacctggttgcacataacttttacagatcccattactgatgatgttaacttaaccactcgattaaggtggtggcacaggttgagtgcccaggaagtagactgtgaaattagcatgcaagctgttgattagggagtgctgttgggatcaactcctgtggaaggaagcagtattaggtagtgggggagtcaggctgcaatgcactcacaccaaaggcctcagatgaccctctgtgaaactctggagctgagatagctcttcatagtgctcctgagatgaggacaaagggatggggctttgttcctccatagtgatcagtcactggatgtgagccacccctggaatgaggtgtgaccctggatgaggcagttttctyctgctaaggcaactcccaaggaggcctgaaccaccaaggactattttctgtcatcactcccagcagctgaggataagcctgtcggtcatttccgaaggtgtcttgggcagaacatcacagagcccaacacagaggtgactgttggggttacccctgcaaagttattctttgttccttttatagttaataagtactttataggaaattatcttgagactataaaatcccatttattaccaaaattattattgatagaatgattgattaatacctggatgaatcctgattttctcttttaattaaataggttacttaaatcttttattatcattaaataacttaatgttcaaacagcctcgattttgccagttggactgttccaactagtttcagtatccttacttcctcatagtctgttacagtaagatgtttcaggcccgttttgagttttccctgcacctaccctcaaaataaccatttatctaaggagaaacatttctccaaagaactccacttcattttaatagaaagtagtatttagaaaccaaggtctagatcctaggtgtgctcattagtattttacctcctttcagtatttcccaattcaacctaggtatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgmaagctctgcctcccgggttcataccattttcctgcctcagcctcctgggtagctggggactacaggcgcccgccaccaggcctggctaatttattgtatttttagtagaggyggggtttcaccaagttcgccaggatggtctcgatctcctgacctcgtgatctgcctgccttggcctcccaaggtgctaggattacaggcgtgagccaccragcccggccgtcctccatacattttttatctttgagcttgtcatttactgagtcttcacaatgtgccaacagtgtgctctgtgtttgcattagttttatgttgctgttgtaacaaaatatcataatcttagtggcttaaaacaacaaacatttattattttgatataaggtataatgatatataaaaggtgtaatgacatcttaactgagctcctcctacctagtgtcgtcccttagggaggaatcagtggaattcagatcctgattattctggctctaaatggtccagaataatcaggatccgatggctggtcctggtatacctggtctgacactgggcctgggatctggaaaggtcttagaagaaattacattgagactgtaaaatcccctgaggaagaagacaaggtcttcagaatgtgaagtaaagagcatgccctctcccaattttatgcaatgagtgaaattctattatggcaatttattcatttaagatatgaaggaattattttctacaaagtgtaaatatggaggtaagaagaagtattagcactcttcttagacattaacattttagcaaaatgaatttattagactcttgccattaactgttagctgagaccagttcccttagaacgagttgccaaatgaccgttttcatggggagccatgcgatgttcaatgactaggtgctgccagggaaggctggcccagctgagtcccaaagtgaggattctccagccactccgcaaacagtatgaaactccagggtacatgcttaaagcactctggaatttaagtagtggcagatgttttagaagaaattccactgtgccactttccaaagcactggaattaggtgttatttacggaaggcaatattgtaccccttcaagcccacaaataaagaggtactcagcagtgacctttattaaaggcaaatcagtggggaacacatgaccagaggaaatgagagaagattggaatatattctaaggccttaaaaagatgtcaagaacaattgtgttcccccacaaggcatcmttaggcaaggatggtccaacctcaatacggtttctttacatccctgtgtttcagctacatccgtggtctcytgtattgtttatctatgtcacttgcaaaaaactaggcttgaatacagttttttaaaagtgatgcttttaaatataagcggtaatcaacttatgaaggaacaatgaacatctatagtaagcaaataaacatccacacataaatatacatatgaataaacaaaatgcaaatgtgtgtcattctttctgccagtcctttgagttccatatttgttgtcatgtagttaataaagtcgttgacttcccccacggtctactactcttgctctgttattctcatgtggcattagtattatgaattaaattacagtctaaacttgcgtatttaattataaacccattgagcacaggaaatgtatcatatctcagcacattcaccaccctgtctcctccagattaagtggtatcactctgctcatcataagcactagtaaacatctgtttaaataaatgtttattgagtatgtattgtaaatatccacttgtaggttaatactagatggactgtaccatactccttagaatgttttctatgttgatttttgtttctccartaattgctttaatctctggcaatgcaaactcatttaacacttgcttttatatattgcattcatatatactccaaagacaaacaaatgctttatcagaattaccagtgatttattctcattattgttgccattcaattattaacaggaattgactgttttagcaaaaatgtcatcagttggcctgttttgtttggaagacattcagctaaactttttcctttgttggctaatgacactttattttttaagtcagttgccatgattttaacgaaatgagcctttcttgtaaaacctagaaggctcattctgctcatataatggatggaacacaagcaaatgagcaaatggtgctttggctccatagacttgccatttgctgggggaaattcagttgctgtaggagattctttacggcatgtgttctgagctgactgagaacatgaaagagatgggtctcgaagatgctaaatgcagtgcatctggtcagtgaccttcatgttcagtgcaaagtgtgcctccccaccaagtccctctccaccccttgggcttccagaccccagcacgaggggtcagaaacccaagaaatatggaaacattctttgtcagttgaaagaattgcataacagttggggtcagatggggcaaaaagctgggtatgcagtttggtttataactgtgaaatctggcaaactacaataaattagacattgtgacaccaacatcctatttctctgtctcacatctctagatcttaaagagtttagccttcatggattgatagaataacacagtcttgtttaaactcatgccaaggaagggctggaaactgccctagaaacaatggtcatgtagatgaactttgtgcttctggtggccacattttttataccatgtcccctgagcaagtttccctatttccaacctccactttcctccctatttccaacacccagttccagcttttaggaaaggtacatagtgcagtaaatttaagcaaacacattgcctttcccagggatataaacatttcagcatcatctctaatttctcttctgttggtaggattttcattaccaacaagcaaagggggaatattgagaggtcaagagatcttcatagcaatcctgattgctctcctgcagtcttcacagaacaaccaaagtgattttttaaaagaacttaaagcagaccatgcctcttttctagtgactgcttttctcaatcagaataagatccaaagtcctacaaagccctgcttgatctggctgtctctgacatcatcttccatggtttcccctgctccaggaactttctcgtctcccacaattcccctgctcaggcactgtcacctcccacaattccctctgctccaggcgtctaatctcccccaattccctctgttcaggcacctcatctcccacaattccctctgtcccaggcatcttatctcccacagttccctctgctcaggcacctaatctcccacaattccctctgccccaggcatcatacctcccccaattcccctgctcagatacctcacctcccacagtttctctgcttcaggcacattggcctcctcaagcatgccaagtaccacctcccacagggtctttgcactgatgacacctgtcccctgatatttgcactgctcattccctcacttttctcaagtctcttctcaaatgtctcctctggccactgtctctaaaatagcacccccagctctgaccctctctgtcctcttaagctgctctagtcattttttcatagcacttgtctccgtttgacgtatcatgtatttatttgtttattgtccgtatactcccactagactatacactccattaatctttatgtgttgacactgctgtattctcagtacctagaacagtgcctggcacttaaatggtgcttaataaataacctgttgacgaaaaagatcctgaatcgtgccacagcaacaattacttgttaattgaaaaatcacaaatctatacatttggaaaggagtctttatttcttataaaaggttacagcctgcagagtgactatccggacaggctgagaagcacagcctctggcagaggctgaaaggtgggcacttcaagggaaaggaagatggaacaggaatttatgctgagctggttggccaaatatacatattccacaggttacaggaggagctatgaacatttatgaagagggtcttaatgtatgcatactgaataaacatgcatgttatgtgtgacccatgttcgctttggggtgagacttaacatttatatgtgcttcagttaggccctatacatcaaaaggtgaagcagggacaggaatgcattgtagtgtgcagcttcggtaaatcgtccagaaccagtccatggttgatagtctcttaccaggagaaagatgctgaaatcagtctcttacgcaatcaaaactgtagttgtggctggtggaatgtgagttagttagtcagcatctggtgatggatgaactgtagttgttccaacattgctcatcttgagaccagggcttgtttagctgctagacaaaaagaaaaactttgtggcagttagaacatagtttattctttaaatgcaggggttcatgacttaatccttgcctggtgtggccttgggtcttgtttataattatatattttattgccacagtgtcagtcttatgatctctattttaacattgattctgttcaattttgtctaaacagcaaaaggaaagggaatatagtgaggtgtgtaccacctcccatcccatcatggctgcggctcagtttttaaggtttctctggggtccccttagccaagaaagagtctgtacagttggttgggagtggggtggggataagattttacttttagttctcacaccttattcactacctgtgtggttatgctcagaaataaaaataaaataagtttagtaagatttctttgctattatagccatcagacaccatataatacggagaataataatttgttcagtttatgaaatgcccttcacacacactattgtttaatcctcatcttctggaatgccaattttacagatggaaaatgcactgagagggttcattagcctccccagtcacagctctggaccaagccgacctgggttcaaatgattgttctgcatcctgatagctatgtagcctagagctagttacttaagttacctgagcctcagttttcccatatataaaatggacataacccttaaaggtgatagagcaaatagaaactgctctagatttgtaagcagtgggagcttactggaggcaattgggtacacaagcgagtgaatgactaagaagccaaacaaacgacatggtgaggcaacccaggaattaggaacagtagaaaactgccaccacaccaggagctggaggcacayggaggaggaggtcccatcagaacccagaaggcatcagcaggtgctggagccatggaggagactcagactctcacctcaagacagagagagcacaggagacacaccctgacatctcccctcctcctgcttccaatcctctctttggccgaacctacctcgaagtcagagagcagaggagcrtgggaacatggcttcctgtggaacctgacagaagattctaggggtgcaggcaataggtctgagaacagccagtctgtcaataggtggagttgctgagacaaactataagtggttgttattcccgaatggacaacaggaaacacaagtccagattctttgactcctgttcctcctggtccttcggaattgaatgggcaacgtgaacaaatctgcagtgtaatgttatgctctgtaaccaactttgtctacattgtagaacattttctgctggttattttttcttaaagactaaaaatatcctgtcttctcttaaatgaggcaacacacatgtgggttagggaatttctagaaaactagcttcctggagtaaatttgtatcgcagttaacaacaccaggtcctaacttttggagcaaactcctcataaagcagcatgttctcccatgcttgaagcttagtctggaatctttgggttagagggaatgactgtttggttcrtggctgtatctcacttaaaacagtgcctagggccaggcacagtggctcacgcctgtaatcccagcacattgggaggccaaggcgggtggatctcttgaggtcaggagttcaagaccagcctggctaacatggcaaaattccctatctactaaaagtacaaaaattagtgggtgtggtggcccacaccagtagtcccagctacttgggaggctgaggcaggagaatcgcttgaacctggaaggtggaggttacaatgagctgagatggcacccctgcactccagcctgggcaacagagcaagactccgtctccaaacaaaacaaaacaaacaaaaaaaataaaaaaaatggtgcctggcaccttgtaggcactgaaaaactctttcaagaatgaacaaaacctggggtcgcctatggctctgcccccctacttaatgccaacatcaaatacctgttgcgtctacttcctgcttccrctggcacccctccacttaccttcccccgagagtcagtcaaagacaccatcatgcctcccttgagcacttcagcaccctctgactggtttccttgctccactcttgtccctctcaaaccattttccatcttgcagacagactgatctttctaaaatgtaatctcaccagatcacttaagcttttcaatggctcctgccccatctccatcccctccctaggacacactctacatacctttgcacagcgttggaggtccctttgctttttaccctccctgggtcaaatgcttcttctgccacaggtatcctgagtttcctgccattccctttatgcaccatcctttccttattccctcagttggttactcccccagctgggaagacttttctctaccttttccacctttaagattgtatcccaaaaccacattctctgaggaatcttcttcaacttccacagacactgttagccacttcctcctctgggtttccacactgtgttcctcgtgaccagtagtcccaggaagaggctggcatgctgtaggaatgtttaaaatgcatgcacatttcactgaaggggcttcacagtcctctttctcagaaataagccattcttagggagaaattctcctatctcaatgctgttcgtattttctctgaagttcatgttatgttcttacttcctgtgaatgccactggcatcatcctgagacagggtgtcctcatgttcacattcctgccttggttagccatctaagtggtgcacttcttaaagccagggaccaggtagtcagcatcaggtgacagccttatgatttmtttctgattcactcaaaaaacctagcacgatgctggtttcatgtatatcccacaaaattacgccttacrtttactccaaaagaggctttaagtgatgtaggaagcactgaaagaaaagtaaaataaaatcaaggtagaaaagacaccttaacaagtacctagcttccatttgccaaatatttattgagcacctactacgttccaaacatcatgcaagctgctgggtatacaaagttaaacaaaactccatctctgtcttcacaaagtttccccccaaccctwcctaagtttgcctgagctagaataaacatggccaggaaggtctcttttctttaggaaacatctggaaatatgtatgtaatctgccaatggcaacttagcaatggaaagggcggatttctacagtcctcaaagagatgatttgcttttgaatacttgtgtttctctcctcttagttgctatcatccatgatttctgygcctttttgattgtttcttttttggtggtggcattttgtttttgtagctggtaacctggtatttctaagagttattyggtgacttattcccacttggtctcagcacactccctttccatcctaagactgttagcacaagttttgcttccttttccaaagcaactgtattcacacttccagcgctgccacatacatcatgctgttaccttcatacttcaagggcccatttggaaatagattgattattttgaacatgaaaggtgcgccttgggaaaaacaaatgaatcaaatggaaaaatgaattaacatcatgaaatttaccttctcagctgaagacatgatagattcctgtgttccttagagacagtcctcttataagaatgaactcttaagggaagtctgcaggtagatggagtcagggctcagcttaaaatgtgtttatataagaatggaaaacaccctctgaggaagaagcttagaaataaaaaagtttctttcttgtgaggggtgcttggattgaacacccagattgctgtgggcatctcattccagagcttctaacatctctatgatgatcttagtggggcttgccatttgcagagagctcagttcagcctcactgacatttattaggtaccgactgggtacaaaacactgtgacattctatgggagctatacagacatattagacaatgtcttcagttcagtttaacaagcggaatagatatctaagtgaataaggagaaaaatgtttgtttgggcttttctggcaaataattgttataggaaaaggggtctcgatgcagaccccaagagagtgttcttggatctcatgcaggaaggaattcagggtgagtcacagagagcagtgagaagagatagtttattaaaagctgctccattacaaagtagggtatcctcagaaagcaagtggaggaatgcgctgtcattgttttaagcttttcttacataggagtcttgtctatgtaaagactaaacaaagctgtgcttttgtgtgggtaggatgacagcatgacaaaatttattattctattgatttaaagaaaactatccttgacattttagtgtgtgagtatatcaaagcataactgtaattctcttgaaagtatatatcattatgggtattgggacatctggactttctgttgttgtaggagtttgtccttgcaggcattactaagttgtttccttagctgtcaacatcttaggaccatgggttttgactggcaaggaaagtgccttgctagttttcagatgcagttgatttaaaaaggttgtgaccctggctctcctacgttcgtttccctaacgatatggccagaagtcttcttattactaagtatagcatatgaggggcacagactgcagccactggacttacagatgacatgcccaaaagaggagagaagtgggagtgtcctgagttatcagcttctttattttggagcacgagagggagcagtgattgatagatgtgtctactcagtcactgataccaaccctccttgatggcaagtatgttcttccaggtcctaggcatgagagaggtggagtcagaacagttctattaggaacaatattcaaccatactgaccataccatgtgctatttgatgtcctttctagactacctgggaacctaatcaccacctaggacattgtatttttaatgtaaaaatatttcaaagccatcaactaacccaaaagattaattttttaaaaggcaatgaattcttctagtgggcactaccaatgcagggctttgcgtgcagtgggctctctggtctgtggaatgcattgaaaggttgagaggacattttccccagggtcacatagcactgaatttgagctgtggctagatttctctttcctatcttgtgaagaatactaatatcaagaaactgtgcacaaagctcaatcaagcctaggtagctaaggttggaaaagagtaacrtcacaaatggaattaaagattttcatcttcttcctcctacatcccagctggggggattaaggtaggtctgtgtaaggagagtgaggccctcagtaaagggacaatgagacattcgaatataggcatatggtccaagcggcttttgccttaaaaacattagttttgtggcctcaataataattcacaaatggaagcaagcactgaaactaagagcatatgttaatttctagatcacttgggaagatggcactagtttttgataagtgtgaaaaaatgcaattggtaattataatatttcctcatgtttagtagtccaatttcaaaggctgcaattattaaaaacaaaacgggattcctttcttggatgctgtctttcccgatgtctttttcttgccctgatgtttttaacgcaaagttgcatgatttgggggagaaaaacacatctatccaggcattatatactctaggcaaacacgtgcatggaggttccctgtatggagccatgttttccatccagattgggccaaggatagctgatgggcagtcatggatgttgatggatgggttttccmagggtagctggattgtggtctcgtaaccatgccgactcctggggctgagaagggctatttagtgaaatgaaatactactctgtcacaacttcctcactcacaattcaatcatggagagtacttccccagtgctgtcactgaaatcattacattcagaattaaacatgggtgtaatagagcagtccctgaggttctattggcacatcaggttccacattcctaaccagctttcccatacaggaatatgaaaagcctgccaatcaggattctttttccttcctttggaattaatctcaccactccctgtccctgataacgcttccataacctgttcccgggccacgtggcatcagcgtatcagcaggattgctcagccttcaccctttggtgtctgacattactttggaagtcttcccaatgcaaatcacaaaaaaatgagttggcccagagagaccctcatgcaggttctctccacctggtcttccttctcttcactcactcagttgttacctcctttgatccacatttctggctcacacaactcttatccayggcagcatattttctcaatgtcccttttcctcatattcctttggactttccagttttattcttctcttgtctcctttcatctccctagatcccttttgccattctccaccttcctccacagaggaagcatgacatggagcaaagagaacaggcttccctgtccccagttctgtctccacttctgcctagctatgtgatgtgcacacatgacgccctcaccaagcctcagtttcccrtctgtaaaaatttcctcacagaggttttgtaaggaccccaagaaataaaacttatttcctgtcactttatttgcatcactatgtgaactgccttggcaactctaaacaacttttgcaatcttaaaattgaatattttagccatgaatcataaaatcaataaaaagctacaaacttcctatgttttcaacaccccctgagactgtggggaatttaggcgactttaaggaaactaaaggttgacctactagtagtacagatgtttgcgaatagtttagaaacatatttctccttggaaggagaagctaggtgatggtattttcttcttaggctcaagtgttagacttcaagagtctgtaataaatcgctccttaaataaataaaatgtgaaatcctctaaggcagatgttggcaattgtttactgtaagggccagctactgtgttaggcgttgcagaccatagggactctgtcacaactactcaactctgctcttacaagagtagggttgtattgtagcacaataatacacaagcaaatcaacataactgtgttccaattaaactttatataaacagtaggtaggctgggcgcagtggctcatgcctgtaatcccagcactttgggaggcctaggcgggcagatcatgaggtcaggagatcaagaccatcctggctaacaaggtgaaaccccgtctctactaaaaatacaaaaattagccgggcgtgatggtgggcgcctgtaatcccagctactagggaggctgaggcaggagaatggcatgaacccaggaggcagagcttgcagtgagccaagattgcaccactgcactccagcctgggcaacagtgcaagactccatctcaaaacaaaacaaaataaaacaaacaaamaaaaaaacagtaggtaagctacatttggcccgcagactatagttttctaaccattgctctaaaggatgaatggagattacattgatcattaacaactcagaaaatcagaaattatgattgaatgggaggtttcaggtgactccatgatgattctggaattattaaggcttttggttactaataaatggcaacccttttttttttctttttttacttctacaagttctcctgatggaaaaatcagtcagctcaaggttttttagtttgggatgaattggcctttgaaatagatttgggctttgataggtttgttggcaattggtaaacccatcctaatttcccacagatggagcagagaaggatcacttagaggaatcagaaagcccaggacaacagggaagtaatgataactaccaattattaagctgccctccccatcacaaactatgaccaccatgatctccattttgtagaagaagcaaagttttagttgacaggggatgagtgctttgcccgagatcacacagaagtgttagagccagctgaattgctttccccttagccacaatatctcaatcaacacaagtaacgtactttccttgggacattcacctttcttcagattcagaaccagagagsaaaaaagaaatcaccccttcttccttctgcctttactttctagtagaagttatacttaaaaaaaaaaaacaatttgccaggcatggtggctcacacctgtaatcccagtactttgggaggctgaggcgggggggaacacctgaggtcaggagtttgagaccagcctgccctacatggcaaaaacttgtctctactaaaaatacaaaaagttagccaggcatggtggtgggtgcctgtaatcccagctacytgggaggctgaggcaggaaaattgcttgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaaagaatcaagaaaatggaagctaagacaagtaagtgatttgcctgaagttgcaccagtagttaatagtggagtcagaatttgacatggttctcatcaactccaaaacattttcaactcacacagctgccatagagcttagaacaggccgactctcaaaccagatggtctgggttcaaatctgaactccactatttgctagttgtatcaccctaggtaagttgcttaatgactcttagtttcctgatttgtcaaattaggatgatgataatggtttccttctcatcttttgttatagggaataaaggggtaataagaacatggtaagccacatgctttggctttttctgtggaatatcagctctatgagcacagaagttattgtctgttttcttcactgttgtatccttagcacttaggataatgtctagcacatagtaggcaatatcaatatatgaatgaaaaatgtcagaagtagtctttaaattaggttatgactggattcaaagtcagcatgaaaaagcatagctttccttttgctttactatttttgtataacttggatttgataggtgaaattcaatatgagtctttgaagtcttaatttaaagtgtaacagtggaaactagtgattgtcttcattctttccatgttcccaacaaaagtagaagttagtacaaaggtgaagcttttaaaacaaaagtggaagttagcacaaaggtgaagctgaggttgagcacataacaggtacaaagagtgctttcagatgtacttctctagttttttgctattccccaaagtgcatccttacataattagctttaaaattcctttcatcccttatttttttttaaatctatcattaacacgtagatttttatctctaagtttatttttactaaacttgcatctttttaaatacgacgtattctgaatctaaatcagtatttagtgacaacagctgctgggaaccactgtaataaatgaattatgggtcccatttacctggcaagattgcctttgatgtctacacgtcaacagtgaaaggggttccagagaaaaacaaagcctctggtaaaaagggcaagctcatcccaagattgagtatgcacgaagagggagcagaaacaggagatgggtgcctctggaacaaacatgcttatgcaggtgggtttatggaggggctcctgagagggtgagtcccatgagtcttcaagagcattacttagatgccatggcacctaggcagaaaacaatgtttaaatttgtgctggatttacaagtatatgtgatattcattctgagtggtataacctatatccctaatagcaaagtgttgaagttctaatctttctcagtggtttgcactgtgtaaattattattttcattaagattaagcatcctcacagaattgcacagcagtaacttatgtaaccacctccttagaatgttctctctctgacaatatgcctaccaaagactcttttaaagatctttgaaattagtaattagggaggttamaatggagcactgtttgcttgtcttaatgtggaatcctctacatgctttatagaaaacaaatgaagtgaataagttttgctcttgaaggttctcctgcttacaatcaaagtaatttgcagacttgcctgatttgtatgtttcttcaagtcaagaataattctaakggattactcctgtcccttcagctataagataacagagtgagaacaaaaatggcttgtgaaatcaacctaacagagtatttcttctctcttctcataggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttygaaccagtcgaaacccagaaacagacacgtacattctcttcaatccttggtgtgaaggtaagaggcagacatttagttttctcatttaaaaattcacctatttggcggggtgccatggcacatgcctatactcccagctctttgggaggccaagatgggaggatcgcttgaggccaggagtttgagacctagtctctaaaaaataaaaattaaaaattagatgggtgtggtggtgcacacctrtactcccagctacttgggaggctgaagtgggagaattgcttgagttcgggarttggaggttacagtgagcaatgattgtgccactgtactccagcctgggcaacagagcaagactccgtctttgaaaaaagaaaaaaaacaagctcatgtatttccaatacatctctttttgaaggggtagtaagattattctaaatacatatgcctctcctacatataccatctttaatgattgaaagagaaagatagaaaaytcatcctccatgtgtatgargataaaacctctatatgtgaagtcaatgctgctatacatttatttcgggattaattggagattgtctaaagttgcagttagttatttgtggagctattaattgcagttttgtaattaaaagtaattgcaaaaatcacaattacttttgcaccaacctcaccaacctaatatatgttgacagtataacctctgtacactattactctgtaaacaaattgggcttattaagcttgattatcaaaactattagagtctataactctgacttcagaaaaataaaataaagtcgacgctgttcatagtagaactaacctctctatccccctactttaagaacagaaagtctgtatatctaaaggattccacaaagttgtttatgtgcatagtgggtgcaaattttgcaaaccataactctggatgtgcaaagatgtagctgtactttaatataatataacttgatctctagtgctattttcagtcttcctttctgtctgcggcagaagcttaatctagttatattcaaataaaactcagtcaagttcaatgatttctctatcaattctgttttgtgcctcagtcacacatagcattttctcctcatcttcatctctgccctttcatacctctcccctgctcccacactttgtacgaagctgttttaagttccagaggcagatgcagatgttgcagcagcatcaatgtgggagagaccacttctaggtcctaggaaataaggcagtgaaagatatgaaagctcacatggggcaggagacttcccatggcaccctaccccatatgcactgctctctaacatcatccaaaatgagcccatattattgctgattttgaatgatccttgtatgtgaaagtcacatttgaatcagggttaatctgtcctagatatagataagtgcacaacaatatttgctactcatctagaacatacaccttggtcctactgatcttttctttgttttatatttatatttatttactttttgtagagacgtggtgtcactatgttgtccaggctggtctcgaactcttgggctcaagcagtgctcctgcctgagcctcccaaagtgttgggattacagtcatgaaccaccatgcccagcatggcttgggaattacctgttccactagtgttggcaaaaggcgccaagctattcctacactccctatacatccatcctcatcatattgtacccaacactcctatctatgagacagatattcaaggtaaatggtaacaggaaatgttaactgggccatgtgcagttcaaaaaatgaactcttgatagtaatcttaaaaccagatgtgaggcatttgcaactggttgatggggtgatatttacagagatgaaaaatactgagaggatcagagttacagatatataaattaagattttgaatatgttaagttggagataaccatagatagacagcagaaatgacaaataggtatgtgaatctggagaagaaaatcagagatatatatttgggagttatctgtacctagggagaaaatatagataaagaaggaaataggatatagtatctagccttcaggaacaccatcatttaggagtccagtagagaaggagtcagcaaaagagaatgagatggaagagtatgtaggaagcaacctattctaagaaaattgtatttaaaaattcatacttatcaatcaagagtttgttattgactttctttttattacaaaaagaaaatcctaggctacatataactgttcagaactctaggaaatttcaggaatgctataatttacccagactttggtttgtttgcaacttttctggattatatcatgtgtgtaaatgggatatgtgtctgcattcatttcaacttatgtgaccactcttcttgacgggaaaagggttagttaagttgcttgacatattaactttcaggataactactcaggaggtggacaatctaataaccttctaattgctgccttgatcttcagttgtatccatgatgagcagcttccagatacctctgttctgaaaaagtcacttaggtctggaggcgttcttgttctagaggctgtacagggacctcccctaggttttcagttcatggaaaggattggaggaaggtgggacaaaaaccagagaccaatttggaagctgtggtctaggacaaagatgatgataaactaaacatgstggtaccagtggagatgagaaggggttagattggagatctattttgtatttagaacaaaaattgcacagggattcaagatgagaagtaaagaaatgggaggactcaagaataactctagatttcttgttagaccaattgggttgatggcggtgccattttcagagctgggaaaactgtgggaagtggaggggaagcactgggggtgaagctaagagttacattcagaaatgttaatttggtgatgtctatgagacatgcaaatgaaaacgtcaagtaagcacttgaataaagtgaatctagaactcaaaggagatggctgagctagacatgtaaacatgggcacggttaggagcaataacggacacaaatgattcagggtcattaacaattaagagttgagacaaaggagaagtcaacaaaggaggctgagcaggagcagtcagtggagcgcaaggagatcaaaagagcccagagccagacacattgatagattcaagacagcagtcaactctgtttaatgctatgattagttgaataggataggggaggaaagtggccatatagtgtggaaatatggatgtcttcgatgatcttgaaaaggacggtttcactaaagtgatagagacagaagccagggagatggtcatgggctgtgttgtaaacaggaggcgagaaagtagagacggcrggagatggcacctttctcaagactttctgtagcacctagatgttgaagcgaaggtcaaaggagaattttttaaagacaagagagagtgggtgttattttatggtgayggagaggaaccaggaaagagagtttgcagtccagagagaggacggtggttcacagccttggctgcacgttgcaatcatctgggaagctttgaaactatggatgcttcagtcccccatgcaggcattctgatgtaattgctctggactgcagcctgggctttggggttttttaaagttctgcaggtgattcttggagctaaggttgagaagtttcaggagtgaaatccttgagtggttggaatccagggaacaggtgaagaagggcctgtgatgggtggggctatctactctctccagagacaggagtagagtagaagaagaggggtgcagattttccagtttaatggaagaagaatgaggtgattgccattttgtgactcctttttttttttttttgtcagtgaagtgtaaagcaaagtcatgtgttgagaagcagcagcaaggaagggcatgaaacgcttgatagggaagatgtgagctagtcatctggagggtagaaggtgaacttattacagggacatgccgggagggtgctccctgcttccagaacacagggcaaactagcacaatcttcttcattacttggcctgtggaggcccaaacatctctgcaaattctttagggatttctgacttcatggctgcctctgcctctaggagtcctactcacacttgtgctgctgcaagtgagaaacttgaccgtcaccttcaatttcaatgttggcaacaacaacaaaagcagccacacacaacayctgtgaatgcccagaccttaactgcagtttgggatggagggtgagagcaggaaggatgcactctgtggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggcttgttcagccacttctgtgcagcaccctcaggttgagtaggtctgaggcctggcctgagaatttgcatttctaaccagttcctgggagatgctgttgctgctggtcggggtcaacacttagcggaccactgnnnnnnnnnnnnnnnnnnnnaaaagcagccacacacaacatctgtgaatgcccagaccttaactgcagtttgggatggagggtgagagcaggaaggatgcactctgtggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcagcacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcasccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggarcacatcagaatcacctggagggcttgttcagccacttctgtgcagcaccctcaggttgagtaggtctgaggcctggcctgagaatttgcatttctaaccagttcctgggagatgctgttgctgctggtcggggtcaacacttagcggaccactggtttcataataatcacgaaacaataaagctgggcatggcccccagagcagcctgcggtcccagctacttgggaagctgaggcaggaggattgcttgggcccaggagttcgaggcagccccgccagcctgtctctaagaagaaagaragacaataagcaataactttaaaactcaagaggcagggccgggcccagtggctcacgcctgtaatcccagcacttcgggagaccaaggcaggcagatcatgaggtcaggagttcaagatcagcctgatcaacatggtgaaaccccatctctactaaacatacaaaaattagctgggcatggtggtgtgtgcctgtaatctcagctactcaggaggctgaggcaggagaactgcttgaacctgggaggcggaggttgcagtgagccgagatcgtaccactgcactccagcctgggccacagagtgagactccatctcaaaaaacaaaaacaaaacaaacaaacaaaaaacctcaggagattataatttactcttcttaaaatttcactggctctaccctgaacctaattccagtctctctcccttaccaccccttctctctctcctactgttctcctttattctctgaacttttctctcccattctgtcccaggagcaaattctccttccttaatgcagagggatccagtgagctttattatttttgttgcttgatctcttccaacaaccatgcttttgggccctgaacaccatttttttaaatgaagtgagagaaagagttcatctccccacttattgtgtggtttcccggcctagcacgcaaagcataacccaaaaaggggatgatatgatgaaccgctccccccaacacacacacaagcacatacactgtagcccagcagtcccctgcagttttatgcttgtgtgtgtgttaatgcataacaaargattcagcgctatggcctggtaactggaaagtaggtcaaaagagaggggtgagactgtcrcccaagtgaaaaagatagcagaagataagaaggaaaactgtttccagaaattgtcaaaagacagccaggtgaacaagattgtggyccgakgtggcacaggatgctgggctgaaaattacagcagcatgcacagcacttattgataggagaatgctcagctgtgctcctgagggcccttcagcctgctttgcattcataggcaatttatcctccttaatcactaaatcattaatggggatcaatagcaatgccacatcagwgaaggcaggggtgcatgcggggagaataattgcttgcttagtttttagtttagtggtgctaaccgggcttcgggtccattctgggaggaaacccttctcctgggtgttagagagaactgtacccacaaaggcagcaggagtgagacgggcagttattatgaattcatcatgtttttctaactactcaggaactctgaactattgaatgtatttcactatttaaatatagaatgttccagtttggtagtctagcactagtgccagatagtgggtcctgaaagatttagatttctgatatctgtgcctagtactctggagaagcagtgagcagtatttttgattgggcatcagttacctttaagggatctttctcctcttgataagttgttcccccattccattctccatcactgcttttccctcacctcattcgacctcatatccttagcctctggcacacttgaggtttaataaatgtttgctgtgttgatttaataatcccaagtaaatactctaggttcgccgcaccctgtcattacagataacttgtaaatgtaatctcagaccttaccatcttgagaaaagtcaaaaacatatctggtgtgctgggaggagtgtgtctgtgggtgatgtgtgtgtggatttctctatctcttagcatctgacaccaaattagcatctaatatttcctttttattcaatgtgttttttcacttttctttaaacaaataaatcaatttaatttaatatgaagaaatcaatatgttcccaatatcttggatgcttttaacagcaaataaataaatatgacctgcttgtattttatyattaaattcatccttagccwatttgctttgtatttatataaggtctttttagcccctttcatacagaatggagtaagtaaccaagactggtgtcctcagagtaacaatgacccacattccttctcttggagactcttgagcccagaccagcatttacgccctcaggctagagccattcatccatcaatccacaaatattgatagtatgtcgcatcccatgcccatgacaacacaatgacctgtgcacagtacgacagtattatgtattcattcagaaaaattcaaagtcaatactgaattaggtactgggactatggcagtgaaaaaggcagacacaatcttcgtatagcttctagcaaggattttacaaatgagctcctaataaaaaactgattacaattgtaaaaagtactaaaataagtcagtgcacaagaagaacacaaaactggggactccgacctatttggggaacgaggagagactggccagtggcttagctttgcaccttggctagcacccagaacagtatttgcataggatagtaatcaaatagttggttaattgaatttttatgaagttttaataaagcttatggaaaaattttaacctttatttactcaatattcctcttaaataaaatagtatgcatcattcttcctagtatctgagtcattagagacttattatgctttttatgccaagcgaggatcatttagtgtggccctgtaatcagaaaggatcccagagagctcacagtaaaccttcttttcaatggcatgtaggtgaccccaggattgaggtgcaaaggtctttacaaggtgtttctagaaagagcatggttggaagtgtctaatgcagagacacattcacccaccaattcatgtggtttacaattccttccttgtagagtctcttatatgcttcaaagtgtgctcatagtcagtatctccctagattgtgtgtttggaaggtgtaatccttatctcattcagcctttygtggtgcctggaattgagtcaatgttcagtaaatgtttgctgaactgaactgataatcaccattctgagaggcaaggagacgattattagactcagatttcaagagagaaagcaggttctgtgatgttacgtgcatttctcaaagtcctatagaaaattaagaaacaaactgaggctaaccctggagcatcctgactctgtcaaggtaagcacttatatttttaaaacaaaagccatcagtatctggcattgtgtaacaaaagaaaaaaaaccaatagatggccagccgagaagattctgtaatgacctaatcaacgtggaaatttctgccataataaataaatacataaataaataaataaattcaggttgatatttacaagatcaaatgaaagctttctctgggaaaaaaaattaaarcataccaacaagggcacaggctcccttagaggatatgtgctaagtaaagaagctctgacattttctttgtagaattgcttcatgaataatagtctatcttctgaagatatctcagtacactaaaaagcccttaaccagcaaaacaggcaaattagcacaaatccagtaaccttctcaagctggtgtgagctgtaatgcagcatgtttgtaaggaatgtaaactatgttgtactatgcacgcacggatgattgtgctgtcgtgagcactgtgggagatatactatcaatatctgtgaattgatggatgaatggcagtagcctgagggtgcaaattctggtctaggctcaagggtctccaagagaagcggtgttagtcattgttatttcgaggataccagtcctggcgaactactctactttatactgaaggggctaaaaggaaagaagcaaactcaactgactattgaggaamcatttgcttgtgcttcatagattgattccattccagtgttactagataggmaagcaacgtctctggagtggctatatgaaaccattttaggaaggcagtgcgtttggatccttccagaataaaaagctcagactctaaaaatgccattccttaatatgctcacaattgccaccgacaggaagttactcctggtatgccacagcacacacagcctgttagaatctgccaccccttttgatgtactttgtgatggaaaaacatatcatggtgacaccagtccggagtcacatttgctctgcagatcaagccactccctctaagagtgattacacactcccagcatgaatctttcctctttttagtggtgctcagcttttatataaagggggaagcaagtgtaagtgattcctaatcccctcgctctaaattccttccttccctaaatggtgactcattttgccttttggaagggccaaaccattattccttctaaaggattagaaacaacaccaaactctggtttaaactgttgaaagagaccatgtaggttagctgttctagcaccatagttttgtttaattcctgggctccctttgccagacttgagcctaatgaccaaggaaatggaacttgctctgactttgaaatagcatgtaaataagcagaaggaatgtatcagcccatgcaatgatgaatgatcttccttctcacaaagaggttatacagatactaaaatcagtaggctcagcatttgtttttacatgtttgttataaatccttaccttctctgggtcgggaggacagtgggaatgtcagagggtgactgaaatccaccscaaattttcttggcccactcttttcttttttaactacccttcyattcccaccagaggaacagtaaaataaatgaggtcattattcttcactacatgcctcttgtaaattgttagtcagcctgcaagggtggttatttacgaggcattttgaaggtctgttctggtgacagagttgctctgggcagtggatggaggtgctgtgtcacactcaccaatggtgccatgtgtaatctgtttttctcagagttttatcgtaatggtggttgtctgccagaggtcacctacgatcaaagagttgtcagttggtccaaggtgcagccgctcctactctgggagctgtctagaccttatttctcccctcagtcctcagttaagtatagtttccagctcccacattccacacaagcctcatacacgtctaccttctaccagtccaaattgttgggtttctagaatagtgagttgtttgttagtttgtttttcctattagtcgagccttccattttactaagtgaagaactagcttcccctgaaacttagtgaaaccccaccgctctgaagctaaccaaaaatttaaaaacaaacgaaaacactatcaaaaagccaacagcaaaaatctccaagggcaaatgattacatttttctatttttgttagccttccaaacatagggagtttttttggagtttccatcgtgatacaattttttttaaccttgctttggacaactatattttaaagtgacagatctgaataaaaacgggaaataaagcactgctttccaccctcaatcttctttttaaaatcataaataaatttaaaattaaaatcgagccttcccatttgacttccttgccatactgtggattcatgataatgtctgcctgtttgaggtgagatttaattcaagtgttggaagggaaagggtggcctagtctggagctccagaactcctctctatcatgctttgccacttaaatttatcacttcccatcaatactaacgcaaagcccaaaggtaaatccttcattttcttggacttcttccttactctctaagctccagacatcttccccatctctcattctttcagtacacattgattgatttcctaccgtgttccaaggcacagtgttgggggctggggacgcagtcatccgatcctttggacccaagagccatggactacttagaaggcagcttattcaaatcctagcttcacaactcactagctgcatgaccttggaaaagttatgtttctctctgcctcagtttcctcatcagtgaaatggggctactttcctcacaaggatgttatgagtgttgatgagttcatgtgtcttgttataaagcacttagaaagttcctggccataaataagcagtataacaatgcttatttacatgctactacttaaaaaaaattaagaagtaaatacttaaacacatacttattcaataaatataatcattaaacggcaatgtccatacagtgggataaatgttacccccgcctccatagggcactaagggaacaaggtttaattcaatctgtgctggaaaggaaagggttcagggagacttaaagaaggagaaaaaagttgtgttgaaggactctgataataaaaaagagcacaaccctatattgctcttaaagaaaaactaatgcacaaaagttggacttgttaatctctttttaaatgggtagcttcacttaaatggaaacacattttagaaaataactttatctgatggaaaagtctcattatagaaataaaaaataataaaagcataaaaagagctcaaagatctacaaattagagacactaacaattaacattttsttgtaatgtcatccatttaaagtattttcagtgcttttcatttttaattggcaattaattgaatatattgttcttttcaaataaacacacatgtacatttacatggctaaaagaaaactttccttttcaccaatcttccaatcctagagaatccccagggaaaaccaactttaactgtgtatatcattacagatactttgctatcattttatgtattgatggcatatatatacctagagaatttaggttttttaaaaccacaaaagagattgtgtcaacctgttgctctgtacctcattttctcactcagtatatcttggagcgttttctatatcagtacctgcatcttctttttaatggctgcttggtatggtcatatcatgttgttttggtgttttgtttacaactatttggattgtttcccatttttactatagcacgttatgccattttgaaggttgcacatacattttgtacaaatgttactgtagaatagacatctagaaatagcattgggcaaagtgaattcacattttaaatttgcatagatattgcctaattacccttctaaaaggctgcagtattttacactacagccatagtagatgagagtatccatctcttcataccctcattggcactggtggttaatcatttgttttaatatttgccgatatggtaggagaattatggtatttcattggtatttcatggttaatttggtttttatgtctctgattgttagtggagttgagcattttttcatatatttattgaacgttatgtttctctacctgcttatatctggaacatgtcaggtgaaataaagatcgtcagggagagacacacatgtgcctcttaaatctatggatacagtttgtatatagtaggataaagagatcttactgacactttttttcttacatagataaccagctgtcaaaacaccacgtattgatcagatctatttttacctattgattttaagggccatctttattatttactaagatttaatacacatctagctccttccatatatttgtccattactgtgctaatgtcagttttaagtgtagctttgtttcagttagctataatcacactaatgctacattaaaaagaaccagaaaatcttagtggcatacaacaataagcacttactcagggatctggggcttggctgggattgggctcatccagactgggcttgactagccagctctgcttccggtgggaacagctggagaggatccgtctctccctgagagctccggagaccctctgctctggtgcctctcatccttctttgaccagtgggcttgctgggtcatattttcctcagggtaacagcagatttgtatgatcacatgctcagctgcgcagtcatattttagacccctacttgcttctgctaacattgcttctgctaacaccccattagccaaaataagcctaaagttaagagaggatattccacatttagagggaagaactgctagttacatggcaaagggcatagatgcaggaaactataaattggggtccaaagtttaatttacctttgggcaagtccttcaatctttcttctttttcaacatattagtttttggctattttctctctctctctctctytttttttttttttttttttttgggacagattctagctctgttgcccagcctggagtgcagtagtgctatctcrgcctcctgggctcaagcgattctcctgcctcagcctcccgagtagctaggattacaggcacacaccaccatgcctggcttatatttttatttttagtagagatggggtttcactgtattggccaggctggtctcaaacttctgacctcaagtgatccacctgcctcagcctcccaaagtgctgggattacaagcatgagccaccacgccctgcctggctgttttctttcacattgttttttccagataagcttttgaatgagcatgcaaagttccaaaacttctgagtagaagtttggttgggttcmcattggtcatatagactaatttgggtagaatttatatctttacattastgaatgttcacatccaattggaaacattttgtatgtgttcattttgtatttcagttttatatcttttgacaaagttaatttttcttataaatattttcagatraactcaaaagcagaaagagtagcacaatgaatatctacttatatgactctcagagttaatggttatcaagattttgccacatttgctttatctatcccttttttccttattttttgccttagcattttcaagtaaattctagtaatcatattattttacctgtacatattttagcgtgtagctttttaaaaatagacatatatrcagtatacatagatacatatgtacatatgtgtgtatgtatgtgtttawgtgtgtttgtgtataattattgcagctaatacaaatcaacaagagctccttggtattatctaatgaaccatctttaatctaattttcccaatgtcyaaaaattatctttttagttagtttatttggattaaggtctgtagattaaatttggttggtatgtcacttaaatcttttcctctagagtaatyctcttcatctgtttcttcatgccacaaacttatggctgaaactgagtcattttttatgtagaactttccatattctgaattttgctgattccatcccccggtgtcatgaaatatttttctctaaccactgtgggatttttttttaaccactgtggcattttctgttaagcagctggttagatctacagactctgtcagattcagctccaagtggcattttttttttggaggaaggggcaaaaatatttcataagtcacrccattgcttcctaggacattcatcctggcagaagatacatatatttaggtttgtcaatagyatctggttcacgttttatcagtctcatccacccgttacgaagttctcttcttaacgaattatttctgcctcaattcgttacttcattagggattgcaagatcgtgacattctaattctaccattccttttgcatttattataatcaattatttcgttaccttgaggtagaattcgtgtaaaaacgcttagatgcctgtcccaaacacacacattttcctgagtgcgatttacacttgtagggtcctgtctgtgttaaagatgctttgctgctctcccaccaggcctgggaataagtaccagactgatgatagacggggaggatgatcctcctgaaattctagccacagggaagaaaagtccttgcaatgaaagacactrgccagggaagctggttggacacacacacatacttgcacattcacaagtatctttcattaaaaggagatgacctactgsttccctcctgccagtgatgggccacaaaacagacatgacacgtgggccttctcacgtgtcccagatttgttttaaaartcattttcaattcatctagttttctrttaatgttaaaaggttggaaattatattttaattagtgttagagaygtacatcagcatcatagaattctgaaactactgatgcaacagaatcataaaatgtttaatgagacatatcaatttaattctgctgcttggaacttaaaragccagagttcgtcagcattttgctaacaaatgtcatcatttacagactgaatttggtgctgattatgttcaccattactaaaaatattgggaaatgagctatgcttggtgaaacaaagggcattttttwaaaatttggctgattaaatgtagtttagaaacaaaataaacttgcataaacttgcaagtgtttggaaacagtctggtttggtaatagtcactatgtttaaaccctgatgcagatgatgctgtgtatctggacaatgagaaagaaagagaagagtwtgtcctgaatgacatcggggtaattttttatggagaggtcaatgacatcaagaccagaagctggagctatggtcaggtgagccacttaaaatttgttattgtcaaggacatttttacttcatattttttgtcacatgtatccctrcaggatcycatatatcgatattagacaagcayaatttcctgctttttaggatctgagactccwaggcagwgagcataggagtagggactcataaagacaactgcgtaatttatcagctgaaaccacatatctctggktattacagtgttacagaaatgagagattccatgaataatgtggcattctattgagaaatgctttggccacttagaacagtgaaatctcattagttcaacctggcttataaagaaaggtattttcaaagtgatgcaaagaatactgcaaggggtgtgcccaattcaaagaaatagcttctttttktttttttttaagtgttagcstagggtactgctaattagaaaagagtgttatcatttcatcaaaggaagggccactgagcttttacatagraagattttatcagctgcaagttgattgtctagacacaaagtagcaaatggcatttctttaagrtgttcagtcattcaaactatttcagtttggtatctttaacaatggagcaaatgaatgatattttaccaattttccataaatgaatgcatgtcctgtgatttcaaaatgatttttaattagcgacacaagcgggggcgaatgtcatttctcaggagttttggctgggatggctggaactgtgcatcattgcgctgggcatccagcagggagttttcayrgaatctggtggtcacagggtactttcttggctccrgatgccttgctttgacttccatatgggatctccctgtgttcctyacccactgctccagtaccygtgttatcctgcctacctggctttgtgaacagcttccctgactccggagaattacatgcccagtgctcaggctycccygcctgcatttctaatgtcctgccaagctacaagctagttggcaccccctgttcttggattcctgcctgactccctggtttcaagccatcccctcctcagtgacatgcaacctttgactatactgcctactgcctgatgcccttgtcttgggtccccaatttctagcctttagcctggtgattctatttatggyccaaatatgacaatctatagatagctaamaaggggaaaagtcatcaaggtgggcagcaaggaggtctggaaaagtgtcccaagcccagtcaggkcactcttcgccagcttgcctttgggtaggcaccctggagcacagtcacttgattgtatcttctgccactcaaagaggctattggtgtgtatcctttggccagaataaccagccaagcrtgtttacagtgatgcagggaatcaatccgttctatgactatttccttaactctccarttagttgctatcctgcccagcaaayacagctgagagaagctgcttaataagaaccaaaatactgagctatttgcatacctgaagaactagtgcaattacccattactgcatccatcctgtcagtttgggatacacccagagtgggtattctaactggactgaataaagaattgtgtggtaattagccattatgattgtggtttctgtcacaagcacttgggtggatagcacacaaggtttctctattcaggaaaatctcttactacagtgaggtacagtataggtaaaatcttcctgtcttgctatttgatctttattcctttttaagaaaattctggtattgcytgtggctagcagttctttctaagragactgaactggtaccagactcctcccttgatagygtaatctactttctgcagccttctgccctctccttgatcctggggtccaccttgtctcagaagaggggaaaccttagagggacagtcactatatgaggtctcctactattttgggtgcaaactaagtagtgtgaagcaccttcctgtgatacacctgagagctctttattttckaaatgcacgaggattcacattactttcgaggtcctaagactctggcctgactttggtaaatgattcattccttcttcttgggtacaggagccaatatgttgaaaagaccttctaaattgaatcattttctgaagaacttcaagtcagcttatgatccctgagtatatcaactctctagtatttctgtttatgtttctggcttgcttttatattcttattcactttaatgaaaaacaaaagaagatgtctcattccttctactttaatatttcatactaaagattatgggagatcactatacaggaaacacacatttctaaacattaggttgtggtttcatgttatttttcatcagagaatattttgcttgcagagtgaacactagtttctctttgtttttctttctccaaatagtttgaagatggcatcctggacacttgcctgtatgtgatggacagagcacaaatggacctctctggaakagggaatcccatcaaagtcagccgtgtggggtctgcaatggtaagcagcaattactgatacctaaaatctgttacacctgtcatttgcctcagtatatatgccagttcattaagagctgctgaaatgatgacttacacttaataaactttcatttgtaagattctagcttctgacacccagttatagctcctggaattttctgagcttatcatgtgctataaaacaaaattatcgtctcaatactgtatgtttctttggctttagaaaacaatgatagatataatgatactgtagaccagttattcttaagaaccccttgcctagagactgaggagtgatcatgacaaaaatgtcaatgactataatcaaacagttgatcaaccaaacatcaaggtgcacagaagatgtgcaaggcacagcttttctcaattttcacactgatagtaagagtgaagaaatgaatggctacatctcatcctaactcctgtcacaaggatgtgtcactgtagggctttctcacttacgaagtgggtattgattctttgcaggatcctgtgtggtaagtagggcagccattactcatgsacttttacaagttaggacacagggtaaggacagctttcagtgacaaagccacagctagaactccggtctgctgacttcaaatctagacattttctacttttcatgccgctctctgcaggatatcctaaaacaactttgagaatgcagagatcttgcagtggaacaactttctgagaaaggagatagaactcccatgagtgggaagggtgggccaggcataggacgtggattaaatgggatgtccaggacccatgcagtcctggattatatcaatgtacccaacatggagagccagatgttggtacagagaagtagacccartctggctgaagagtagattatttctgaagaaatgttaaactgggtggtatttcaaacaatcaaagactgaaaaaaagaaatacttatattaccaatttccctaagttttctaagaaatcctctttttgaaagaatgttatgtttgagtttggtttgtatattcttttgagctaaatgaaatcaatattgttaatataaaaatattagactgtgaatgatatgaaatataatttctggttagcttttaagaatggtggcttttattttattaataactaagctacatgtgaatttaagaaacagcagagcataaaaagtaaaaatagaaaccaacatgtaaaggcagttttgtttcctatgcatttacattccataatgggaagccaatgaattccaaagatttgggggaatgttgaatttgggaaatgtttaccaaagtgtcatgaccgtttataacaaatatattagacttgcatctgatcactatttttactgtttcgcccacaagatttctctttttcttctttgaagttaccataacaattttgcagtaagaaaggaagcaacagctagcagtggttaaatttaaattaattccttcttaagcattctaaaatggcacactcatcagcataagcttactcacacactgtgtgtacttttacgcacccagaagtcagaaatcactgcctarcagaagccagtgcaaaagagaagcagacaggaagcagttaacctaatgtgtctgtggtggcagctggctaagcggaagctgttaattattgaataagcacacatactcctaatgcaaattgccctgagattttattaatcatgtaaagcctatgaagttctaagtttgaaaatttatatcccaattaaaagatttaaaactagacagagaaaatccatttggaaaacggtttggttttatttttggagggggagaatttgggtgttaaggggtagaggtcctgacctgagacattttgagcaatatttccatttccgtcatacccttgtttatatacacaaaatrttcaatggttttcaaaaacactttcacctctattagctcctttaaaccttagaatacctctgtgaatctttccaaaatctgttccgttttaataattttaaaagctaaaatactgagcctccaaaaatcaatttaaaaaatgacacagaggaaagatcaagtgttctttggtcattcaggcagatactctcccgttcacaaatcctggaaatctatcatgaaatttctgaatgcagttaaacaaagaacaaagacaaaaaaaatctttaaatttctcaatgaatgatttgactttattagtatgaaaagatgtgcctagagagcccacaagaaaatgttctgaagttgtggactcttagccagaaccctgttgcaggkcgacagagctgtgtgtgttttctcaggggctgggcccaggcctcacaggtaaaacagaggctggtgcagagttgttctgaattcctctcaaacacctcccagcctggtcatagaggctagaaatcccattcgcaggttgcaaatgccagagcagcggtataggtggcatgtggactctccagaagaaatagcacatagatctcagttcatccccaggtgagagtgaaggaaggcagaactttcctgagggcacttgctgctgggaaacagtgaggatgagcagaccagtctttgctgggtatctggagagagtggagctgggtggggacaagatgcagagcacacgactggggccccaaagacaaatttgcttactgtggtccaggacaagtctagcactgaaggttggcaaggagttttcaggcaacaggtgggtgcatgttgaaaaaagcaccgataacccaaattgtgcaaactttcaatcataataagaatctgaatttgggccaggaacggtggctcacgcctgtaatcccagcactttgggaggccgaggcgggcagatcacctgaggtcaggagttcaagaccagcctgaccaacatggagaaaccctatctctactgaaaatacaaaaaattagccaggcatggtgatgcatgcctgtaattccagttactcaggaggctgaggcaggagaattgcttgaacccgggaggcagaggttgtggtgagctgtgatcacaccattgcactcaagagtaaaactccatctcaaaaggattttaagtgcacaatccccagataaaaatatttattgttcagtatatttatatttattgtatgtgaccttgggtaattgtttgttgtagaaggttgtcctgtgtagaatgtttaacgacatccctatcttctacctgggggatgcaagttgtcataactgttcccttaccagttgtgacaactcaaactgattccacatattaccaaatgtctactgggggtaaaaatcacccttagtgaggatgacagcactaaacccctctgtgactcagtttctccacctatggaatgtaagtaacactctcttctcacctgcatagcgaatctgtcttcctaactcactcaaaacctgctggttttcatccttgactgaaaagaaagtgaaggcagcatcatatgggaagcgactcagctcgtgtcgagggattggaccttgattctggttgtgctattaacttactatgtgacccagggtaaataactcacctctgctggcctcgcatctttgtctttaaagtgaaattttgtctctgtactcaaaccacattggcagcaagaatactcttttattcttcaaaatagtgctctcccttcttctattttttcctttatacattcagtaacttcccttgttcttatattgagttgctgttatttcactttgatgtaaaagtaggaaaagttatgacaatctggacagcctggggctattggagtttcccaggagaaagcaagtccaaaatcctgtattctcatcatctagagattaggcctgagatattataaccttacataagctaacttttgcttaggctcctttaaatactgagtggtgcattttaccaagctatactgcagattgatttaagagagaaaagaaaaaaaagagaagcaattagaaaaaatgaagaaacttgcccacagttatacttctccctttaaattgcattgcttgattgctgctttctttycaatgcatttctgatgtgacagttcccaccaggaaaattgccagagaaagctaaggagaatgcttaactttgtgccatccgaacacttacttccctcacatggcattaataaagcattctattgctagccccaagtttctgtgaataagccagacatggactctgagccctgagtcagactatcaaagaaggtgggccgtgacatattgtgacaagggcagcatggttctggggaaaagggaaggctgtgcaaccacctggcattactgcggcgtggttacctgtctatgcctgttcctgcctcccgactgataggatctggcagcaactatgggcagagaatttcccccaaggagatgcagctgcttctgcaaaggctgccgytactgcagataaaggctcgttattcactgtgacacacctacatgtaccacctccatccatatttgctccagtgggtcaaggcattaccagtggaggatctgtgtcgaaacacatgctgaaccagcgtgtgcaatggggaggactctccaagagtcttctgggtgaggaagcagaagcccttggaagtggtgtccctcactcaaagtcacacagcaaataagtggctgagctgaaaccagatatggtccttactctcagatcatattaccttagagggccactatcaacacgttattgccaataacacaataattatgtaagattgarttgccatttcctagaaaagaagagagccccaagggaatggagcccagatgaggcaaattattgaaaatggggaataagtgaagaaaggtatcaatcagaggattctaaatagccataggcactggggccctggagaatgagcttccaaagacgatcaggtaccaaatatgatatgataatggtggtggtgtttggtggtggtggtgatagagttagtgatgatggtggtggtgacggtggtggtgatagtgattgtgataataatggtggtgatggtagggtgattatggtggtgatagtgatgatgatggtgatggtggtggtggagatggtgacggtgatggtggtggtgatggtaggagtgatggtggtgggagtgatggtggtagtggtggtgatggcgtaatgtggtggtggtggtgatttatgatggtggtgatagtggtagtggtggtggtgatggtggtaaaacactcagtatttactcatttgtttgacaaatgtttatggcaatctaccagtctgaacactggagtacaattgtgaacaaaattaagtttctgccttcacaaagcttacagtctaacagagaacacagactagtaaatagaaaattttagctcagcatggcaaattctgtgatggaaataagcatagggttgtatgggaaagcaaatctctcaaatgtagctcaaaggtttcccaggactaaacattggatcaaaagatagaagaatgtctgaggtcccacagtaattaaccatgctattatttgaagaaaccctttctccatggtggaaattatatacaaacagctagtcaccaaaagcactgaagaaaaatgtagtagrgggttatttgctcttctgggggcttgtttgttttgcaattcagaaaactaaggttgacacaactgaagtttattccataggatctcaacatttacagttacttgatccatggtattctgattcagttgtagtaagaaaaaaggtaatattaatgagaaaattaggaaagtaggaggagagaaaaaaacgtcaatatagttacatatttttaaatttcagtgtttgtactgctgccatcctggactatccagcttcccttgagatgtatgcatttatttttaaccctggccttttgctaatatcgaaccacaatgccatcattaatccccattaatactttgctctgactatgmcttttgggaactaactcatgactaaacttttttaaccaatcgatgttcgatgtactctttagcattgtaaaaaaatcttgaacttcagctagtaaatcaaactgaccacaattcggagtaggtcctggatttttctaggacacagtacaagatgaatgactgtagacctttgagatgaaatggactttagtgcttctgatcctcatgcatctgtgatcctacagataaacagaaaataaagttattttccctttgtccatcttttcctccccctctttttgtcccagtatttagaaagatttttttctttccaygcatgaaaaagacagtaatgacataactacttttatatcttgccaagcagctcctcaaggggttaactataaaaccatgttttgttcattttctttcaattgtttacttggtcatcttataggaagcttcacgttgagcaaacctcttcatgcaacaaaccttaattataaatattcagattacatttaaaagttcactttgattagaaatttcacacctgagtcatcccaaatgaactgtaaagacagaaataaatatataaagtttgtatttatttctaaagtttattccttgatcatacagaccagtcacaaggtactttcgtaacagttttattaagaaaaattttaattacaaagcaatatctaacccatcctttggtttataaagcagcttaaacctctttttttggagtgaacggtcrtagatacatctgaggacccaggtgctcaatgggcattgtccttggcatttctaaatcaccaaggaactttttyrcatttacccatatggattttaatttttgaaaaagttcatctatcaaaacaaatcatgattatgtaataataccttgttaccccattcttgtgtcagatttatataactgccaatgggaacttctaatgatggtggcggtggtggtaatcatctctaccagataatgagtatgaccacactgaatatgattcggtgtcactttgtgggggtaaagatacaacttccatctggtcttttataaaagcgacaacagcctacctgcattactaacccacagatgcctagaggtcaaaattccccaggtggtgaccactgccagatgtaggttccatcatggacttgagtctccatccagagcttctgggtctccaaccctatcagcttttatttaaaagtgttattgtctctttctatgattcatatcaggaatgaaatttctcagtttggaacagcakaaaaaggcagaagcctccggtgttccttgcaacctttccaattrtaacgcatatcaattagtargagctctcggggtgacaactttgggagaatccactgatttatattaatgaagagtgttactgtagtccaacagagtaaagtactaaattaccaactctaaaaagattttttagaaaaccattaaagttaaagtcaaggtatttctaagaatgaaagtcatttctatgattctaaaatgacccagggaattcaatgatgaatgagaggtacagactcaaagcaattctctaatgtattcaaagtaaacaatacyataaggtcaccttattcaccagggattttcatttctgttcattgaagatttttwaaaaattgacagatatattggaagccagtgggaaaatagaatttatctaacagaaagtatcttcatagccacttttgagaaattgcataaatccattccataaataaccaaagtgcaggtggagagactgaggcatcaggaagttaagtaactttatccaaggttgctggtagcactgggggtgggtcatgagttgcctggccccactaattcacacacaatgttctatttcccctggatttgtcctctgtctgtcctctctccmggtcacatgagctccttggatacagatataatgccttttacatgtcctgtctgattcaatccttctctttcaggtgggggcagtggggggacgatgaactgctcagacattatcttttttctcttatggtaaaagccagcagtgtaatgaagtttccatttgtggtcaaacagcttggtttctcaattattaagcttacatttcttatgcctcttcaccccatatttttggagaaaaacagacatttattacaaggcatctctcgaatgtgataatcatgggcaatctaaatgtctgctttccctgaattgcttcctggaatgaggtttcaatgctgcagctattctgtaatcacacaggctatttctgaagcacagggatgctttacagcactccctccaagctgagcggttggtgctgctctggtctcctggggccagcatccccaggatagatggatagcaaaggagcaaagcaaagccagctcagccctttaggatatgcacagcttcatgcaccttgggttcccttcataccctctttctttcccctgtctcctcctgttacatccttccctttttcctcytcctgctctgcatttttccctctctcatacgtccattcctttaattcagatatttttgaggcctgttctataccagctctacaccatgcagcagtggtatggcaatgaaaacagcaggccacacttggagaccttgaaatctcagttttctctctcagtccacatttgcttatttctctcattattgtcaattagtaaaatatgttttggccaaatgagcatcctcagatactgagagagacaaggttaataatttcctgtggtcatagttatcatgaaaaatgagtctaattacccacccctatcagagcttgggtcatatatataccaaaggacattcatatatcggtagttatatgcttcatactattcattacagttagttacaggattttttttaattgaagtaaaatttacatacagtaaaaaatcatggatattaaatgcacaattcaatgacttttgattggggtaatcaccaccccaatcaaaatatagacatttccacaagctcagaagtttccctcgtgcttcttccggtcaatccccacctcattaggtagctactattctgatttcttgcaatgggttacatttgtctattcttcaactttacataaatggattcacacagtagaaatagggctggcttctcttactccatcaactgttacatgtgttttcaatgctttccttaccattactaagaagtattttattgcattgtatatcacaatttgtctatccattcacctattgatgcatgtttaagatgtttccaatgtgaagctattatgaatacagttactataaacattcttgtacaagtgtttttgtgtatgtgttttcatatatctggagtaaatagctaaagagagcatgcctagatcagaaagtatgtatatatttaactttataagaattggctagttttccaaagcagctctactgttttacattcctgccagcaacatatgagagttccagtttctccacagcttcacctattcttgatgtcttgaacctttttaattttaaccaatcaaatgggtatatagtggcatttcattgtagttttaattttcatttccctgatggctaatgattttgagcatcttttaatacatttattggctatatatatatatatatatgcagcatgttttcaagtctactgattttcttattcagtcatttgtacttttattattaagttatagttgctctgtgtatatacctctcatttgtcagatatgtatagaacatattttccccaaactatggcttgtagttatattttataaatggcatattttaagtaacaaaagtttttaaattttataaaatcaaattttttcattgttctttaatagtcatccccagtaaatgttctttccacatgaagactttcacatgaatcactatttgcccatgtttgccactatttctcctatgttttatttttgaagctttataatttgaacttttacattgtggtctatgatccrtcttgagttaccttttggtgttgtgtgaggtagggatcaaatcttattttttccaaatttatccatttgttccaccagcatttgttgaaaagactgttggaaaggctttcattcgttgcaaagagtttctttgttgaaaagactgtcattttcttcattgaattgctttggtgactttgtcagaaatcaaatgtctacatgagtatggatctatttctagactctcttttctgtttcattagtttatatgtatgtccttatgacaataccacactgccttttttactgctttcctctagtaaaccttcaaatcaggtagtcattcatttttgttcttctttttcaatattatgtttaattattctagatcctttgtattgctatgtaaattttggaaacaactttccagctttaatgaagtgcctattggcattctaactgtcccgttgtcttgatctattaaagaagtattaaaatgtagcctatagccatcttccagtgatagcacatccattcattcaacagaacttattgagttcccactctgtgctagccctgggaatataaagtcaaaacagcatagtgccttccttccttctgtgaacataaagtctgggaaaagaacaaggacagtctaaccaatgacacaatacaatgtgataaatggatagtactatgcaaagagtactatgtgatcaaagagtaaggacatccaaatcaaggtgataagtaaagattcccagggtgaaaccagctgagttttaaaggatcaatagggcaccaggtaaagaagaggtttgagtgtggatggacattccagggagcgagaataacatttccagcaacaacaaggcagaaaacagcttgttattaagcaaaccactatgaaaaaccaaagacatggtagatgattttcctttcctttcgaccaagtatgtgaccctggctgttgtaagtgccataaaagcccagaagaaaatcaaggatgaagagccaggcaagggaagaaatagaattgctgctaccctatttcttttttcttgtgcattttctgggatgcctgcccatggaataacctgagtacttgaccttcagctcatctcccttcctatccttacaacataacttggcaaatggcggagcaggcacaaaaacagatctctacattcccagaactgtgaccttttaaattttattttttagaacaattttttcaaacagcaattgaatccaaatacataaaagagaaaaagcagagcagctattattaaagaaaggtggtgactgcagccttgactatcaacattcaattctcacctgccccaccccacaacaccgtaactactgagtttcttttgcaaaaccctagcatgtcatgaagcacaatytgacatccaccacaccacttccacctgtgattaagtctggtcaccaccacactgtagctggggatttgtggttcacaaaacctggaaacgattttctacaggaaataattcttctccttgccaaacttaacgctaggcctttgatgttagttcgtgttacccaacatcaaaattcatttccaatggtctttgagaaaccattgtggacaaaattaggtataagactattttctaaaagagttatggaaatcctagcctttatgaggacataacttttaacaatgaaatttaacggaatatgataggtttataacagagaaaagtcatttcatcatagccatataaaatgcacacagaggagaaaagtacccttgcatatttttttaaaaagcagaaagaaatagtaactatacaaaatgtaaaggtctgcgctacaggaaattgaagaatcaagaaatgtcacatttctttatttttcagtatcaagttagaatctgctcatattccaatgaccaaaattaaacagaagtccagtacgggtcatgttttagggctatttctattctttgaattatacaggagaaataattttaaaatcatagataatattatactatagatgctggtttaatttaaaagtcttcattgattttcacagctttattgagatatagttgacaataaaatgtgcatacttaatgtacaattggataatgttgacatgtatatgtacccatgaaacgaacactaaaatcaaaataatgaatatatccattgcccccagaagtttccttattgtaatttcttccttaaaccactccctgctttgtgtaccatcccccatcactgctcagccttctgtcattatacattgatttgtgttttctagacttttacacaaatataatcatgcagtatgtactccttgtgaggcttcttttatgcttccttactgtattctgagcttcatccatgctgttttttgtttcagtagttcatwcctctttattgctgagtagtagtgtttcattgtatggatgaatcactatttgcccatgtatttacttgtggatggacatttaggccattttccgtttttgcctcttacaaataaagccagaaactttagcttggaagactttagtaaaagtctttgtatagacgtaagcttttatttctcttaggtaaatacctaggagtgaggtggctgggtcataagctaaacataggtttaatttttaagaaactaccaaactgtttcctaaattggatgggcattttacattcccaccagcagcatatgagagtctaaagtgttgcatatcctcccggacacttcatatgatcagtctttttaatcttagacttttaaatagatgtccaatgttaccttgctgtggttttgatttgcatttccttaatggctgatgatactgagcatcttttgttgtgattggccacccacgtattttctttgatggaatatctgttccaatatttttctcttgttttaaggttgtgtttgttttcttactattgagtttcaagggttctttacatattctggatacaagttttttctttttaatcagataaaggatttacaaatatcttcttccactctagttttattttttcattctcttcacagggcctttcaaagagcaaaggttcttaatttttatgaagtctgatttacaaatttttttatggatcatgcttttcatattttatctaaggaaactgcctaacctaagatcacacaattttctcctttgcttccttttagaagttttataaccctaggttttatatttaggtctaaggttcattttgagttcatttttacatatggtgcaaggtatgaatcaaagctcgtatttttgcatatgaatatccaattgatgccacctcattttttgaaatgattatcctttatccataaaatttcctttgcaactttatcacaaattagttaactgtatttgtgtgagtctatttctgtgttctctattgtgtcacattgatctgtttgtatttataccaaatggtgtcatgctacttaatttgaaagtattacatgtaattgtacccaaattctatttaattttaagttttattgaattttactttaataggaaagaaattaaattgcaacagaagaaattattaaacttcaaataaatatttcttcactacaagagatatcatttcttaacaggttttcctaaggttattaaaaattataaaaaccattaaaagaataaagtaattatgtacttttaaattatactttaatgttagatggtatcaattaactgagagacccacacactaaaacattaccattttcactgttcctctcctctttctcctatcttttttcttaggatgattattgtttttatattatcaagtcttaaaattcatctgtaactgtaaatcccaaagatgcttaacttatatagagttttctcacccctgaatctgttatcacagagtctctgttcctgggttctttgtttgactyagcccctaattattttgatatcactttcaagtattaatagtttggttatgataggtaccatattccctgaagtacttcatgttcgacaatgtgtgtaaaagggggctgaatgcttgatttgatgctccacttggtcactgttgatgtagagaagagctaatgatttgtgtacattaatcttgtatccagaaactttgctgaattcttttatcagtcctaggagctttctggaggagtccttggggttttcaaggtaaacaatcatatcrtcagcaaacagtgacagtttgacttcctctttacctatttggatgtcctttatttctttctcttawcttattgctctggctaggacttccagtactatgttgaagaggagtggtgacagtgggactccttgtcttattccagttctcagaggaaatggctttcaacatttcctcattcagtattatgttggctgtgggtttgtcatagatggcttttattacattaaggtatgtcccttgtatgctgattttgctgagagttttaatgataaagcaatgttggattttgttgaatgctttttctgaatctattgagatgatcatgtgatttttgtttttaattctgtttatatggtgcatcacatttattgacttgtgtatgttaaaccatgtccacattcctgttatgaaacccacttgatcatggcggattatctttttgatatgttgttggattcagttagctagtattttgtgaaagattttagcatctgtgttcatcaaggatattggtctgtagtttccttttttggttatatcctttcctggtttttgtattagggtgatgctggcttcatagaatgaatttgggagggttccttctttctctatcttgtggaatagtgtcaaaaggattggtagcaattcttccttgaatgtctggtagaattctcctgtgaatccgtctgttcctggacatttttttgttgataagtttttaattaccatttcaatctcactgcttgttattggtctgttcaggatatctaattcttcctgacttaagctaggagggttgtatttttccaggaatttatctgtcttttctagattttatagtttatgtgcattaaggtgttcatagtagccttgaatgatcttttgtatttcagtggtgtcagttgtaatatctcctgtttcatttcttagtgaggttatttggattttctctctttttggttaattttgctaatgatctatcaattttatttatctttttaaataaccagctttttgtttcatttatcttttrtatttttgtttgtttcaattttgtttagttctgctctgatcttggttatttcttttctcctgctgggttagggttttgtttgttcttgtttctccagttccttgaggtgtaaccttagaatgtcagtttgcgctcctttggtcttttttctgtaggcctttaggtctatgaactttcctcctagcactgcctttgctgtatcccagaggctttgataagttgtgtcattattgtcattcagttcaaagaattttttaattttcatcttgattttgtttttgacccaatgctcattcaggagcaggttacttaatttccatgtatttgcatggttttgaaggtttcttttagagttgctttccagttttatttctgtgtggtctgagagatggcttgatataattccaattttcttacatttattgaagcacattttatggcttatcatatggtctatcttggagaaagttttatgcactgttgattagaatgtgtgttctgtggttgttggataaaatgttctgtatatatctgttaagtccatttgttccaaggtatagtttaaatctattgtttctttgttgactttctgtcttgatgacctgtctagtgctgtcagtggagtactgaagtcctccactactattgtcttactgtctatctcatttcttaggtctatttgttattgttttataaatttgggaacttgagtgttcagtgcacatttgtttaggattgtgatattttcctgttggacaaggccttttaccattatataatgtccctctttgtctcttttaactgctgttgctttaaagtttgttttgtctgatataagaatagctacccctgctcgcttttggtgtccatttgcatgaaatacctttttccacacctttactttaagtttatgtgagtccttatgtgttaggtgagtttcctgaaggcagcagacagttggttggtgagttcttatccattcttcagttctgtatcttttaaatatagcatttaggccatttacattcaatgttagtgttgaaatgtgaggtaccattacattcatcatgctctttsttgccygtgtactttggtttttttgttttttgtttttgctttttaacttgtatttttgttycataggtcctgtgtgatttatgctttaaagaagttctgttttgatgtgtttccaggatttgcttcaagatttagagctccttttagcagttcttgtagtggtggcttggtaatggtgaattatctcagcatttgtttgtctgaaaaaggctgtatctttctttcatatatgatgcttagtttygctggatacaaaattcttggcygataattgttttgtttgaagaggctgaagatagggttccaatcccttctagattgtagggtttctgctgagaaatttgctgttcatctgataggttttcttttataggttacctgatscttctgtctcacagctcttaagattcttttctttgtcttaactttggataacctaatgacaatgtgcctaggcaaagatctttctgcaatgaatttcctgggtgttgtttgtgcttcttgtatttggatgtctaggtctctagcaaggccggggaagtattcctcaattattaccccaaatacattttccaagctttcagaattctcttcttcctcaggaacaccgattattcttagctttggtcatttaacataatcccagacttcttggtggctttgttcatattttcttattccttttcctttgtctttttggactgggttaattcaaagaacttgtctttgagctctgaatttttttcttctacatgttcaattctattgctgagactttccagagcatttcgcattcgtaaaagtgtgtgcaaagtttcctgaatttttgcttgttttttctttaagctatctatttccttgaatatttctcccttcacttcttgtattattctttggatttccttgcattgggcttcacttttctctggtccctccctgtttggcttaataactaacctccttaattctttttcaggtaaatcagggatttcttctttgtttggatccattgctggtgaactagtgtgatttttggggggtgttgaagagccttgttttgtcatattacagttccttctcatctgggtaggctctgtcagagggaaggtctagggctgaaggctgttgttcagattattttgtcccatgggatgttcccttgatgtagtactctcccccttttcctatggatgtggcttcctgtgagccaaattgcagtgattgtctctcttctgggtctacccacccagcaagtctacccagctctggagtgacactgggcattgtctgcacagaatcctgtgatgtgagccatctctgggtccctctcagccaccggaayagcgcctattcyggtggaggtggcagggggtacaatggacactgttagggttcttagctttggtgtttaatgctctatttttgtgctggttggctccctgccaggaggtggtgctttccagagagcagtagctgtggtagtatggggaggaaccagtggtgggcagggccccagaactcccaagattatatgccctttgtcttccactagcagggtaggtaggaaaggaccatcaactgggggctgggctaggcgtgtctgaggtcagactctccttgggcaggtcttgctgcagctgctgtgggggatgggggtgagatttctaggtcactggagctgtgtacctaagaggattatggctgcctctgctgagtcatgcaggttgtcagggaagtkgggggaagctggcagtcacaggagtcacccagctgccatgcaaaccaaagggccagtctcactcccaccgtgcccccctcaacagccctaagtccatttccaggcagagggcaagatggccttgaaaacctgacccggtctacccacctcccagctgcaaaagaaaagggtttggttcttccacacctgtggagtctgcacaccggatttgcaccctcccccaagttttggccaggaggcttctcaccccattcaaattgctacaaagttcagctagagatttccttctccatgtggagttttatcctctgctcctctgtccacctttctgatggatctctgtggtgccaggcagggatggcctgctaggggacctagcaagctcccagggcctttctgctgcttcctctacccctgtatttccctcagctctccaagttgacccagcaccaggtgaagtcggaaacttctcccacaaacagaccttcagcttctccagtggaggtttgtgttcgggagaggagggtctccctttcccacttgcatagttgggacactcacagtatttgggggggtctctcgggtcctgcagaagcagtctgcttccttcagagagtctgtggtcctctcaggattgctggtttgttcttgcagtcgacctggatctaaaatttacagcacgagcctccacatgctgctctgtccagagctgcaatccagtcctgcctcccatccaccatgatgatccaaatccttgggttctctattttaaggacactaatcatccttatgttgtatcatctttgttttccataactatggtactattagaatctctctaaataattcatcactttggttttttattagtattttctttgatatctcaagttttcttctatgtcattaatttttatttttaataatatgtattctgtttcttgcagtttataatttattattagctctgtaatggtatgatttggtcctcaatttgttgccttggtctgtgatctcctaaaaggttgtgagaaaaatgacttatgctccttaatttcgttttcttctatgtatattttttcatgatctctccctctctctctttctgtctcttcctctgcatgcagtttcttttccctatatttatgctcaaacttgcatcattcttgtctctagacgttctatttgctgtaataaatgaaattcttctcmatctaaggttagtttgatctcacttctgaactacaatttgaggccaatgtaccacattctatctactcttcagtactctgcaagagattggagtgaggactacagtattagaagatgaacaatctttggtatcatgcttagggtctgctctttcccttaagattctcctacatctgtcactccagaacccacccccacaactggaggcatatctcagttccattgggggatacgctcagcttgtattatttcccaattgtgttccagaatctctacctcttttaaggtgcagatactttttcactcgtttctccacagcaggtgtttccaccattctgttcagaacaataaaaagakcagcttttttttttttttttttttttgagacaggatctcactctgttgcccaggctggagtgcagtggtacaatcagctcactgcaacctctgcctccccggttcaagcgattctcctgcctcagcctccagagtagcggggactacaggcatgtgccactatgcccagctagtttttgtatttttagtagagatggggtttcaccatgttggccaggctggtcttgaattcctgacctcaagcaatcyatctgcctcatcctctcaaagggctgggattacatgcctggccaaaaagatcagcattttgattatatttattactttctagawtttaaaatataaattagaaatctcaggtttttgttgactagctggtaagatggttaaggttaggagctgakccatgttgcctctctgctttactccatagtcctcatgttttgttgggaccatgttttgaagtttattgcattatgctgataatgacttttaggggtttttgaaatttttttctaattttgtaggtattatgggagggcaatttagtgtagccttaatgaagttgaataatgcctcctgtaygtagtcctggacttgtattgtctacttgaccaccagtgactcaagaccaagacactttattctgccactggtcaaaccctgagatcatgagagggtgttaaaacagccaactgtggcatgaaaaatgacaaacatgtcctccaaacatatcttgttgcttatgaggggagatattattttaaccctttacatctgtcactaaaaacttacctctttcatggcctgagctccctagaaatcaatgttctaattagaaaacagtagctaatctgcccaaatgctaataaatgagggttgtgatttatctagcaacaggggaacagctcagcattaacaattaaaaggtctgtagaggacagagctttttttccttactcttcyccttagctgattgagttcagccctatgctataaatagcccttgtaattaatggctatctgtttgaaaatcagttatcaggaccacagtttaggagcctttacctctgaaattcatagagcctattttatgtctcagtgataagggaatgataatgtgagttcaaagctaaacctacctacccacaaagaccaaaccacatcatagcctaccaaggcattcttcaatcttcacgataatggatacagatttttaaataatcaatccaactgcaaggagaagtactgatctttaatatagccataatgtttggctaaagcctgctgcactccagtcatttcatgactctataagctaaagtcaaaatttatatcaaaggcatgagtttgcaattagctgagcaaggtcttttagagacccccaaagagttcattttttcctacattgaacaaattaactgtgtggttcataaagttcttcttcactttaacctgactggacacagagttaaagggggaagatagcatgtctaaaccaaattgaatagtgatcttctagacaacactccccagaagggaccctccttgggaaataccactcagtgctagagtaaatctcaaatttcagtgaaggctttgtcattcacagtaaaagatgcttgcacatcttgcatgttttcttctagtattttttttatttcgttcggtattgcctacttacataatacccatgcagagctcctagaaggtcccagagcctgccatattgtttcatgacactacacatttattaaaactgtttccactatgtagatggccttttctggccagtttgcctgtcatctccctctattaggccccccagcatcaccaccaccaccctccaatctaactgataactcccttcctcaggttcccactctacctctacatttttctgtcttaataccagtaatctttacatccacttgattggtttcttgaccatctctctccaggcataaggtcttattcttactcaaatatacatttcctatatgtttgttgactatataagtgattattgaacaactacakagcatccagtctttgctaacacttggtaraactcagaaagacggagattttttttctttgttcccaatgaattgataaaccagcggggaagacagacttctctacaactagacacagcaagtcaaaaagaggggtctaggcaggtgatgaggctgagttgttagttggtgaggcagcaaacacataaaagctcaccatgttttaatgtctcttctgtgattttcataatcaaaacacacatgcttcaatcatatgtttcacattgcttactaatgtctttgcattataactcagacctgtgcttctaaacgaatgtgcacacaaatcacccagtgatcttgttaaaatgcaaattcttattcaagagttctgggaggggcctsagattctgaattcctamcaagctcccagggaatgccaatattgctgatccatgaatgcctcaagtagcaaggctccacaccattgtaatgtcaatgtaaacattgttgaaatggcaccagtttttggaaaagctcctggactccccacctaaactcttctgactgtaattaaacatgatcaacrttacaccaagagaggtagattcagcagtgcccagaaaaaaactggcaagatgccttgaaactgttacctcttggcctttgttttactatgtaaacacaaaaggtctttgctcctgcactttaggtctgctgctacaagatgaatgtagtctgaaggtgtggcaagttttatccagatattcaagattgcctttctctgctaaagtctcttccatatttaaaccataacatcccaggttctttatggaaacagaaataccttctaagaaaactctaaaactttaatctgtttaaacaatcataagaaagaatacttaagtgaattttacaaagggaaaaagaagctctgggccaggcatggtgacttatgcctgtaattccaactctttggaaggctgaggcaggagaatcacttgagcccaggagktcaagactagcctgggcaacatagggagaccctggctctacaaaaaaaataaatttaattagccgagcatacacctgtagtcctagctactcgggagcctgaagtgggaggatcacttgagcctaagagttcgaggctacagtgaaccatgatcgtgccactgcattccagcctgtgtgacagatcgagaccttatcttagaaagaaagagagagagagagagaaaagaaaagaaaaaagaaacaaaaacaaaaaacctctgtaagcatcccatgggaatctattttcttaactcttaatgattccaagacaacatctgttaactttttcaattcattagagtctaccactcaaaatgacaacatctgttaactttttcaagtcggtagagtctaccactcaaaatgaaagtcaaaatccattagaccactaatttctcatttgtgagttttgagttatctttccaccaagacaagttccctacttgagattttatcttttgtaggtcttcttcctctcttccccacatcattcttgagcactaacctagcccaaaccaagtgtcctatgtatgtcttcttccaatccggtaggtgtcacactcctcctatctgccgttcaactttgccttgctataatatgcgatttaacaggcaatcttggttacttggtctcctcttgcgtatttagtttttgcatcttttttttctaacaatgtaatggtaaaccgaacagaagtggaactcttttcactgggcacaacatatagaaggcaatggcagccatagcttgcgccatgcatagcctggagtagacaaacctaaatgaactttcttccttctcacttctcayggactcatttaggtgaatgccaaagatgacgaaggtgtcctcgttggatcctgggacaatatctrtgcctatggcgtccccccatcggcctggactggaagsgttgacattctattggaataccggagctctgagaatccagtccggtatggccaatgctgggtttttgctggtgtctttaacacatgtaagtatccaactgagtaatttctttttaatataaaggaaacttcactctaagacattttttctataacctaacaaagagacatagcagcccctgttgacactatagaatttatgggtgagccattctgggatgtagtcaatgcataattaaattgtagtgggccaaatatgctcatagtttctctttgactgcagaatctttatagaaagaatgatagactatatcctgtgtaatccatcacttaacacccraagaaatagagggttacagtaaaaatayagagaaaaaagccattttctttycagccaccacattttaaaaaaackaaaacagttaaaactaaaataataaataacaaaagatatatattgcttatttatcattgagaagttgtataaatatgcrtatttatttattattgagaattttataaatatatmcacttaatttttatcccagttatggaaggtattatagcaggtggtctcatattcrtttttccacatttctcaatgcccctgagcaattagagatcagaacataatgaacaatctttccctctccagtttcccctctggtttttaatccacccaacatccaatctgtagaggaaagcatatgagaacagaattattctcttcagtgtcaygcatcatttttcagaggcatttgcctctctagacccagacgatattacaattaattcagtgaatatttttaaaaatacatttatttcagtatgtcttcatcactggtaatgattttcattcacaagtcatttctacagccttggagaaacattaagctcaagttggggtgtcctttctgcctgctcattaataaagaatttttacctagctaacattttttaaatcaaaaacaaagggaggggttggaggctggagggaggtcatttaaaaaaatgattacaaawcctatttgttttagctcaaagtctcaacagtctaagacttggtgatctaaatttaaaamaaaaaagtcatgagttttgttttgttttattttcccatagtatcaaacaggataagattattttyttagccatttaaatataacccagggaagaaggaatacatatttcttgggagcaatgaaaatcaaaagtatagtcccctagaagcactggtctctgaagttccagatagaagccggaacttcatggtaggttaaaggttggaggtcatcccatccctcgaggctcccaaaccaagacaaggtaaaagatgcccaacagaggcaaccactcttgtgaaatgattttagaagacagaaaggacccaagttctccccatgcctacaatttcactatcccagtgtaattccttccggctcacaacaagataaaatagtgaacaccttacatcygttcgtgtctttggcataaaaaggttatccaatctatgcctgaaaacaggctttggcggtaaatcaagaaaaggcagaaacacacagtggggaagtcacaacgagagtaaacctgaagatggaaattgggggaaggaggaacaggtgccctaaagtcaagcctcactttcttgaaattatgagtaaggcagagtcttgaccaagtcgtgtctgggataatgtgaattagtgttcakccagaaacagaatgagagtggcaatcgttttattgataagaccctgggtgaacagggctgaaaatcaagaaaggaaratgggaacgggaggcccgtgrcagctgccactgttgtttggggcattaagatcargtcctttaaggaggrggacccttgaatctctaccagactccagtttggacttccaaggttgttctgttgaaggaggtgggtagtctttggttaaaaatgctaaactattctgaaggagaaaataaaaaggcaagccaagtcattaatcttaaaattgtcagctgaattattttcaatgagccctgatgtctggtgtcctgggaggcakggagggcatttggattaagtttaatcagtaggtacatatggcaagaaaggtattcagataatttgttatctattaaaaygaactaaaatgaatctgtggtgtcacccaccaatgcatgtcacaggagcaaattctggccaagacagcaaattccaccaaggacctactctgtaaattcctaacttcctattagtgggtttttaaaattgtattttcrggaacatagtcccattcatgggactaaaataatactacgttgatgatcaaacgcttagaaacgaaacaattagaaccctgttgggattctactctagttggcttcacctgacaccagctgcaattctgaaggatcacacagcaagatttctctctaccgcccccatggggttgaatgaccacccttttccagcatggaacatttgagaataacatgtccaaagggcttttcatgttgggtcaggaagaaagtcccctacaagaagggttttttcactctgtgtttattaaatgctggtgatgtgtttagctgtggtctgtcctttcctgtagttttacratgccttggaataccmgcaagaattgttaccaattatttctctgcccatgataatgatgccaatttgcaaatggacatcttccyggaagaagatgggaacgtgaattccaaactcaccaaggattcagtgtggtgagtttgattgacartggcattggctgatgtcacattatagtaatgttacacatttaccacaagatagactcaatctgatgtttctgttctattttgaggaccattcaacagcacaggcagaaaactctgattgtcaaagaatgttctagcaaatgattagwaatgttactgaagagacagtttgggttcctagtgataaaaatcaatcattccttataatagcaaccaccaaaaaaaggtcatagttttagctgctgcatatgcctatactagttcctctctacyttgatatattaatattacagttaatagcagaagtattggagccaagcrttctctgggtcagtgccctgggactaatagagctaacatttatttagtatttactatgcatcggtcttggtgtatgcatgatcttatccagttctttttagttgtatcaggtggatgttattaatatcgccatttacaaatgaggaaactgaggcccaaaaaggcttgctcacggtcatacatctgttgagctgggaataaacccaaatgcttctgaccattaaccacaaccttttaaatgacttcagcagtataggttttcttttcgaatgtaaagatgagattctccttgattatattgtcacctttcattgagatatagaaatgggagtaaagctgaaattgttccccaaaaccagctgtggggttctctcactgccctgaacagctttgttacaagctggctagagggaacttaagatcccagggaaattccatttttccttgagaccccctaagtccaaatcaatacactaagaagaaacgraaaaaatcctaagagtttaagtaggaagaatttttatcaaggtctgtgtgggaggaaattggggcataagttcctctgtggtcaggcattgagctaggtagaacttctaagccaaaaatgagtctcatgcacaaataataaagctaaaacactttctgttatacaagcatccaaatggggatggtaggaagttacaagttcattttaagcaaaactaaaagttagaagtgcctgaacttcatgttacaggaatggatcacagttgtagcagcagtattaactcaccagtaggggcacacattcattggagaatgttgaaatgaaattgctgaatgagtagcaaagtgctaccatgaattaaaaatagttcggttcattggaagggaatgagctgagccatagtaagctggagggcacgtgtaagacaaaaccttgtctctgtaaattgaacagaaatttaaagaacactttaagcctgcagaattataatatagcagccctgcatgtatatgggatgacaaaacagaccaaaatagtcaccccaaaaactcattgcaattgttaaaaatgacaaaaagatagttatttggcattctccatatctcttccttaaaaacacacagacacacacacacacacacmgacagacacacagacacacacacacagcctttgtagctaagtgcagttcaaagttatctttcccagctccttgattcaggtacctcccatcatcaaataagtccctatgaggcactcctacaaataaccccacaggccctaaacagagttaatacaaaatagcgaaggtagatcttgcccttggtaaccctgtcctcwttcaggtccctgctccaaattacttccccttttcctgacaccatttgttcctttggtgccttactcaaatatcccatcaccctgagactgttcttcctggcctgggaccctcacccaccctccactgcagaccactgcccgagactcctcttcccttcctttgcctggcttgtagtaggttttcaacgcatgatgcctgatcagatgctctgactgactgcggggctgagaccagcacaactcaggacgtgcccagaccatgaagcacagggattaaagggctcagtgggatctgaggccaagacttggctctgctactgcccaagctgtgtgactttgggcaaggcacaacctctctgtgcctcttttctcctctaaagtggagagaacaatattccctgcttcactcatcacagagccgagcataacaggtgcctaatgaacgttagctgctattattgccttcattattagtcacacagctggaatttcttagaggcaatatgtttccatcaacccaagtacatcaaagcggtcagaaaaagagggatgcccagtgtcctaagatgactgygctatttctgttactttggggtatttttaaagaaaaagcagacacttggcctcaccagtgcaaacacccatgcaccttagaagttataggtggtccaggaaaacaagagtatggctaagactctcctggattgaggaggttagtgcgggctgtccccagacagatcagccagtgcatgatcaccacagccacactcctatgtcaagctctggcttgggcagctacttgctgtgtggctttgagaaaatgacttcacctctctgagcttcattttcttcatcagtagaatgaaagtaatcttagtagttaccatttcccgatggagtgrctataatgattaaatcaggtcatccaggtagagtgcttaccatagaggtaggcctgatgctgatttaattattattggtcactggtaagaagcaggggctgcctgagcatagggctggtgaggaagggtgagggtgagggtgarggtggaggctaaacaggggctgaggtgggggtgggaatgatttgctgggcatcagctgacctctgtgaggtcagtgcggtgtagactggcgacacatggcctgatggatttcctagcaaggatctcaggagctattggcctcatacttacctccctccacaggctctggtcaaacacacccacctcaacctgtcttccccgctcctggttggtttgtggctggggcccctctcctctccaagtaaaggagacctgagaacaatctctcatcctccaccatctatttcttcttcaacactcaggtcccaatggtccacagtttgtgatgaatcagtttgtccagttaggtctcagtgactcagggtgtcctcttctccatgactcagccaaatcccagcctgccgaaaccagaaatcagccagcagggaggctcagaggaaaagtacaagagggtgtgagaggtgtattctgctcgccacactccagagccaggagtgacaagtttggctctgtctcttgctgtgacccttctcgccttactactgcagaccatcaaggacagactgcttcctggtttgccaccgtaggtcccctgcatgaaggatgtttccttccaagagggagcctcacctcaggggggctacagttttgcacagagcggccccactgttgacgccaacagaggccatggtctgagctccttagctgttcaggagagggmtggggactcaggaacctcagaagggcagagcagggcagagtaattagatcccagggtagcaaatgaaaccccaagtgggcaaatgcaaagtagcagatcccagaaggagcaatttcggccgcctgtccccagygtgctgatgagttctgaattatgtgtaacctctggggggaaggcagctatgaatcactggacagtttaatgaagacgcttgctcaatgtttagctgcagtccaaacagcaaatagaatacgagggctcagtgaggagggagtcagggctactcagaggggcagggggacagcaatggtttggcctcaccttggaagagctcagcttgatcacctcattatacaaaggtcacagtcaaaatggaaacaattttaaaagacagagacgttggcacttactaggatcaagaaagatttttcaatgaaaggcttcgctccttctaaatgaagaagcctccctgtgttcttttgctggagagagtgtggtctgataggatgattctgggtgagggttggtgtcctcctctcagcttttccccaccggaatgcacccacccacagggggagcagtgtctgatctattttatttttgttgttttgtcagcatgtaacagtrtgcagggcatagagcaagcactgaataaacagaattgcttggaaaaaatttttaatgcataaaaactccatgctgcaatgggtggtcttaatctataaacaaasctttttcaaagcacattttagagcagaaattaaccagctttcacacctgggacactgccctaatcagtgtataatcctaattctcattatgtcctcagtactcatatggtgtttyacacattgtaggtgcatttttgaaattgagattgttcttctatacattattttatttttatttttatttatttttattattatactttaagttttagggtacatgtgcacaacgtgcaggttagtaacatatgtatacatgtgccatgctggtgcgctgcacccactaactcgtcatccagcattaggtatatctcccagtgctatccctcccccctccccccaccccacaacaggccgcagagtgttatgttccccttcctgtgtccatatgttctcattgttcaattcccacctatgagtgagaatatgcggtgtttggttttttgttcttgtgatagtwtactgagaatgatgatttccaatttcatccatgtccctacaaaggacatgaactcatcattttttatggctgcatagtattccatggtgtatatgtgccacatattcttaatccagtctatcatttgtggacatttgggttggttccaagtctttgctattgtgaatagtgccgcaataaacatatgtgtgcatgtgtctttatagcagcatgatttatagtcctttgggtatataccaagtaatgggatggctgggtcaaatggtatttctggttctagatccctgaggaatcgccacactgacttccacaatggttgaactagtttacagtgccaccaatagtgtaaaagtgttcctatttctccacatcctctccagcacctgttgtttcctgactttttaatgattgccattctaactggtgtgagatggtatctcattgtggttttgttttgcatttctctgatggccagtgatggtgagcattttttcatgtgttttttggctgcataaatgtcttcttttgagaagtgcctgttcatgtcctttgcccacttttcgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctcttgagtttcattagatcccatttgtcaattttggcttttgttgccattgcttttggtgttttagacatgaagtccttccccatgcctatgtcctgaatggtattgcctaggttttcttctagggtttttatggttttaggtctaatgtttaagtctttaatccatcttgaattgatttttgtataagctgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagagctctgttttgttccattgatctatatctctgttttggtaccagtaccatgctgttttggttactgtagccttgtagtatagtttgaagtcaggtagtgtgatgcctccagctttgttcttttggcttaggattgacttggcgatgcaggctctcttttggttccatatgaactttaaagtagttttttccaattctgtgaagaaagtcactggtagcttgatggggatggcattgaatctgtaaattaccttgggcagtatggccattttcacgatattgattcttgctacccatgcgcatggaatgttcttccatttgtttgtatcctcttttatttccttgagcagtggtttgtagttctccctgaagaggtccttcacatcccttgtaagttggattcctaggtattttattctctttttagcaattgtgaataggagttcactcatgatttggctctctgtctgttgttggtgtataagaatgtttgtgatttttgtacattgattttgtatcctgagactttgctgaagttgcttatcagcttaaggagcttttgggctgagacagtggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtctgtgccagttttcaaagggaatgcttccagttttggcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggctctgtttatatgctggattacatttattgatttccgtatattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctacccggctttggtatcaggatgatgctggcctcataaaatgagttagggaggattccctctttttctattgattggaatagtttcagaaagaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttattgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtccctgagattctggtatgttgtgtctttgttcttgttggtttcaaagaacatctttatttctgccttcatttcgttatgtacccagtagtcattcaggagcaggttgttcagtttccacgtagttgagcggttttgagtgagattcttaatcctgagttctagtttgattgcactgtggtctgagacatagtttgttataatttctgttcttttacatttgctgaggagggcttttcttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttrttttgagcctatgtgtgtctctgcacgtgagatgggtttcctgaatacagcacactgaagggtcttgactctttatccaatttgccagtctgtgtcttttaattggagcatttagtccatttacctttaaagttaatattgtcatgtgtgaatttgatcctgtcattatgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattcggggttgaaaattctttctttaagaatgttgaatattggcccccactctcttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcgtctcgaggagtatctttgtggtgttctctgtatttcctgaatctgaacgttggcctgccttgctagattggggaaattctcctggatagtatcctgcagagtgttttccaacttggttccattctccccgtcactttcaggtacaccaatcagacgtagatttggtcttttcacatagtcccatatttcttggaggcttttctggtttctttttattcttttttctctaaacttcccttctcacttcatttcattcatttcatcttccatcgctgataccctttcttccagttgatcgcatcggctcctgaggcttctgcattcttcacttagttctcgagccttgcttttcagctccatcagctcctttaagcacttctctgtattggttattctagttatacattcttctaaatttttttcaaagttttcaacttctttgcctttggtttgaatgtcctcccgtagctcggagcaatttgattgtctgaagccttcttctctcagctcgtcaaagttattctccatccagctttgttcctttgctggtgaggaactgcattcctttggaggaggagaggcgctctgctttttagagtttccagtttttctgctctgttttttccccatctttgtggttttatctacttttggtctttgatgatggtgatgtacagatgggtttttggtgtggatgtcctttctgtttgtcagttttccttctaacagacaggaccctcagctgcagatctgttggagtacccggccgtgtgaggtgtcagtgtgcccctgctggggggtgcctcccagttaggctgcttgggggtcaggggtcagggacccacttgaggaggcagtctgccccttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggccgctttgtttacctaagcaaacctgggcaatggcgggcgcccctccgccagccttgctgctgctttgctgtttgatctcagactgctgtgctagcaatcagcgagactccgtgggcataggaccctccgagccaggtgcgggatataatctcctggtgtgccgttttttaagcccgtcagaaaagcgcagtatttgggtgggagtgacccgattttccaggtgctgtctgtcacccctttctttgactcgggaagggaactccctgaccccttgcgcttcccgagtgaggcaatgcctcaccctgctttggctcgcgcatggtgcgcgcacccactaacctgcgcccactgtctggcactccctagtgagatgaacccggtacctcagatggaaatgcagaaatcacccgtcttctgtgtcactcacgctgggagctgtagactggagctgttcctattcggccatcttggctcctccccctaattattgtcacttctatacattattttagatgctgtgtatgactcatctagttggacttttatattgtaaaattatcttcaattttaatcactgtctgcaaagcagaatgatctaaaaacgaattccaagtaaaatagtagagaagaaaaattcagaatgtagaccaaattgcttaaagatgcttaagggtttgtaaaaatatcccatgatgcattgcagttgccaattctggacagttatcagagatkcttattttcaaacattttcttgttaaccatatttctggccaagttggttttaggaaaatcacctggagttagaccatgagccttagcattagaggactgagaatatacactgaaggyacacaatagtgttggaaaaaacattatttgccaccttcaaagaataagagtagctcatgttcacaaaaatacttttttttgcaatgccctgatttaagtgctgacatgtaytaatttacttctacctcttaacagcatgttaaggtaattactgttagtggcacggtaacttaaccaaggtyccagccaataagtggcagaacctgaattacaaacccaagggggctgaccccagagcccactctttttaaaatgacatccttattgactgggcgtggtggctcacacctataatcccwgcactttgggaggccgatgcaggagkatcacttgagatcaggagtttgagaacagcctgaccaacacggtgataacctgtctctactaaaaatasaaaaaaattagctgggcgtggtggtgcatgcctgtaatcccygctacttgggaggctgaggcaggagaatcacttgaacctgggagacagaggttgcagtaagccaagatcatgccactgtattcctctagcctgggtgacagagtgagacttggtctcaaaaataaataaataaaaataattaacatccttattaaaatatgcttcacggcctggygaggtggctcacacctgtaatcccagcaatttaggaggctgaggcaggtggatcacaaggtcaggagatcaagaccatcctggctaacacagtaaaaatcccgtctctactaaaaatacagaaaaattagccaggcattgcaggctaactgtggcaggtgcctgtagtcccacattgcaggctaactgtggcaggtgcctgtagtcccagctactctggaggctgaggcaggagaatggcatgaacctgggaggtggagctttcagtgagccgagatcgtgccactgcacttcagcctgggcgacagagcaagactgcctctaaaaaaaaaaaagaaatatatatatatatatatatatatcacatgctacaaaatttacaaaattcactcctttaaagtaaagtacacaattcaataatttttagtatatttttatttatgtattattattattattttgagacaggttgtctctcacccaagctggattgcaatggcaagatcatgactcactgcagccttgacctcccaggctcaagcaatcttcccatctcagcttccctagtagctgggactacaggcacacccaccacacctggctaatttttaattttttttttttgtagagacaagatctcactatgttgcccaggctgctcttgaactcctggcctcaagagattctcctgcctcagcctcccagagtgctgggattacaggcatgagccacggcactaggccatttttagtatatttgtggtcttgtataaccatcattatcatcagattccagaacattttctctcccctctgccatacctattagcagtcactccccatttctccaactctggcaacctcgaatctactttctctctctatggatttgccagttctgatcatttcctataagtggagtcatgtaatatgtgaccttttgtgtctggcttccttcacttagcgtaacgtgttcaaggttcgtccgtgttgtagcatgtatcagtacctcattccctttcattgatgaatgatatttcattgtgtggataaaccaggttttatttatccattcatcagttgtacatttgggttgtttccatttttggctttcatgaataatgttgtwatgaacattcaggtaaaagtttttatgtgaacatatgttttttatttctcatgggcatatatttagagtggaatttctgggttgtatggtaactctatgtttaatttcttttgatgaagtgccaaactgttttccaaagcagctactccattctgtattcccactagcaatacacaaaagttccaacttcatattcttgcaaataacttttattttctgttttttttttttttttaattattattgtagccatcctaatgggtgtgaagtggtatttcatggtgggattaattttcatttctctaatgaccaatgacgttgaacatctttttgtgtttttcttggccctgtgtatatcttctttggcaaaatggttattcatatttttgtcccattttaaaattgacctacttttgtattgttgaattgtaactattctttatatgttctgcatataagctctctatcatatatgtgatttgtaaatattttctaccatccatgggctctcttttcactttcttaatggtgttctttgaagcactaaagaaattaatttttataaaatccaactttttaattatttctttggatgcttatacatttggtgtcatatctaagaaaccataacttgatccaaggtcacaaagatttgctcctctgttttgttctaagtgttttacaatcatagatcttacatctaggtctgggattcattttgagttaactttttatgtatgtatgaagtataaatagaaatggagaagagagaaaaataagagagcgaataagagagaaaactaaaatcatcttattgattatctcttgtacatggtaaattatttttttaatgttgtcttaaagattctttgtttcactcaggtctgagatttgaaaaagaaaaaaagtaaaaaagagattctctatttgtcttcagcttttgacagtttgaatatgatgtgtctaagtgtagatatcttaagtttatcctacttggagtttttgaactttttcaatgtacataataatatctttcattgaatttgggaaatttttggctatcgtttcttcaaatattctttctgctacttgctctctttcctcttcttctgggactcccattaggaaaatgttaatatacttcatcaactgcataagtaacatctcacctgtttctggggctttgattttgttttagttttttgcttctgttattcaaattggataatttcaattggcctaccttcaagttcattgattcttctttctgcctgcttaactctactgttgaaactagtgaatttttcattttggttattgtacttttcagttccagaatttctatttggttccttttcataatttctatcttttcattcgtattctctatttgatgagatataattctcatggtttcccttcagttctttgaacatatttataatggctaatttaagatctttgtcttgtaagtccaatgtcttagctttcttaataccaatttctcttggctgcttcctgtgtatgggctatacttttctgatcctttctgtgtcttataatttttgttgaaaactgaacatttaaaataatataatgtggcaattcttaaaatcagatttcctgttctctagcacctattgttgatgtttgctgttgttgttgtttttgctgctgctgctcgtttatttagtgaccttcttggactaattctatgaagtctgtttttcttgtcatgtatggccactgaagtgagctgagttagcttagtggtcatataacaattggacagagatttccttaaataccttgggccaaaagctccccagctttagccaagtagcgttgtgtgtgtgttggggaaagtctttaattaacccgcaggcagtttaaaattcttcattagccttcacttcctgtgtggacagagcctcaagatcaaccagagatgagagatgaggaccttcctggggcttttcttttgggcatgctcacagccctgcacatgtttgtggctatctatgtcagagtttttcaaagcctcctatggacatcttattccctgttttttctttcaaagtgttttggatagcccttttttagtctcaagtggtattgccccttcaggcattatgatgttaaacatttgcttctattttatttttatacattatatgaatagggctgattcagaatgagctgtgaatcagatcaaataaaaacaagccctgagaatggagcttttcagagagctgccaggcaagttaagcagtggcaatttggagagaaagagctttcggagtgttcaaaactcattttctctccttcattggtttctaggctgcaagtttgcaaagctactgaggctactggtttttaagactactgtggaggtggggtgagaataaggcaaattaaaactccacaaagtcactcttcttactgagatttatgtttgtttgtttttttccttgaataaatgcccctcagattgttgtttgcttcacttccagagttctggaaaggtcagctgtgatcatatttgcaagtgttctcattgctctatggaggagcagatttccagtagtccttactctgccactctggaggtgtttcccagagcccactcttaaccactacacaagtgcttcctaccacactgctaaggtgctttacattttgtaagaatatttttggcatctagtagagtcttcctgacatatatctgctgaaacacatattattgtatgtatatccttttatttctccatttctcccatacattacggggcatgatattgatcttttagaaaattatgtatgtagaaagccatctatggatttagtttcagcctaatgaaggaatgtaaaaaatatttgcttaaaaacaagaagggggcattgctctttgaaggttggaaatcactgccctacactctcctcccgttcctctcaggtacccatccattcctgctgctggaatgtctccaaagagcgcctgaagccctcattccactcaagtctcacttgagagtaaaccaaggggagtttgggggtaaaatgtcagaggtcattgtaataacttcttgggaaattaggcagaaagggaaaaaaagtgggaatcatttaataaaccacatagaaaacactccatatggcaatggaatcatgttctggttaatcataatttttgcctacaagagtcatcatatataccgttagaaggttactagttttaaagtaattagaaactaataaagtatgcaccgcctaggctatactgaatgtaatgtaattccttttggtaattaataatacctctaggaacacgttacaaaaataagagccatcagctgtagaatatcatattcataaatagtttataatgcaaaacagtaactttggtacctactgggtctattggttggaattcttttaacccttttcaataattatggagacacttgtccagaatttattatataaacttttttatacattagacttttacaaacaaatgctctcaaaattcaatattttcttcatgttcagtcaggatattaattcctagcttgctatgccagagtggtaaaagggggtagggcttcattttcaaaatgaacccagcaragggaacccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaaaaaaataataaaacacgtaatcacaccatggggaaaaatgaaaggagaagaaaaaaagaaagctggataatcagcccctaattttctaaaaattgctattaacaaagctgctktacaattctcttgataaatatccaagaaatctgttcttggaagcttaagaagagagtggaaaggctgtactctcaggactaaggaaggactcactccctaaagactttgtggatggaaatttgttcagtactcctgtagtgtgtatgtgagtgaggacatctggactggtatctagccaggatgccctggtagaactgcatttagcgttgatgtcctttccgatgggttgcaacatccatttggttcatgcctgtgtctgagcacttattaatggttttgactatcactcctactacacatacacctcatagtttaatggtggaagctacagcacctgtccaagtgcacccygccatctgcaaccccctccattgaggtctcttgtgctatatcagactgtatttacacgtgacttctcagtgagacttgcaaaaccccttgccttcacaggacaagtaagaataaacacattcatttcttcttttttcttggcggtcagttgattcctacaacagcatcctttactgagctgggatgcccatggcgccctccatttatctcccatatagcattgctatgcaaatgaggccattcatgactggctacccagggcttccccaggtggctcccagccagagggatctgaagcagctgagcctcagagaggacaggggccctggcctagtctccacctgactggactgctggcctttgacatgacgccagttaacatccaaatgccccttgctggtttcagcactccaacaggctcaaacaatgaatagctgtattctgaaatagtgtcatgctcgcagctccatcaaagattcctgcagcatgcctctttcctctgaataattcctttctgtcatcttccttcattatatttcctaacaagtttttttctaagtccaggctttcatttccactttgaaatgtcttgttagacaagcctcagagtccaccaaattgttcccacttctttccaacaactcccaccccatcctatccccactgcccctgaaatggccagagcttaataatccaggatgtcctgtcattattgtcaacaatattgttgtctgtattcggaatgtattagcagaaccagagaggtagggctacacccatctgctacaaatacacaaatgatttgcaagatagacagtgcctttctttcaccccctgccagttttgctatgaaagaattcaaacccttggtttacagttgaagttggtccaagacatctcctccagggctttctcttgatcttatttgtgctctcccctgagccctaataaagctgcacaaacaaaattacaagcccatatctctttcttcccttttaagaactccttttctctgaaacatttctggacagatagattgtaaatgagatgaccctgtggactgtttaagcagttagttagccaagttaaggtcagtaaaggactccttgtttaaattaaccactttattttcttcaaacacatagcaccctgaagcccatgttggtctcagctgtgttctctgtccagctcttcaccaccccataggctcctatacctctggatatgaccttagccagaaccaagacagattttgaactactgtgctctactgggttttggtaaaataaatacataaataaataaatagtcctcagtgtttcggagggaacctaatacatgtttattatgcagtattttaaatgttgcagaaaaaataccaaagtaagaagtatcyattttctaactactcagaacatctgtaacatttccttaacccttctgtaatatgtctctttgtgtgtcgtatgcatgtttttaatgctgcataccaaagtaccaaagtaccacaacgtaacagcttaaaaaaacacaacttatcatcagacaattcctgtgggtcaggagtttggtcactggttgactgggtctctctgctcagggtctcagataactgcaatcgatcagtgttggctgggactgttgtcccatctaatgctcagagtcctcttccaaattcattgaggttcttgaaagaattcagttccttgcagctgtagaactcatagatgcttctatcttctttgaagccagcaggagaatgtctctgctgctttgaatccctgacttgctctgtctctgatctctagacccagacttaaaaggctcatctgatgaggccagacccacctgataatctaccttttaattaactcaaagtcaacagattagtaaacttaattacttctgcaaaatcctccttgacacataaagcaacatagtcacaggagtactagcctgttctgtttatagatttcacctacactcaggggagaaaattatacaaaattatgcaaaaggtagtgggagtcatttaaaattctgctctgcatgtgattttgaaacactaatatgccatggatgtctttcytgcctagtcaatatagatctgcatttttatggctgaatagcattctattctgtttcaaaatacttgatcacatgttggacagttaggctgcttccatgcttccactttccctttcttacaccatgatgaacattcttacataacacacttgtctttgcatttgtatgattatttcccgtgtacaaattcaaagcacatggatttactgaatcacaacataaactatgacgtcccatgtagggtcccccagcaggggatggtgctgctgttctagtgaagtactgcctttggtgaaggttctctgagtcctttgtaccaatactgctgaattattagcatccttgaaaggagttctaaaaattactagctgtcactgcacggaacacacaggaagaaacataaagcagagatgtgttcttcacttgtcatctccatcgttatcctcccaaaggttgttctcatcttgattaaacaagtctcaatgaaatgaggcctttattttgatttctatactgcttctatagaaagaggcaacaaggagatttagaatttttttactttaaagggacacggtaccttttgactgtatagtgagaacttaagtttcaaatgaaggctccgagaacataaaaaaccatgaatcttaaagagaaacaaacaagcaaargtttaataagaacttccttgctagatgtcctcatgatttatttagccaacacttactgagcacctcctaatgactgggccctgctctagtgctggagatgtgtagaagaataagaccaacagagctcccaaagkagatttatgcactctacaaatgcatgatggaattgcaagatgaaaacagaaaaactcttatggatctagataaagaagctttagaataaaaagtagcatttcaggaatcagttggtattttccaacctggagaatcagtagatgaaattaggaaaagtctgtacggaaggaataagtgtttgagatcaaatatacaacatgttgkctatagttaattatactatactatatatttcaaaattgccaggagagtaaatttcaaatgtttgcaccacaaaaataaatatgggaggtaakcgatatgttattaacttaattatcctgcaatgtgatttgattttatatatatatgtaaaatcatcactttgtaccctataatatatacaattatacaattattatgtgtctatttaaaaaattaaagatatgctaaaggaagttttccaacacaaagggaaatgacactactgtatattgaaaattagatcctctgacacgtatgaattgcagcaaaaatgctaaatatctgagaaaaatgctcacgcctgtaatcccagcactttaaaagactggggcaggaggatggcttgaggccaggagttcaataccagcctgggcaacatgagaccctgtctcaagaaaacaaaacaaaacaaaacaaaaaacaggaaaataaatgtctgtaaacattagcctctttcatggaggaacttgggatataaaaaactgagcatgcttaaatagaattgtgtaatgtcagccaaatggaaactcttgaggcacgggtggcttaggacacaattcccctagtcattcctgagtagagaggattgcatggtgaaagagatccccatggctgtggaggtagcaccctctcgttctcttcatgggctgtctgggagctgagccattagctttccacccattgatggaggcccagccctactgggagcatttgcttcctccccacctcacccactgcctgcaagttcctgaccctgttatgaaactcccaccctaaatacacagataacgtctcagccatgagtgaaactagaagagatcatgtgtaactaattagatgtcagagtgagagaaaagaaacttttccccgggtcctggtcatttgaaaagaaatattatcctcaaagaaaagtctttacttgagatctgaagtgcaaagcatatttatcttgttccaggctaaccttgccaaggatatttgaatttaaataaggctattctggagcctattaatctagggtgatggtgtagcagtgaaagccagggggtcactaaacacttcgggtcgtataggaagcaggacggcgtccattcagggttgcaaatgttttattgctgtttttccctgggtccttctgcctgatggggcaaccttcactgctctggagagaggctagcagagtcattgtctaacatacacagtgacctcccttccagcttccaagcaaagatggaggctctcaggtgggaactgacctcatgttcctgctcagagacctccacaccttcaccctaatccacatctgtacccttctctccctgcagaccctgccttgcttcccacatctgtccagggtgttgctctcagcctcatcctcttgcaaccttggtatttcagctcccttttatattcccactgtctctaccttcctccattcctccatgaacatgcctcagtctcttttaatttgaaaataaccgaaacagacttccctgcattgcattacatgctagcccctgccctatcttttcttctgtcttacaacctagatcacttttttttttttttttttagacagggtytcactctgtcttccaggatggagtgcagtggtgcaatcatggctcactgcagccttgatctcccgggctcaagtgatcctcccactcagcccctcaagtagctgagactacaggtcagctaacttctttaactttaatagagacagggtttcgccatgttgcccaggatggcctcaaactcctgggctcaagcagttctcctgcctcggcctcctaaaatgctgggattactggtgtgagccactgtagccagcctctaagtcactcttaaggaagaagctacctctttcttccctcctcattcatttgtcagctggctttgcccagccctcctccaccacccaccaatactcccgcaacctcctcctccgcttcatccaatccagagcatcacaagtgtagacaaaaatgcctcttaggcctcacctcctgggtttcccacaggcactcaagctcatcctgcccagaattgggctggtcatccacccatcaccaccagtcccaacacagactttcttctcttccttttttattcacagtcttggtaaacaaaaccatcatactacttggacaggcaaaagtcttccccaactcatccgagtccctcacatctccctaaacctgtgggttgtatccccaatggcttctctccctctccatggtgctggccacctgaatgcctttctggtccactattgcagttcttcaggggtgggggacagccggggaggactcagctcaatctccagccttgcctctccatccatcttccacgaacagagatttgcaaatttagatcttcttcttaaattattccaatggctttttatagcctaagaataaagcatgaatgtttartttgatatcaaaggatttcacaatcttatcctyacctatatcataggtcagtgttgaagagtgtggatttcagagctctatcactaactagctgtgacctcagcaaggttcttaaccttcctgggtttcagcttcctcccctgtaaactgggggtaattataatagtactgttctttttttttttttctgagatggagtctcgctctgtcgaccaggctggagtgcggtggggtgatctcagctcactactgcaagctccgcctcccgggttcacgccattctcctgcctcagcctcccgagtagctgggactacaggtgcccgccaccacgcccagctaatttttttgtatttttagtagagacggggtttcaccgtgttaaccaggatggtctcgatctcctgacctcgtgatctgcccgcctcggcctcccaaagtgctgggattacaggcgtgagccactgcgcccgaccaatagtactgttcttatagggtgctagggacatcagatgtgttaacatccatgagggttttagaacaccacttcgcactaaggaagtgttatatgtatttgttagtttcgtgcattgcctgccatcaccgttctcctatgaacctgaatgttcaaacacgctatgctccagccacaacacacagcagacagttccacaaacaaaccatgatggctatttcatgccgctgtaactttgttcttcctccttttcttgacctcctaaattcccatttatctttcgagcctcagctcaaacatcacttcccaaatacctggagactttgctccactgagactccatggcaccccaaatcaacacccgttttaccagggatcatttaaattaattatttttcaaagcctgagagttaccatttttgagcacttaacacatgccagtctgtgttcgaaatacatgtattagcttatttaagtctcacagcaaacctatgacagttttgataattggtttacaggtttgtcatttctcctagaagattaccctttatgggtaagaatctatgttttgatcatctctgagtctccagcacctaccaaggtgcctggtgtgtagtgggtacatagtgaaattaatatctcttgaaccaatcaaaaatgggctgcactcagagaaagatgggagcatgggcaaacagctgacatygaagggcgtctaggcacggaacccgtggtagttgaacctgaaattcatcagtgtcataaacaaagactgctgtaactacctcaccacattattaaayctttctttattactatatgaacattttctatagtgctgaggggttaatgtgctctcatttgattctgtactgtcatataatttcaggtcttttcaaggacataataatacaattcatgatggcattttattccatgctcttgcttccagggtcatattcaaatttctgagaagttttccatgacccttagcacttttaataaagggtaaagagagattcaccctgacaacgtattcttcttgttggacacgagatggaaattgtagagaattatagtcaggcataattgttgtagtttctacagtaatagtctaagaccacaaacacaagtattttttgcttaattgctacaaaggaatatgctttttctaaataggaactatattaaaaagttcaaaataaatatttcagttttggttaacttttcttccccaccctgtcggyacctagtaagttctgtttcgttagtsagcagaaaatggttaagattaaaactgttcaatgcactgattcaaatatctttgggtggccttgaagctgctcttagcagagggaaagagacatccagccatktgagtgtcctgagggatgccaatgagaatsaatctgcccagaaaacccaagtctagagccccaggatatctccaggagccctcagatttggcttaatccattctaataatctgtagatagcatatgcacaggatttggggtcacttttttttttttttgagatggagtctccctctgtcaccaggctgaagtgcagtggcacaatctcagctcactgtaacctccatatcccagattcaagcgattctcctgcctcagcctcccaagtagctggractacaggcacccgccaccacacccagctaatttttgtatttttagtagagacagggtttcatcatgttggcaaggctggtcttgatgtcttgaccttgtgactcacctgccttggcctcccaaattgctgggattacaggcatgagccactgtgcctggccgtcacttcttgatctcttggagcattgggtgtgatgggaagtttaacctttctgggcttgtgttttctaaggaactaccactgctggaatgaagcatggatgacaaggcctgaccttcctgttggatttggaggctggcaagctgtggacagcacccccyaggaaaatagcgatggtaaaactgtgtcctccctctgggaacttgcttcattgctgatytttgttttgcttttatgcttgcatttgatgtgtgggaaccacgcccattgggaggcaacatctgaagtgtgcttcctgggcacatgtacagtattagctaccttccaatcaggtttaatttcatttccattgtcagctttaccctgattattttacagattttagagaaagaatataaaacaacgtataattcatccattcttgctttgctaagcagttttgaagacaggagagaaaatatctgtaagcatttttactaggctataaaatatacttcagccctttgtggtatgcactggtaagatataaggcaggagagaaaatagagaactcgaaaaataattatagatcatcctttaaattgtttttccagaacctrgcctccttttatgtcatgtgatttcctccaaagcttcagtatgtgggtatttgtcttctaacttgccaactatgctaagcagctgcagctctgacctcccccagatttttataaaatcacatcataagcctccatctctctttaatatgataatataaagaatcagtagactgtggatattatgtttatttcctcaggtgttgatatatcgatgggcacacacaggaacatgcataaacattcaatggatattcatactgaaaccatattataatcctaggctttaaggaagaaagtttagcactttctggtgttctggtatatatatcatggggacattttacaggtgactaatagcagctaatctcttattaactatatagataggtggttaaaatttaaagcattttagaagagtaacataggccytctgacttcctaaatgcatggtgggcatggccaaaatgcacaggcaatgtccaaattctccagttaaacttgacatatgttcataatgtccaaaaacaaaagacaaaaagcaaaacaaacagcaacagcagcacaaccacagagcacacatcaacatttccaacatttcagataccacctgaacaagagataaatgctgtgtaagccacctgcttggcatcaacacatctgggtatgtgtctgtaggtggcagagtagatgcaggaatagtgttgccttgtatttatttccatggcttcaatttttggcttgagggggcatagccaatggaattctcttcagccttggaaagcatctgggctaaatcagcaatgaagttgggaacactggtctttacagagtcaccctcagtgccatgaatcttgcagtatctggacagaattggagatgacaaactcacayygcccttcctctgtgcaatgcaggcatgtatcrgtgtggccccgcctcggttcaagccatcaagcacrgccatgtctgcttccaatttgatgcaccttttgtttttgcagaggtaagcaggaagctggaggaaagtgctgtttttytccccaacctcttaacacatgaaagagtaagctaaaagttgttgtttctaagttttccaggtacatagcrtatgcttcgtgttgacaaaggtaactaggcattattccaacttccaggctattaatgctaaatgcagttcttgtttaacrtttttctttccttgatgttttgggattccctactcccaaaagtaaatgctttactaacattagcttagttctctgcacccattaagtatcaactgctccagagaaattatatgactaatggatctctcaactaacctcattggaagagatgggtcatgaattgaaatttcaggacatgccacttccctctgggactagtccagcaatccaggtaagacaaaatccacatacacacacccaaccatggtcttaccctggcctttgcaatctatgtcctgccatcccacaccatcacctgtggccagggagggagggttgagttgccaaaggaggaaggggagcctggaggctactctaagagaggaatacagcccacctacagggttgatgggaatgcctgggcaaaggctctgccatttcagaagaactaggcagggactggaagcagaacaggctgttaaaggatactcaaggagagctctgaaaatcaaattaaatgtaagagatgttgggtaaacgagaaggctgggctgccggcctaggaagacttgaaagactgagaggcaggacttccccagggtatatttgcaccagtaaatacactgaaataatgtctttcactttgcctaccattggatgctcttagcaaccttctaaaattgataattcttcccattttacagaaaataaaatcgaggcaaagagtgattaagtgactttctcacaaccatctagctaataaatagcagtgctaagatttgaagccaggcagatacctgaatgcayactggtaaccattgcactctagtactccaggaggaacaaatagttattattaatgtacaccaggcattgtactggggggaattctaaggttcragtctttaagaaacgtatttctagatgccaggtgacagggcacaaacacactgaacatgaaataacaacaatacttgtcaggtgggccatgtagagagcacagatctgcattcatatgatgcatgagttgggaagtagaggccaagaactgaagcaggatggcaaagaccacaagacaccatctaggaaggaagggcgacctgggaacagacagtgaggatgcctgtggaagtgtccccaggtagtaagagcagagaactgtgggaccacatgggaaggagggatgattaggcaaaatgattagaaagaagccagaggaagggaggagtgcaaagcagggggatgagttgagcatctgaaagctttgtgggggcagttgaaagctgtgcagactcactagaacgccaaggatgcatcaggggtgttggaaggtggaggctgaaggaacgcagtgcagaggacctccctgagagacttgctccttgtccctcctgtaagtgagggagagttttcactgggtgggaacttgggcaaggtgctgacagccttgtggaacacggattggaggggttgttatgaagttgtggggaacatctagagggctggtcatccctccaagccagagatggaaagggcatgagctagacaaatggcaataatgaggaaaagaggaggcaggactgagaaatgttaatatttagaaagcaaaacgaacatcaaaattcagacagcaagatcaggaatttgaaacacacaaaagaccagtgttcatctcatcgtacctgcygtggcagtttacagaagcctttggagaccaagcttactggacttggaattttatcccctcgttttcactttgggatttgaagatttccacaaacctcccagctgtcatttgatagtttatgatgctacgagagcccctaatgaggagatcactctgaaatccacaaagccttgttttcagctttttattacactttattgctgcaaagaaggagaagraggacctccctccacaagcaagctgcctaatagctgtaaatgcaaacactttttgctattattaaatatagatcggggtgttatgaatgtcatcaggatttgcagattataattactcctttctcacccactgcagaggcgtgtctgacagagggtacaatttgttgctttggcatgggctgcgctccaggggctgagccattttkaagagatgtttgagttgatgaaaagtgtatgaggaatcttttctcaagggtgcctgcagtgggaccccatggggagtgtcatatgagtcgatatgactcaggttcgagtctgtggctctctctgctctccctcgtccttgctgcatcagctcgccttctcttccctcccagcatgctgactttcttggtcattccttactcatttccaggcttgatcaagcatcatgttcattgactgttttttagtgttcccagggccttagtctccatgagtgaaagcagagcctaaaaagaagaggggtatgcctggaaaatgtcttaccttctgttccttttttctctcctcctccactttggaagttcaccctccacatttctgggtttctgccagggcttgaagcttatttctcttacccctcccttcccatgtcctccctgctgcagtgggttcctgtggatctgaagccccatctgcctatctccccagcttatggtggcctagggcttccaaataggtgagaggagatgagagctgttctaagcgtctggagtcgtattccaagattccatgttcacgaagccctcaggggttcttagtgaagaactctctccttcttgccaaagataactctcttctgtcctaacttctcattaactctgctgccctctttcacaccactccaccccaaactcactcacatacacacacacatgcatgcacacactcctgcctgccctcactggcgctgagatgattttgacaggagcaataactggctccctgggaccacagcaaccatctcatcactcaagaagctaagccctcctctgctgtgggccagcagttctcttatacaacgtgtggagatgttttcctgtagattattcattctcaattcaaacttatttattttgctactatcttatcagatgcagcctatttttttggcatctcctacttggctataaaataatccagtcatttattcaaatagcatacaaaactytggaattattttagctttccttcttaacctcccttatgcatcttgccaaaaataccttcccaaaattatcataaatccagccacttctacaatctctatcgttaccctctgagctctgtacaacactgagctccataaagttacctcctaactcctcctaactcatctccctgatccccctcttgctccttttctgtctattccccacagagcaagagaattattctttaaatgtaaatacaaacatcacactcctgccccaacccttctggtggagttccaccacccttacaataaaactgaacataaattcctacaagattccatggcttcccttccacttcatcccttgtttatttccctccagccatactgagatttttctcttcrgaaagcatccacacatcctcttgtgtcagcacttttagacatactgctccttttgctaggaaagctcccctcactatctttcactctgtgtaggaagaatgctttgcatgctttgttccctctctgcattcaagtctctgctctggtcacctcttcaaagaggccttcgctcacccaactscacctaaaatatcaccatctgccctgttgttttcatcctccaaccttagtgtgtactccatttctcccttctagaatatgagctccatgaaggtagaagctcttgtaaccgcattgctgagagcaggatctagggtccagtgccaggaaggcattcactgcctccatatgccctctgagaagcagcattttctctgcagagcctgcagacaaggttatctccacttggaaacaaataaacaaaccaaagcaaactctgtccagggtcctgaaagcaagagcacgtctctagcctcagtggtgaagagcatatcttctgccacctgtggacaaatgttcacattctatgggcccaggtggacatttgcagagagcagcccccaagcctgctttccaccccacctttactgagaagctagggccctgaccaatggtagaggctactatgtaggaagtgcctgtacttaagaggcaagggtgtggtgttgtgaaaaaaatatccaatttcatgcaccaatgcccagattttgtgtgatgataacccttcaagtgtagggatagaaaaaggggatcactaacattacattcaaaagaaggaagaaaaattagccgtaaatgtagggctttcacaagtagtaccaatctatccaccagcccgacaaggaaggtaggctcagagagattcagtaactcggagggaggagccaagatggctgaataggaacagctccagtctacagctcccagcatgagtgacgcagaagactggtgatttctgcatttccatctgaggtaccgggttcatctcactagggagtgccagacagtgggcacaggtcagtgggtgcrcgcaccgtgcgcgagccaaagcagggtgaggcattgcctcactcgggaagcacaaggggtcagggagttccctttcctagtcaaagaaaggggtgacggatggcacctggaaaatcgggtcactcacacccraatactgcgcttttccgacgggcttaaaaaacggcgcaccacgagattatatcccgcacctggctcggagggtcctacgcccacggagtctcgctgattgctagcacagcagtctgagatcaaactgcaaggcggcagcgaggctgggggaggggcgcccaccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcactggttctcccagcatgcagctggagatctgagaaggggcagactgcctcctcaagtgggtccctgacccctgacccccgagcagcctaactgggaggcaccccccagcaggggmacactgacacctyacacrgcagggtatwccaacagacctgcagctgagggtcctgtctgttagaaggaaaactaacaaacagaaaggacatccacaccaaaaacccatctgtacatcaccatcatcaaagaccaaaagtagataaaaccacaaggatggggaaaaaacagagcagaaaaactggaaactctagaaagaagagcgcctctcctcctccaaaggaacgcagttcctcaccagcaaaggaacaaagctggayggagaacgactttgacgagctgagagamgaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaagcaaggctcaagacctacgtgaagaatgcagaagcctcaggagccgatgcgatcaactggaagaaagggtatcagcgatggaaaatgaaatgaawgmaatgaagcaagatgggaagtttagagaaaaaagaataaaaagaaaccagaaaagcctccaagaaatatgggactatgtgaaaagaccaaatctacgtctcactggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctgaaagggaagcccatcagactaacagcggatctctcggcagaaactctacaagccagaagagagtgggggccaatattcaacattcttaaagaaaagaattttcaacccagaatttcatatycagccaaactaagcttcataagtgaaggagaaataaaatactttayagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaataaccagctaacatcataatgacaggatcaaattcacacatgacaatattaactttaaaggtaaatggactaaatgctccaattaaaagacacagactggcaaattggataaagagtcaagacccttcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagttcttagagacctacaaagagacttagattcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacacaaattataacaaactatctctcagaccacagtgcaatcaaactagaactcaggattaagaatctcactcaaaaccgctcaactacgtggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaatacagacacaaaaaacccttcaaaaaattagtgaatccaggagctggttttttgaaagaatcaacaaaactgatagaccgcaagcaagaccaataaagaaaaaaagagagaagaatcaaatagacacaataaaaaatgataaaggggatatcaccaccgatcccacagaaatacaaagtaccatcagagagtactacaaacacctctatgcaaataaactagaaaatatagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaacaaaaaaaagagaattttagaccaatatccttgatgaacattgatgcaaaaatcctcaataaaatactggcaaaccaaatccagcagcacatcaaaaagcttattcaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaaattctggccagggcaattaggcagaaggaaataaagggtattcaattaggaaaagaggaagtgaaattgtccctgtttgcagatgacatgattgtatatctagaaaaccccattgtctcagcccaaaagctccttaagctgataagcaacttcagcaaagtctcaggatacaaaatcaatgtacaaaaatcacaarcattcttatacaccaacaacagacaaacagagagccaaatcatgagtgaactccyattcacaattgcttcaaagagaataaaatacctaggaatccaacttacaagggatgtgaaggacctcttcaaggagaactacaaaccactgctcaaggaaataaaagaggatacaaacaaatggaagaayattccatgckcatgggtagsaagaatcaatatcgtgaaaatggccatactgcccaaggtaatttacagattcaatgccatccccatcaagctaccagtgactttcttcacagaattggaaaaaactactttaaagttcatatggaagcaaaaaaagagcctgcatcaccaagtcaatcctaagccaaaagaacaaagctggaggcatcacactacctgacttcaaactatactacaaggctacggtcaccaaaacagcatggtactggtaccaaaatagagatatagatcaatggaacagaacagagtcctcagaaataatgccgcatatctacaactatctgatctttgacaaacctgacaaaaacaagcaatggggaaaggattccctatttaataaatggtgctgggaaaactggctagccataggtggaaagctgaaactggatcccttccttacaccttatacaaaaatcaattcaagatggattaaagacttaaacgttagaccttataccataaaaaccctagaagaaaacctaggcattaccattcaggacataggcatgggcaaggacttcatgtctaaaacaccaaaagcaatggcaacaaaagccaaaattgacaaatgggatctaatgaaactcaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgagactgtaaactagttcaaccattgtggaagtcagtgtggtgattcctcagggatctagaactggaaataccatttgaaccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactacgcagccataaaaaatgatgagttcatgtcctttgtagggacatggatgaaattggaaatcatcattctcagtaaactatctcaagaaccaaaaaccaaacaccgcatattctcactcataggtgggaattgaacaatgagatcacatcatcattctcagtaaactatctcaagaaccaaaaaccaaacaccgcatattctcactcataggtgggaattgaacaatgagatcacatggacacaggaaggggaatatcatcacactttggggactgttgtggggtggggggaggggggagggatagcatagggagatatacctaatgctagatgacgagttagtgggtgcagcgcaccagcatggcacatgtatacatatgtaactaacctgcacaatgtgcacatgtaccctagaacttaaagtataataaaaaaaaaaaaagagagagattcagtaactcatccagagccacacagcctaagtccaataatccttgccatacactctgaacttatctattgttctaccatagagcgtcaattgattttgggtggggccaatcattccatgcttttttaagctcctagatgattccctagtacaaccagaatagagaaccattccactacaggccgaaaccaaaaagaaagcttgctaatgtcgcttggaaagaataatttccctccacatcccaccccaacacacatatacaaaagccaccccatacaggtgtttctcgtctcctctctccgcaaaggacagtgctgttggtctgtcctgagatttyagcctacaggaatttctgaagccatattcaaggtgggggggcaggaatcagccactttcatattttgcttgtttccctggaaaaccacaagctgttataaggattgttattaagaagttatttatcattattgttgctacgatttgaaagtagagggggtcgctgtttgtacttacatggcttcctccagagggaatkcccgaattctcagacagctcatttaaagcttccaaaatgacaaatattccacaggtatctgctgcgtcctctcctgtcctgattcctgacttcacatttcagcctttcacaacatgtggctagcacccctgagttctggctgctctgctgaggggcagggccaccgtttatcaccctcagaaatctgagccgcaagtgtggaaccatctcaccactcaagctggggctcatgctcccgcagggtggtgtgggaaaggcggtgtgccgtgaaggccaagggccaggttatgggctgtcccagggcttgagctgcttctccagcagctcctagccatgaaaccacaaacactttgcctcccccttctgagtcttggtgccctcatccataatacggttacaatatatacctcacaggcttgttgttgtgaggttcaaactaaatcctttataaaatgtccctgaaacaytgtaggtatgcaacaaatgttggctatctcccccttagtagaaatccgacttcatgtgcactcagaacattctgtgagaaagtaaaattgctctctttaacctcaactttaaaacctagggatatatcttcaagtttccccattacctaatgatgactattatatttttactcaattttgaaatttacaagtcatgttcacatagatcttatctcactctggcctaaaatgctcccataaaattggcagaacaaatttaatcatttttattttatagaatcaggaactgaagttcatagagattaacatgcactttctacaaggacacacccactatcggaacccaggtttcttgcagcaaatctagtattcctctcaaatgccatctaggtttcaccttggctgttactttctagccaacccttgactccactgccccatgtgctcccaaagtatcttgtacttattctttcatggtacttatcgcactgtattgcagggcttctcaagcctgactatctaacagaattatgtgagactttttgtaaaatataatggatttagggcctcacgtgatttaggtcccacctccttaatcaggcgtctatttttgtttaaagttctccaggtgactctgatgcacagaatcatgcttactaaagcataaactctctaatggcagcaaccaaatctattttgttcatcattaggattctgaatccttaaacaatatctggcaatactattcaatattattatcaataacatttactgagcatttactctatgccagacactatgataagtaatgtgtgtgcatttgtttctgttaattctgccaatcgtcctatgaagaaggagttattatcaccctatttaaagagtgggtaactgaggcttggagaggagcttgggaaacatttagtaaatacatcaatgactattagcagtacaattcatgcttcctacctgcttccatgataataactggaaccttcaagaaagtgattataaaatatgtaataaaggactctggtacagtcagctttcaggcacacattagtcattgtctctagaaagtagaatagtaaagcagagccttgggagagcttgggggcagacagcatggccccaagacactatttctgagtcccacaaatagcacattttagttgctgaaccaatagaaaatagcctgaattcctcctagatcatctaatattattgttcaatttaaatacttttggcttcaagtagcagaactaatgtggctgaaacagatggggactgattttctcatataagaaatcctgaaataggtggtcctgatgcgggcttagccatttaacagcatcattaaggcccccaaatccccaaacgcctctcagctttctactctgccaccttctcattgtcagcagtgtttctgttcactgtctcacgatggccacagcagcttcaagcatcccttcacctgaaaacacctgaaaacagctgaaagcagaaggggaaggacaaactcatccatgtacctctctcctttttcaaaggggaaaaatgtttcccagaagccacctagcagacttcctcttcctcctggcagtaggtcacatagccacagttagcccaaaagaagtccagggaagcaagcgatgggcatggtggcatggcattgtcttctctcctrtgagaggtaggacttatcacaaggacagaggagggagaaaaatggttgcttcttagacartttattatctcagcctcaaataatctttatttaaagtactactaaatcaactagattcgcctttagaatattttcaaaacctgtttggccctatgatacgaatccartgttgttgaagaaaggggcatgtcagctccagagatctctagacgactgctctatggacagttaaagactttggcaacagcagacatgtgatgatggctaatgctctcctctcctgtttccaggtcaacagcgacctcatttacattacagctaagaaagatggcactcatgtggtggaaaatgtggatgccacccacattgggaaattaattgtgaccaaacaaattggaggagayggcatgatggatattactgatacttacaaattccaagaaggtaatttactaccactgaatgaagatttatttgcccaagtccattgagtacttattcattgtcactcagagatgagttccagagaatgcactggcatttgcagcatttggtagcaacagcagaagtataaactttcacrtgtgaaagacacgtcacatatgcaatttttcattgtagttttctttgctagcttgctttgggcagaattctcattcacstggcttgtaaaatgatttggtttaaagtcatacctaatttaacagaatatagaatatgttcttgctcacaagaaccttaattttaaataatcctattagaaaacactgtataactaatgtaattttagtccaataatagaaattaaaataactacttcacatttgtttagtactttaccaattatttccacatacattgttctattacattatcatggaagactacaacgtagayaatacaatattaataggacaatgcaatctctctaactcaggacaattaggtcgaaggccagtttcaattccaaaataatgtcatggtgggtttttgttaacttttattgcatagaatgtttcaaatggcactactgagtttaattctatctcaatcaatgcttagtgtccgstcyatgcctgcaattggtttggtgctggcgattccagcagtgagcagractcagttcctgtcctggtccragtgacaggattattgtgcagaggggtctttggaaacaataagtaggggcatttagtccaactgattcagaaaaagacttgagaagagaagtcgtggacctcggttaaagaagctggacaggggtttccagacagtgtgaacatgaccaaagttacagggcgtgcagcagcccggtatgtttagggggatcctgcaggctcagaatgcccagtgactgaagacaaagctgcccgaggccagcagtggccagaactggaggaccgtgagtgtcctgatggggaacatgcaacatattttgcaaatgattcactgccagaggttcttaggagtatttatttttagtaaatggataaaaatgacaagtaattagcatatacctaaatattcattggaatccatgaagtgctaaggagtgcagaatttattttaaatagtttagacagtctccctgctcttatttacaaaagtaatttgcactacaaagaagaarcttgctgaattgagaacacttgtgcatagtctcagaaagtcagaatttttgttatctgaactagtgaattttcactgtattttttaaatgcttcattttcctcttctgttggttatcatccattgcacaacacagatacaaaggtggtatttttttgtcatttggatttttccttaaaggaaaatttaaaacaatataagtgcaaataaaacaaaacaaacaagcaatgccctcttactgtagagttataagcaaaaaaaggtttggagaaacaaaaaagcaagttcatagaaaagttagctgcaacatccactcattcatacatacatccacacgacagctggctcttaccatctgccatcttccagtgctgtgtagagctggatacatgtacagccctgccttcccatgcagctggggagaaaagcagaaggcagccctcactgtgctgggtgagaattgctctggcacagggtggacgggtgctgccgggcacagagaaaggctctcagccaagaatcggcagttggggaagacctcgtggaggaagttagtgatgggctcactaagcccaaaggacacacaagaattggcagatgaagctggggaaagaggtccccaagaaaaggcagtaaggcaaggactgtggtgagaactctcgtatttggaagaagtcctgaccagacagagtagtgaagaaaagttgcacctacaggcagctaggggcagcaggaagcgagctgtccacatgacagatgtctcttggaaaccatggagccgagcacagytgccattagctgtcagcatggaggtgacagtgaaggccaactcaggaatgggacagaatcagatgccacgagaggaaagactaaaacccagtccacgaaacaggagtcaggggcttggctgggggtggataacaaattaaaacaaaatgtgtccgcactgcatgaggaagacatctgaggtccaggcctctagagtttagcaaggaggcaaggctgagggagagggacagtgtggaggtctggtccaactagaagaatccctaaatccacatagatggttgtaagcgacgactcatcctgcttcggggctggagtttgaccccaagtggatagtttcttaatcaagggtggcatacacatttcaractggaactttggaagtgaccaagtagaatgttgttttgagaagaacaccaagactgcatctgaatgtggcgggtagaaggattgatggccgccattggccactggcatgcagtgaggactcgtcatatccgtggctcagtacttaccaccctgattctcaccgttgaatctcttataatttctctgatccacaaatgctgagtgtagataccaaaatatggaaatgagtagaatcacaggaaacaaattattactagatttaggacttaactattttaatgaattaaatcatggaaagatcaggttcacttcaacttactaaagcttattattaactttataacttttttcaagatatataattaagaaacgataagactttgaaaatcagaatttctgaagacttctcctgtggcaatatatcttctttgataacagtgtcttgattccattccctctttgctccttcagttacttccagggtcactgttatttccacctctccctctctattttctccttccaatcagcatttaagcaggctcaaatatctgctgtgttaaaaacaaaaattacaaaaatctttttcaccactgtctcttcctcctcgcctccttgccgtcctggagygctgcctggacttgcgtcctgctgtgttccttctccactccttccgcgcacactctgtcctgatttctgctaccagcacttccttgaagttgttctcaaggttgccaagaccacccaattgtcacagggaagaaacattttgcagacttcagcttacttgaccttcctatacttcctggtgctgttgttcactccctttgcttgcaattctgtcttttctttgtttctacaatgttactttctcctggttccaccccctcctgcctgaccctcttttcctacctctttttgactataagcttttcccctttcttcacccttttcaaattccatttcattctaggcatctatccttgggctccattcccacccacctgatgttcttcccacatagctggtgttaatgttcacatatgtaccatcaccccatgtctgtgtctccaccgggactttacctaaatgtcctacagaaacctgacacggaacttcccaaatgacacctctcactctctccctcacctcaggtccgtttctcccactccccctactctggtgaagagaaccaccatccactcaaatttagctacttaagaatgagttaagcaacaaatcctctaaatgtcccctctgaaattgttctcgaatgcatcccctcccctccagctctgtagcctaaaaattaaatattatctggtgtgtacaactcttaatatagtgcctgacacataataagtgtccaataaaagtttcccctattactagtaattctgttattcctgccatactactgctattagtttgggctatgawtagttttctcctggaaaaatacttgctctagcttcccaattccacctcacctcctcaggccctccttccctcagtctagcccctgccttgctgccaaagtaatatctgaaatgtaaacctgagcctctcccagcactgcttaaaagccccacccccccccccctctccctgtggcctccagggcatccagtcctaactcacaaagcctcttgctaagtggcttttcggcacctggtcactgcacctcctgagcatgcccccacaggtattgtatgcagaggccagggacctgccagcagttcctccaacaagccaagccccccacctgcatccctggtcttgccctcgctccaaaaactccgagaggcctcccatgccccttcctttccccatgcactgcaggccaacctccgtcccagcatctgtggtgagcacctgtgtgctgccattgctcttcacgtgttccttctgcaccagtgagggaaagactgtttctcctctgtgcctagtgcctagcacggtgtttggaacattatggggtttccaacagcatgagatgatttgaatgaatggttactggggaggcactttcacagctaggcttagttgaacataaaatgtcctaaactggactattatgaagaggaaagttttgtctctggctgaaagcaaaatgcttctccaaacctcaatccttcagatcctctgtgccaggctgggtttcagggcctggggatgcagaggtggacaacatgtctctgttctcatggagcttgcattccagcaaggaagataatgtcacacagtaactagtactgtgacaaggaagaggaaataaaaccaggtatgtgttagggagagccgagaacactagggtttgaggacacattacacaaggtaagagggggaggacaggggaggtgacagtggagctaaagccagaagaatgagaggcttcgtccaacataaaagggctctcttattacatcctagttaatggaaagatatttttgactttgcacccagaggctgcagaagaatctcagaaaatataatctggctttggatatgtctctcactgcactaaaatgttgcctgtggccctgaattatgtaagatgccagagcacgcagcataactgtagagaaacaggaattactctgccaggctctgggaaagccgtgcagttgttttctcctctctgggcctgcgcttcctggaacagccccagcctgcttctgtttggcggtctccgctcacagaggacagtgcttccccagaaggaagctccaggttcctgcacccatggcaggctgtgaagttgcttgtggctggcttcaaggcttcttctcccattcacctcaccttggccagctcagctcctctctgatgtgttmctgatgctcgaatttscctcctgcattttgcctcaatgcatctctggcccgcatccaaagtgatcatcattaatgttctcttctcatggatctattggccagatgatttctgctaaaagatttcactgcacttcccttgtcctcactcctccttccctttttcttacctccctccgagtgctctagctgatgcttgtcctagaccaactgttcctggcacattcttgcagtcttgacaatcagggaaatcgttaatacacacacacactacacattcacattcgtatgcaatgccttctggcattttttctgtctttgcagagtagcttccatttattatatatctacttcctctaattcacctaataaacctaggatgtagacacccttattttacaaacaaggaaagtgatggtaataatagtgtctgtcttatagtgttgttatgaggattaaatgacacaatgcatcataagcacttatgccagtgcttggcacagagctagccctcagtgagggttctgatgattcattgacctctcagtcaccattgcattttattattaactagataaagtagaagacaatacctttaaactagcataattataaaagctaggattcttattttaaagtgatttttttttcactagccattctcaagcctagtttttacaagccaaggaatttgccttcatcttctcatctctatccttagggatacacaaagataaacccaaaggtatttaggatggaaaagaggatgatgaccatccctcacatctgcatgagccctgtttccaagccaaagccttttgtccaaggctctgtaaggaccgttctcccaccttcccagtgtctgaggcataagctccttctgaggcctgacttgtatctgtattttctgcctcatcacttagacaaagctatgtttttcttcttctggaggttaccctcctctttttcctcccttcatctccaccacaaccactttgcaaaccctgcacaaaacattttcctaaaagcagcacacacacctcgaactgcattagaacttaggtgcaccacygcctgtcaacagatgtccctcaaaaaactgccctccgtgtcagatgagtttgggaaaccttgtgtaaagaaaggcaaagaggtgtccttgctgctgggcttcacttagaacctctaatttgctaattaaggtggagaacatctccaggaggcgctggacaactagggcatctccaagggatctgaccggagcaccttgggcagggtcgcctttttaatgtcttgccagagcccagcatccttggggactgggggatgcaagttttggtagaaccttctgccatggcatgggtgttggggrcaatggcaattgagtgagatagggaagaacggggcaggagccctcaagggtcagctcagcaaacagcaagtgggacaggcccargtggaaggagagatgaggaagacaggtcttattggggggcaggtattcacaaatcagagagaaaagttacattgcaggaggtggaatggcaagaggcaattatttccaattattagaggtccccaaattctagccacatggctgggactaagaaaagcaagcaaactgacaccacagtttaagaaaagatagacattgccaattttacctcccaccccctgaaatagtggccccggagaaacccctttctggatagatcccaacactgtcacctcctaacttgcagcctaggctggtcactgactgtctggcaatctgactttgcagaatttataacataggaataatgacggcaccctcctcctggggaggtctgaagcttgtattatagaaacaccccaacaagtgcagtacacrgtgcatccattaatgtgactttctctctggtggattgtatttttgcctgtcattatctctggatctcccccaggtcaagaagaagagagattggccctagaaactgccctgatgtacrgagctaaaaagcccctcaacacagaaggtgtcatgaaatcaaggtccaacgttgacatggactttgaagtggaaaatgctgtgctgggaaaagacttcaagctctccatcaccttccggaavaacagccacaaccgttacaccatcayagcttatctctcagccaacatcaccttctacaccrgggtccygaaggcagarttcaagaaggagacgttcgacrtgacgctggagcccttgtcctgtaagctaacaatggtgtggttctttstgagactcgctgtctggcccctgtcttgctaggtgttaatgcccgttatagctttatatcaaagttaaagttccctccaagatctcagaagtgtgagcctcacagggagaacccactcattctgcaaaagcctccactttctttttttttatttttattttttgagatggaatctcgctctgacacccaggctggagtgcaatgmgaygatcttggttcactgcaacctttgcctcctgggttcaagcaatcctcctgcctcagcctcccgagtagctgggattacaggcacrtgccaccacrccaggcaaatttttgtatttttagtagagacgggrtttcactatgttggccaggctgatctcaaactcctgacctcaggtgatccacccacctcggcctgccaaagtgctggaattataggcgtcagccaccgcactcggcccaaaagcctccactttcatcctcacgtctcatgcacagaagtgaacattgaaaatttcaaagcctagagccccatgagttgtgagaattaaatgtaacttcttgctactcaaagtgtggtccatgagccagctgcatcagcattccccaggagtttgwaaaaaatgtagaatctcatgtcccaccccacaccctctgaatcaaaatccatgttttgacaagatcccaagcagactggagtgtacaggagagtttgtggagcatggatctaaatgatccatctcagaaacaggccctctgctggtgcctctcgcccaagttaggaaagtcttttgggggctgtccagaatgaatrgtgtgctttgctttcccattcaaaaagatacacgcgctgacataggccgcttcttaaaacgctgtctcctgtaatctcagcactttgggaggctgaggttagcggatcacctgaggttaggagttcgagaccagcctgactaacatggtgaaaacccatctctactaaaaatacaaaaattagcccggcgtggtggcaggcacctgtagtctcagctactcaggaggctgaggcaggagaattgctcgaacccgggaggcggaggttgcagtgagctgagatcgtgccactgccctccagcctgggtgactgagcgatactccgtctcaaaaaaaaaaaaaaaaraaaagaatggaggctggaaacaaagctgtgtcatctaggaggggcctaggaagaggttttctgcctctgccatctcttgtggggcctctttctcgtccttgcatgcacatccttccaagcattttcatcactgtaaaaactcagaatattttaagcagatcagggtccacgtgctacagcttgccttggggattacaatctcaaaaaatcacatttcctaggatgttcgtatttggtgggcacaacagttgaccacacgatgggcaacacaagtccattggaagaaactggtctctaggcagagaatgagttagagcaggttgcaaaggacctcgatactttggggcaccaatttctgttggcctgacatggggcactgaagagaaaagtgtacaaataataattttgacaaagcaaaggcaagcaaaactaatacgctcccctgggatggtcaagccacaagtctgaattgctctcaagctctctggattttgtggctgtcacagatcatggtccccttactgaggttttggaaaatattcccagaaaaatgagaaactattttttaaaatcctaattccaaggaacttactcaaatttgaaggaagcaaatctccccagcttcagtaatggagctaacaattaagaaatcactatagtggggccaggcatggtggctcatgcctgtaatcccagcagtttgggaggctgaggcgggtggatcaactgaggtcaggagctcgagaccagcctggccaacatggtgaaagctcatctctactaaaaatacaaaaaattagccaggcgttgtggcaggtgcctgtaatcccagctacttgggaggctaagacaggagaatcacctgaactcaggaggtggaggttgcagtgagccaagatcgtgccactgcactccagcctgggggacagagcaagacttcatctcaaaaaaaaaaaacactrtagtgttttctttggaaactaaaagctttggcacttttcctattcctagggtagtaaaggtaattttcatggaaaagaatagtcagtgtaaaggactgaagaggacaacagtcatggggattgtttaaaacaggcagccacatttgatttcagagagttttgcaaatagacaattctggatgtaagcgatgactgtgtcacctaccagctgtgtttcctgagcaaggtacttaagcactctgagctgtctctcctcatcygcaaaggggaaaaacagcacacacaccccggggttcttgattcattcccctaacctttatttagtgcttgcaagtccaggttctgttttatgctggagacacagcaatgcctattctkactgaatttctgatctcatgggggaaccaaacaaacaagtgaatctatagtatagttatatgggtaatagaaaaatacaaagcaggttaaggaaaacggggagtacctgtggagatggtcagaaaaaaaaccctctctaatggggtgacatttaacagagacctgagtgaaggtcagaagtgagcattccagccagaagaaactgtatgtgcaaaggccctggggccagagcatgtctgatgtgttcaatgagcaggaaggagccagaatcaggaacaaaggtggcaagggggcagtgctgggtgcagaccatataaagaattgtaggcctttataaggcctttggtttttattttgagtgagctgaggagcctttagagagttttgagcagaaatgtggcataatctaasttaggttttgaaaagaccactggctgctgtgttgagaagagactaaagaggaagtagggcggaaggttagagactggtaggatgcttctgcaatcactccactgaaaggggttgatagcagtgatggaagcagcgagaaccagtccgatctgggcatgtgctgaaggtggagcccgcctgattggctgagagactggatatgtggtgtgagagaaggarggtatggaggaagccaaatgagtgatgaatgtgaaatgtktgccacatggtagaatcttagtaaatggtaacttccaacatgtttacatttggggaaactgaagctcgagagatgagtcgatgtgttcaagcccccacacagcaatgagaggcaaagcagataatagagtagacagataatagcagtgacagtgagccagttcagggtaaacttggccccaagtgggccaggtcccttccttgtgctcccattacctggagtctagcacagatccttagacaaagaaccaaatgccagcccttttcccacctcacaagtgtcctgtctcataatctccttccccttccctctttaatccaattaaagaatgagcttgtatgggtgagtagaatgatatcattctctcagtcatcgacctagggacagctgaccaaacctatgcctgagtccataggaacacatctcccattcgcttggccagccccaggttgtcctgaataacttgaagggaactggagactctttgttcctttgccctgcaggcaggtggtattaactgtgaccaataaattgtatattgaaatataaattaaattgcagtgtattgcaaaaagccacataacttcaggccttgatcaagcattcttagatgcctctgctgcaaagaaagctttccaagtagaatgggaggcatactttccagattgatgattaaagggaatgtgtgtgctggaatcagcttgggagatctgaataacttaaacctctccgtaccttcaaaggtgctatcatttccacttggctatatttagttttctttgctttttggaaaagagatgaggcagctccagtctgtgtctcccttggctttccccagacaccgtaaatgatattggcagcatcccagccctaccrctcatagagcgaaaacctattcctccttctcctgccacgtttaataaactttatctagaacaatttcttgtgcagtggcaaaacacagcacttacataacatactatttcagaagcactgttctcttgggctctgaagcacagcctggtttctttagtgctatgatttagggagtgttctacctcagagaagaaaggggtcctgatactgagattataaaggtagcaagagcctctgtaaagaaatcatatcccattagccaaaagaaatccagtggtcaaacatagtcctctagaaatagtcagargaagtcattttattattgttattactggaaacagctagaggcaaaaggcatcttcttcgaggccttccaccttgccacttcatccattctatctagagacacgataaactgaccatttgtgctcatctgaggctgtaaccaatagagggccagaacctcactcatctaaacaattawttgcaaggggagccatggaggaagcagggtccaggcttaggtccaaagacagcaatacgagagcgggtcattccaaaaggcaggacctgggggccaaggtcaaggcaaggtcatagctttaaagagtcagctctaaatggaatagctctgccccaggaatcaagccaacaaagctagctctttagcgcttgcccaaaataggccaatacattctaataatccacctgccctatgcggggtttcttggtttcagcaccattgacattatgggctggatactttgttgtgggactatcctgtgcattgtaggatgtttaactgcatttttggcccctatccaccagattccagtagtaacccaccctccaccccagttgtgacaatcaaaaagttctccagacattgccaaatgtcccctggggataacattgcctcctattgacaactactagtctaggatgaccaacctttctagttttccagggattgatggggttctcaggatgcaggcctttcaatttaaaacccaggtagttctcagtccaccctaactctgccctaacttaccccttctgctgttagaacctcctgtctctcagagtatctcacacttcaataggcattgtctggggtcttattcaaatgcagatcctgacttcactggtgcagtaagaagtcagagaatctgcatctgtaacaagctcccaggtgatgatggtgctgctggtgtgcagaccgcaggaggaacagcaaagacctggactggaaagccatcccttccactggaacccaggctgtctgcagggctgattctacagggatgcccctggttgttggagtggcccttctcaaccctggctgcacatcagagtcagctgcagagctgttaaaaatacagatgtctaggtcctccaaggctctgatttaattggcctggaatgagagccagcttggtaggtctttaagggtccccaggtgattgtgatatagagccatgactgagaactcttcaatcagaagtcctggaagcaaggcacagcacttacgcatctgyaaagagacttccaaatagaagtgctgcccaagacagaggctttcccagcctcttggtcttcaaggtccagagcaagctgctgcagatccatcgcaggtgtgagagttcctccacagatgatgggcatggctcaatgcacccacaccttcgagccagtggggagtcaggggccctgccctctgctctggtgcatgcccatccacaggcaccccaccctgctgcaaaactgctgttcagtacagcaggctaaaatgaattaccctctgtgctcaaactgttggccatgaagctgtttccttcaataacttccacaggaaggggaagtctttggcaaaagccagaaactgagaaggaaagcagtaaagacattcagttctgtgaaggttcatagagtctgttctctgtggctggggatggaggaatgagtcacccattcacctgcggagtctgccagctgtcggcacatacaggcatctggctccaaccaggtagcagtgggtgcacacctgggctcagcctacagaaaaactgcccattgctctctagaatcctggacagtgggaaatgggagttagagagaaagtgagccagagccacaagatagaactcaccatcctcagcccagatggtaattggaggggagccaggaccactctccatcttccaaatgccattctcattggcttgtccccaggacctagaaatctgacatcagtgactggtttccattgagaaaacaattgtttggcacagaggtcttctaaatcacaaacagaggttcggagatagttgaatgcctttggtagaaactggtttcaacagcttccttctcttaaatagaaaaatcatatcagattggagagaaaatgtggaatgctacagagaaaatgtgtaggtagttgacaatttagtctgagtgtggcccatggcctaggtgagacacttcttatttgacaagggatcctatgtggaatgggggccttggacttcagcaccccacatgttccattttgggatgatcccrgcccaaatcaaagccaccattaaaacccattggtccttctttgccatgaaaatcacatcttttccatggcatttcttttacaacagcaaaagaactgtttggaaggtttgacacattttctccagtgagacttcaatgaatattaaatttccagcacattctttacctaagaagcaggacagcttatccccaattgactctttgttccacttgccccttacctttgctgtgttcctggtggcttccaggctaatgtgggaggggtagggaaacttggagaaaagtaaagcagaccctgtctcaagtcttgatgccaggcctgtgtgtgttttctcctactagtcaagaaagaggcggtgcwgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtcagtcttagcgtctcatcctggaacagagacaaaggcacgcagacttagtgttcatgtgtgcatatgygtgcttgtatgtgtgtgtgtgtgtgaatgaatgtcctgctcaaaaaaaaaaaaaaaaaaaataccagtgctaggatcctcttgttctttgaaagaagtaaactgccctatatatagacacatacatataacactttcctctcctctccagatttaaatatatagatgtggctgcagatataaatataacctgtgggtataaacacacttgtggaggaagataaagatgtgtaatggctacagatacttagaactttcagtgtctccagaataaagtgggtcaggcatgctataagaggtagataaactgcctgcaacattttggacagtaatattgtttatggaggtataattgtggatagtagattgcacagatcaaaatatacagcttgatgatgattttgtatgtgcgtgtgccttgcaaccacaagccagatgaagaaatggaggatttccaacacccctagaaggttccctsttgccttttacagccaataaccccctagactatcaccaagatagtaacttttctgacttttatcaccataggtttgttttgcccatttgaccagtagttttcatgatgcctctccagtgatcaccagaaatctctgcccaaatggctcaagagacttggcagaggaaggccgagggttgatgakagtggaagataaatgtgggagcctctgtgctcctacttctcaggcccacagctgtagcttctgggggcatctgtggttgcatccatgagacrccttyctgccctggaagcaggaacccaggcttctggcagtgaccctgaggagtgacatctcatgcagcccttatccaggtcttagagcccttccctagtctctggagaacaatcttcttgaagtgattaagagcaattagcacagatcctgctaaactacattgctctaaagtggtagataaatcaaagctttataaagttgatcacattttaatggtcctagaggtgggcagggtgagggtaggtagtccttgcttctcgtgaatcctttgctgtgagtcatttggaaagccaatgactgctgtgcagcattcagaatggcagtgtttcttggrtaactactgggctccagacgctgttcttaaagcactttacatggttgcattttcaaccaccaacaaccccacaaggtaaagagtactggcatyactttacagatgagaaaactgaagcacagagaggttctataactcctccaaggccatacagccagcaaatggcggagctgggcttccaaccccagcaggctggctgcaaaagcagggctgggaaccagctccttcaactgaacgttcttatggtctggtcctgtgtaattgacacagtgagccaccccaaggcaagtcccacccaaactcacgggcatgtaatgcccatcagggagcagaacaccaggcccttcttttctacaaaggcctacattgtcatgtctctttgtttccttcgcctctgtcatggcccacaggcccaccatggcgttgtgtgcacaggacgcctgaaaagaatgaaaacgaggctgtgcagggttggcaggcaaagggagaaacaaatgcaaaatggagaggtggggattagggttgctgcagaggtaccatcatccatgagaacgtgaagttaatagcttaaggtgcaggatgccctaaccccgaagctgttcttcacagctggctcttcctatagacatgtgggaccccctgctgcaggcctgtcccagctgcttggtggaagcagcttttgctacccttctgggctrttgcgcaggtttcatttatgagctcaaccctgaaccttccctgacagcagcraggcctgtgtgcgtacctaattatgaagtgacggcctgtccctgtgaaggtctcaggagagaggcttcccaagctgtgaagtgctcaaaccacagcagaaaatagaatttaattgcaccactgataataaaccggatgkatgaaggaaactgataactttcatcttttaggcactattaatttgcaggattatttgttagttatcttctgggtttacttaaagagcagtttaattccccagggcacaatcagaataccttatcccacaagttagcagacctgggcatgtagagagtactttaaatggagagttrtattgttttgtgtttccttccacaaagsaaccagagatgctgttcctggaggaaacttatttagaggtagggacatttgatagggaagagagcatgagagagatggagattctggcttctgtccatgccaagtttgttcaaaaaggtggaatggggcatcatcccataaactgtcctttaaccattagcccaactaactccaaggataacctaaatccaaatggagtagaagtgctcctgggtaaagcactcacaccctaaggaccacccaggagtcacggagctgtgagaggccctgagtgcagaagctccggcctgtggactggggacctgcctagcctcctggagaggtgaaatgcagagtcatagcaggggagggaaggagggaggggaagggagggagaggagagaagaacagaggggagaggagagaacagaggagaaaaggatggagggaggggaggggaggggaagatggagaggagaaaaagaggaaagaaaagaggaaggcacaggaggggagaggagagaacagaagagaagaggaagggacaagagggaaaaaggagcgagaatgggggggagaagagaaaaacggggagaggagagtaataagaaaacttcaagttgaaatattccaaaggaggcctagggagaggggtcagataaattgtataaaacacaactcaattaagagttattttttctccttccttccttccttcctttcctgtctttctatttttattttagatttgagggtacatatgaaggtttgttatgtagataaacacgtgtcacaggggtttgctgtacatattgttacatcacccaggtactaagcccggtacccagtagttatcttttctgctcctctccctcctcccatcctccccactccagtagaccccagtgtctgtttgtttccttctgtgtgttcgtaagttctcctcatttagctcccacctataagtgagaacatgcggtattacgttttctgttcctgcattagtttcttaagaattatagcctccatgggctttttttttcatatgcttgttggccatatctatgttcatgtcccttgcccactttttaatggggttgtttggtttttttcctgtaaacatgttcaagttccttatagatgctggttattggcaacatcaccaatcatcagagaaatgcaaatcaaagccaccatgagataccatctcataccagtcagaatagctataattaaaaagtcaaaaaataactggtactcgtggggttgtggagaaaaaggaacacttatatacggttggtgggagtgtaaactagttcaatcattgtggaaaacagtgtggccattcctgaaagagctaaacacagaactaccatttgacccagcaatcccattactgcgtagatacccaaaggaatataaatcattctatcataaagatacatgcacatatatgtttattgcagcactattcacaatagcacacacatggaatcaacctaaatgcccatcaatggtagactggacacaatgcagccatagctgtaaaaaaggatgaggtcatgtccttcgcaggaacacgaatggagccagagaccattatcttagcaaactaacacaggaagagaaaaccgaatactgcacgttctcacttataagtgggagctaaaagatgggaacatgtggatatatagagggaaacaacacacacagggtcctattggagggtgcagggtgcggcgtgggaggagggagaggatcaggaaaaataactaatggctactaggtttaatatctttgtgacaaaataatctgtacaaccctcatgacatgagtttacctatataacaaacctgcacatgtacccctgaacttaaaataaaaggttttttaaaaatgaggacttggaaagggagctaaatgcagtaaaagtacgaaaccacaatggctcagaggtccagaattacataggatatgtttctctaaattctaagaaaacgctcacaccctttttcaacctctttgagcctggatggacacacaactgactgagcctcaaggttgctgtgggcaaatgtgccaggcacagggtgaaattatgtgagagacagagaggagaccacagcccttcctgctcagctcagtcaagataagggttgggaccagcccctggtgattatgatgacagcagctatgatttattaagcactacattattaaacgcctctcttctatgatcttatttaaccctctataccatcctacaaggaggacgttactataaccctattttactgattagaaaactgagaggaccagagaaggcagtgccttgtagcacagtggtcagaacatgggctctggaaccaaatcatctgagtttaaagcttgttttctgaacatcataactgtgtaaacctggacagatcatttcacctctgttggcttctgcattctcatctgtaagtcaaaagcaatggtaactctcctcctggggtccttgtgagttttttatgagtcattggatgcccgagtcacagtgcacacctacatatgttggttgctgctattattgccattattgctgtttattagtaactggcccgtgatcacgtgcctgttgagggaaggagagacacttctggcccaggtcttcctgacttggaagcctgtgctggcagccgctgggctacaatggaactatcacaaaaagcagaggtggtcattgactttgcagagagttttgtattcaagggaggagagatcacacacacttgagtggtgtgggacatcaagaattaagactgtagaaagatgaatggtctccaatgaacagataacgttcaaccagtagagatggatggagagaccccttcagatactaggaagaaaatgttagcaagggctagagggraggtggacggcagtatgtagagcagtgagaagcgtgccttggctggggtggaggctgggagcagggatgagtaagggtaacctgaaaaagatagcttgaggctatgtggaggggagtctacaattttggatgagagctttatcatcgactctctgaacaaagaggcttcaagggagtttctagagtgggaatgtaacatgattgtcaactctgctctcccacaagtcggagccgctttttcttcctcccttctcttcaaagcctttgcccaaagcattgtcttctccaggaagtacccaactcagccttggaactggagtttcctaaaagctagtttccagctgttcttacctgattcccctttagatcaaatctaggccaatctggaacaatactgggctcacatgtctgaatccaagtcaccgtcaaccaaagcaggccagtggcttcctgtttgtgcatcccagtggacccagtcgtggattttactggtccctgtggtgataaagatggggcctgggctcaatagtgctcccagtcaaccattcccagcacccaccatgtgtgagtcagagtgtgtgatcctcacatggaaacaggcagagagagacagtcattaaactttaatgagcacacgtctctttccccatgctatcaaaatattttgatgagaaaagaaaatttcattacaatcagacatagaatttttctctgccttcccatgtgttgcttgttctctctctctctctctctctctctctcacacacacacacacacacacacacacatcctctctctgaacttcagtatcccctttgcaaagtgaatacactatgattatactgctccttctattaagtacagtcacatataaaacactgcactggggggattgacatctgtagcaatgtttgtgagaatgcatggcccacgtccagacctagtagctgttggtaaatgttctttctcctctgtagtcccatcaatgcatgggggttgcttagggcagcatgtgggccactggcctgaagtgggccagtggcctgagtgtggccctcacctagtggcatggaatctcttgaatctctggtcaccaggtgttgagtgtatgcagcattccctgtggaatggggccttcctcatgcagggaggcccgccttggagatcctggagtaaggcctaggggagagaggagacactcacatgttcctccaatgatctctactcagtacctgccattctaaagcagctcaggagccagcacttgtgtggtattatcatgtggaaaaagtcctgcagcctttgcaggatgtcaggaagcaccaatagaactaattttctcatgtgaactaggaacaattttgctaggagaaaacataaccattttttatgtgtgtgatttttaaagttacaagcataagcaaacagatgtctccaaatttttcaaaaaaaaaaaaagcttttaaaatgaggacaattgactgtttccaagagtttttaaaagtaagcgtttgctctgtatttattttgtccattagctgaaagactttctagtttttatttatctctttatttagtcactcttgcattcatccattcttcatatagttatttggtgcccactctgtaaataaattgtagcaaatgcctagagctttcaaaaccattatcagagaggccgggtgcagtggctcacacctgtaatcccagcactttggaaggccaaggtggstggatcacttgaggtcaggagtttgggatgaacctgaccaacatggtgaaaccctgtttctactaaaaataaaaaattagccaggctgtagtggtgcgtgcctgtaaccccagctactcaggaagttgaggcaggagaatcacttgaatccaggaagcagaagctgcagtgagccgagatcccgccactgcactccagcctgggtgacagagcaagactcaaaaaacaaaacaaaacaaaagcaaaacattatcagagaaaaattcaacagtgagaacattttctttctttccttttttttttttagatggagtctcactctgtcccccaggctagagtgcagtggtgtgatctcggctcactgcaaccttcgtctcctgggttcaagcaattatcctacctcagtctcccaagtagctgggattacaggcgcccaccaccacgcccagataatttttgcatttttagtagagacagggtttcaccacgttggccaggctggtctcgaactcctgacctcaggtgatccacccaccttggcctcccaaagtgctgggattacaggcgtgagccactgcgcccggccaacagtgagaacatttttgttgcatttttctgaaatggggaaaggttgcgccactttctttcagcactggcccacctggaacagctccaggagtgcagttgctctgttttaacctgagctaaccagcacttacacagagcctggggtgctcctcttgcaaagacagtgtacatggggcctgtgaaagakgcttaacccacagaaatcgacttcaacaagcagaatatctgcatgaccagcactgattggtggggaattgtatagataacacaagatccatgggaagtatcactgttgaccccggagaggaggcagggaccttcctctgggcggcttccctccaggccagcactcacccctgtgcagattgtgcccatctgcaggtgggaaggagacagtgaggggacccagtccagcccactcgccaaccatcaagccctgcagcctggcatggagccacatccccccaaaaaagggggttcccttttccactttgcacagttgcatcctggctccagccccatgtccagatctcttccaacttgggacactagcttgttttttcttaacaaccatcctaatgttgtgttctaactggagcttttcatgagatgcccacaatttttaccgaggttaacagtagaatcctcttcagtctccctacggctcacaccctggaaacccaccgggatggaccaaggaagggtgggtggctgtggtggctgctgatctcactcctcccacatcccattcatacaactttatcccagaggacacattaaaattggggaaaccactgggcacggtggctcaagcctgtaatcccagcactttgggaggccgaggtgggtggatcacgaggtcaggagatcgagaccatcctggctaacacggtgaaaccccatctctactaaaagtacaaaaaattaggcaggcatagtggcgggcacctgtagtccctgctactcgggaggctgaggcaggagaatggcgtgaacctgggaggcagagcttgcagtgagctgagatcacaccactgcactccagcctgggcaacagagcaagactccgtctcgaaaaaaaaaaaaagaaagaaaaaaaggggaaaccacttgagatataatgagtgccccaaacaaagtacatgacagtgactggctacactgtgagacttaactgtagtttcatttagtgctgtaaatatcacaaacttcattaaggtggaaaatgggaacagactatgtgttctaattattgctgaaccctgaccattttcccctccatgtccacaaccgagcacgttctctctccagcctcctgyrctctctgtggctccatcgcactctcgtcaccaagattcacccctgcccacacccacacccttcatggggaggccggggatgggaaccaggaggtgggcttcttcacctctcccctttgtggctctcttctctaacccctgagaaaccgaatccacgtcattctccatagaagaccctataggtgaggaggttctcagggtcaccctggcaacatgttctccctttaaacctcatatttcattaatgctagtatgtgtcagatgctctgttgtatgatattacattgagtcaccccactaactgcataagaagctgaggcccagagaagtcaagcgacttgtctaaaaactcaaagtggcagccccggtcttcagcccctgcatccagcttgctctcccttcagcttggcctggaatagcaccactgtgtgcatcccagtcacctcagttatgtccgtgacactgtttcaggttatttgtggagtaaatcagaggtatctacctatgagtcctgagggactctgagcaaggaaagcctgcttaccccaggggaccctaggaggggacaccttcagccctgctcccatagctgactctcsatcccctcgtggctactttcacagaggattgtggccgtgggaccaaaccgtgggtgcccttagccaggatagatgatcgtaaactatgtctatgagtgagccctcctcatcgaaggtgttcatttccatctctstcttcaggacagctacagaacagtrcacattttagaatgaaaatgaggagtcactggtaactgcggtacctaaaacataatttgctctgtgcatttcatgtttgctatttttttgaatcttaaaaagagacacacatgagaataacsaatctcacattccagtcctgtaatcccagtatgtttgggctactgattctctttttaaaagtggcatctytcatttttaaaagagaaaatcctagatagtgactcctattatcatcaagtaatatatatcaaggccccaaggctamcttgtcacattttactctggcatagaaatctaattccttctctataaagtcaaaaagagagaggtgagttatagatgttttctaatttagttyagggtcaacttataatcctcgtcctcaactgatggtttagcgataacttaaaaggtgatgctgcaaatgattctttgctggatttcagaaaataaagaagctattccagcaaaaaaaaaagtttctatttttacctstattctgtcagggatcacagtatakgtagttttgaagatgaawgttttagagtcagaaagacctggatttatatccaacttccgccagattcctaactctgtaggctttttatttatcttctaaatttcaatttcacgtaaacagaatgggattaataatcatgtctacccccaagaccatagggctgtagagaagattaaataaggtagtgtaagtaaaytgatgaacagaatgcctgcattactaagtaaacactaactaaataaatgtaagttacttgttattattgttgtcattaaccagagtcaggatcacgtgttgctgagcaacggctatggccccagactgtctacatttgaatctctcctaccctacttactaatggtgtgaacttgagcaagttacttaactcctctgtgcctcagtttcctcatctataaaatgaagactcctaatatttacctcttagtgttgggaggattaagtgagttgatagaactttctagggtaatgggaacattttaaatctgctccatccaatgcagtagccacgagccatatgaggcttttgagtccttgaaagatggctcgtgcaactgaggaactgaattttttacatttcacttaattttaattaatttaattataaatagccctaggtggctagtggctactatattggaaaaatatagactgagaacatttcctaaccaccctagaaccattagcattggtcagtaagtgttcatctaagtgtcagctaaaagcaggggcagtgcctgtggtgatgagcagagtttgcaaacaagaaattgcccattatcaaaaatgatcacaggccaagggggagggaaaaatacagtttccagaaatacgtgcaatacatgattgaaagtacttgaaataagagctgttaggtgtgctaataaatcatgtatttcaaattgccaacctcacttattgttactctttctcaaactttttccttcatttcagtttcaattttgaatacagttatgtatttttaaagcatatgcttagtggaagatatcttgtgatttctaaaaaagtaatttctttccaaaaagtttatataagagaaagagagtatgtgtgtgttagtaactttcytgtttaccaaagaatcagagtagcagctcattatcatgaattagtataaaggacaggaatgtcaatatcagtaagtgatatgtaacttgaaaaagcatactacgggttgatttttttaaaacagagagagatattttcaatagaatattgagaaaaacttaaggccatcaagtatatgcaaaagcatttgacgtcaccaagtaagacatatgctttattcttttctctggcccaagtaatgaatactcttctctaaagcaaatacacataaaagtttcttcttgaactaaccttctctaaattgcctgaaggctccctttatttaaggttttatgagagcaagaaaatgaaaaatatgactgygaaaatgaaatgaaaatatgactatgcagatatggaattatgctttcagcaataaggaaaagggagctttgcagattcctaaaataatgtgatgcaaacagatattttctccccaaatagtcattgttctcagcattttgtaggtaccatarcatggtgcatcactgaaatcaacacataacgtgaaaacactatgtgttggcagcattttcctcaaaagaagcaaggagagggagacacctycagttacatttcccaagcagaacacastgatgtcgagcattgggtaggtttttacatttagtttggtttgagtgtctaaggctcattatcatcagtagtcagggacaggaagtttacattctcggtgcaggagacaagtgtcagaaaagggacactggtctttgttaattgcaaaagaaacacactacaaccagagaagggcttctcctctcacccctccccatccttctccctgctccccactccagcatcagggaaatctgggcagaattgatacacccatgccagcatctaattacagagacaatactggaagcaaactgattaggcatgacatatgaaattacctgagaaggtttaatgtcctgaacatattcagatctgaagcctatctatgatggcccarttgcatgggccagtttctcaaatactaagcattccttctcactgtcatcagtgacctggaagggtgtatttcactttccacagcgtaggaggcttcatgtagagccagtctactggtatggraagggttcttaatctagggttcaygggcccctagaaaaccatgtatggacttcataggtctatagtrcatcccctaaaaatacatgccyatattgtatatatcttgtatttgtcactgtgtatgtctgtgtagaggaaaggtcagtagctactatcagatatacttttgaaggggcttatgcccatccttatatagcataccatggagaagacagatggctccaaaatattttttccagaaagaatawagtgatcatagcaaacacttttgccaataatgtctctgtggcagctccatcttcttcagtttagagagcttttgtaaatgctatctttattttgtattttttaaatccaaagatgtttttgaaatgtttcttaatgcaggaaaaaatatattggacacacttgagaatgaaatcagggacaccatgtaaagtattctgawgtattgctacaccttcaatatctaaattgattgaggcagggcctctgggaagaaagtgaaaaattcagtctgtcttccacatgttttgtctataccagtggtttccaactggagggcaattttgcttactaaggaatatttggcaattgctggagacacttttggttgtgatggctggggtgcggggctgctcctggcatgcagtgggtagacaccagggatgttgcttaacatcgtacmtggcacaggacagctctgcaacaaagatgcatccagcccgatatgtcagtagtgttgatgctgagaagccctgatctagatcatgattastgtttttgccacagccttcaaaccaggcttctctctccacaccccatgtgccagccagcctaaaagtaacttctggttcatgttctagtttgcctgtcattgaaccagtctcctccccattaggccttatccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttcaagatctccagttagacagactttaacttcaatcccaccttggtcatttggcagcttcaaatcctcattcaagttacctattttcctgaaccacagttttctcttttataaaatgaaatgcctggcaccagtgatcctgccctagaaaacctccttcttcttaagggaataactattattatagtctgatcgagctgatacaaatatagcccttgtgttgygaggcttatgtgagaatatatgtgaattatggttgtcagctggggctggttctttgtaatcaacaggggtgcctcaaataaatgaattacaggatccacccattaccagactgaggattgctggttaaagtgctggactccctgcctggcacacgatccatgctgtctaggtgcacctgctgttgttgctaccatgaccatcgtctgccyctctcctagttcccctgaayccagctctccaccactgccctccaggagatgcggatttaaatgtaacaaagtttagggagttggctgaaagtttcgtttttcttatagacttaagaaatcccatagccataaatttagtcacaaagcatggcttgatgagtaaagccataagagtgtattcttcttttaatcgatatataataattgtacatatttatggggtacatgtgatttttcaattcatgcatacagtgtgtaatgatcagatcaggaagattttattcttgactgtagcataagtaagcaagggtcctcttctctgggcaatgtccttcctctttacgtccattcttaaaaacgsctcatttccatatattttctcccatattatatagtggctaaagraacatggaatagtaatggctgtgttgtcatctggaagatccagacatccagtaaattccatttytgagccattgacttaatttaataaatatttactggacattggtattgaagtactaagtattggagttaaaagtgggctgaaatataaggtgaataagacaaactacccagagcattgctaccctaaaaagcatcaactgtaatgcattgggcctttgccatgtgccttgcaatatgtttgccgttttatgagcatttttcattccaaacctttcttgcaagggaagaactattattcttatcttattcccaagttacttagagcttatacagatccatycatttggtatacatagctcctaaacaaacaaacaagtcttatagccacctggcattttgcggcacattgcgtttatgttggaaaagcatatggttctraagtgtgtggcatacagtaaacacagcttaaggtatagtaataataagagcattctacatagatcgccccataaaagtgtcagcccattttaaagacaagaaaactgagtctcagaaagcctaaatcacctgagtccccactgttaataagtgttgaacctggcactgagctctggctgtctcctgtggtgttcttccaaatacctgatacttctgagagtcataatagatcaactcaccaacaaataaccttttattttcctggactctggtactgtggctgtagaagaaaaatctcctttccttattttagtatccaggttcctcttcatgttcaacagtaaggactccatccttggcatatttcttgcgaatgtgtctaaaactaagaaggcacatgtgccctgaagcattttctacttcttaaactcaggaatcccctttgttccagcaggaaacttgatgcctatccagaagcaaagttcacttggccgccctcaccgtggaaacgtgttgccacaccaaatgaacwtccccctcctgctgtcaaagagcagtcagtggccaccgctattgacctgagctctaattagkctggttttataatgaggaaaagagtgygattctaattagtaaatttccatctctttctcaataggtatcctccagtcaaagcaatcagctatcctcatcacactggttccattgccaaaaaaataactgtatcataaaactctagtaaaagtgatgatggttaagacaacaagagagcagaacgaggttttatttgstgctaatgacctgcattctctctcttaggtccgtggcactcaggtagttggttctgacatgactgtgacarttsagtttaccaatcctttaaaagaaacccygygaaatgtctgggtacaccyggatggtcctggagtaacaagaccaatgaagaagatgttccggtaaaccttgggttggggagaccgggcaggcagtgcagrgctgtgggaagctttctctgtgtgtgtcttttccaaacatagatctgctccccartgaaaatgtcttggaagctgcctcctccttgccgaccatttctgtagggcgtggagtaaaactagggttggtttgaccagcactttcatcatttaatccttaaagacaccctacgatgtagatactgctattrtctcccttctgtagctgaggaatttgaggctttgagaggttgactggttacacaggttcagttacacagtttatgaaaacagagccaagattcagactcaggctggtgaattccagaacccaagtttgaaccactttgctgtactacctactcacgtatggtctcttctcatctttattgagctcctaccacgtgtcagatattatgctgagagatacccccttttcatgggtgctttgtctccagcctcacctcacagattttaccatcccaatcagtgtctacaactgttggattcaggtttttttttagttgagcctaaagagctctagatggttccccattcaggggaccaaagacaaccccaggttctgtaatgatatgaatgaaactcagcctcttccacacacaggccacttcaaattgtgcttgacaggtctcagtttctgtgacttctactaacaaagagtgtgacccaacaagataacccattccatggtcaggtarctctaacagtaaggaaacakgtttttctaccatttgatcctgccaatgatcctaattctgccatctggactgacagaaagtaaggcccatctcttttccatctgatggtttgcaaatgtttgcaaacagctgtctcatcttccttgaatcttttctacctggggacaaatatctgtcctgactttatttycctctcctctaacatggtttcagctctctctctctctctcccacacattccaatttgtcactactcctcttaaagtgtgacacccagaatggatcccaatctttgaggtttattactttcatttctaccacagataagtccttgtcagcatcaatcaatctagcacatttcctgtggagtgaccttctaaggcatagaaagggaggtagaggactttggaaactgcctcatgaccagatatgtcaagaattttcccgacaccctttatggaagcgaccccactctggaatctgtgggataaatgcaaggcctcacttataccctctggggcaactttattgcccataaagggctctccgcatttctttcaaattacaatgctcrtagcttctgcatctcatcatttaagagatgccttattgcagatgcaataaacaacagagaaaataatcttagtgcttttgaaacaacgcaagcacaaaacatagcaaccttcctgtgctaacaggaaagttacaggaaaaaaaaataagtaaattagtaatcaaccccagctacatagagaggtcagcagccatacccctgctttcgtcagaaacgacagtctcactcacccattctcgcaccttcccactcaaatcagatgcaagaatcgttcaggcaaagtgaaacacgtttcctcttccatacagccccctgctgtatccaactttttccttcccagacagtaaacccacaarctttatctgagtgtacyggaaacttctctatctttacaccttggctatccccctagaattccaccttggtcaaggccaacacatgaaaaaagacactgtgtgtcttagacaaaagatgaattattacacagtgaattattacacagtgcaatgacccactatttgggaggcctcaggctcaaaataggttaaatctccagatggtttgtttattgttaatgtctgacattggagtggagcaaagtggagtgaatcgggaraaaggatggataaggccagtcccttcttggacacagatgtcctgcccacacactggcttaaggtactrttagtagttactgcaacacgtaagtctaggcagacaagtagatagacagagagctagctgctcttagtcagtttgagctgctgtaacagaaatgccatagactgggtggcttatacaacaaacatttatatctcacacttctggagtctgggaagtctgaggacaaggtgccgaccaattcggttcctgatgagggctcccttcccagcttgcagatggctgtcttttcactgtgtcctcacatggggcagagagagggagggcaagttctctggcacctcttcttcgaagggcactaatcccatcatgagccccaccctcatgacctattctaatttagttacctccccaaagctccatcgctaaatggtatcacactggagtttgggtttcaacaaatgaatgtgtgaggaccacaaacatttagtccgtaacagtcctcaatctctctttttaagttttttttactgacacattgtaattstacatatttatgtggggcaatttgatgtttcgatacatatatatgttgtataatgatcaaatcggagtatttagtgtatccatcaccccatgcatttatcatttctttgtggtgagaacattcaaaagcctgtcttctagctcttttgtaatatacaatacctactgttaatcatagttaccttatcatgcaatagaacaccagaacttattcctcctatttaattgtcactttgttctcattggccaacctcttcccatcttccccttcatgttctcctcctcagtctctggtaaccactgttctgctctttgcttctatggtataataatttttttttttttagtgtctacatgtgagtgaaatcatgtagtatttgtctttccatgtctggtttatttcacttaccatgatgcccttcctccaagtctaattcatgttgttacaaatggcaggattttattctttttatggctgaatagttacagaaacccagcttcagggtggaatatctcccagacaagagaagctttatttctcagagacagtcaaaacttgggctaaaaatcatgacatagaaaacatttgttatctaagatgggcttacaacttggagcaagtgccactttctctgtttactcctcactccagcacacaccttcacaaccaagacctgagccagtccgtgcccacttccatatggtcagataattagaagcactccactgtgccctatgttgccaagatctgatctaggagcgccagatccatgtaacaacttggacgcctagaaagtgcaattccacaaaaccaaaatcctttgcaagaccgtatttctttctagaatacagctcttaaatagttggggaatcaccacccccactcattcacccacaccctgccagatgtggtgtctagaaggcaggggttattgaacccaaagcagagggcctggaaggtgaggagctggtaaacagggaattggagccaggaacaaagaaggcggtgctgtgtctcacccctcactcgcagtgagccaactctactctgaaatggtttatcttcctgctcttcccccactgcctccggcctgtctcagatgtgcagaggttccacctccacagactcttaactttctgcacttgatgcttccagagcgtcaaataatttatcttccagatttattttgctctttagaaaatgatccagttcaatatgttatttcaagagaaaaactcccccactttgtgatttgggcttaaactttaagtttctcaaataggacagaagctaaggtctagamgcacagaggacaaaccatgggcagttgcagtttattgtaataataatctyatttgcctgcgtgcattcaagatgataaatggccggtatctcctgatggctcagcacgttactgagaatcgtttatcacaacatccatccccagaaaataggattactccaacattgctccacttatcaaaatacttttttctctgttatgaatttatctgtatgtaaaatagcatgcatacgtatcttcatgtatgagtattttcatgtatgagttttttcgtatgtacacatcattatgccggatggttttatgagtaagagaaaatgataagagggggctaaatacttagcttctatttgaggtggttatctacagtacatggtctcaggtcgggtccttaaccagggccactgtttcacaaagtgcttctgattgatcacttgggggaaccagaggagagagaatgaatggatacaggtaacaatagcacagctgttgagaaataaatatcccaaacttatattggtattgaattgagcactgagaattttctctctgcatacaggcaggagaaactttcctaaattatcttgcaaagagttcaatgaatcctccatgaacacttccaggacactcttattactaagtcaaaaagtatctttcctgcttgagaaataaaacctatgaaaaagtaagcacaatggtcagaaaaagccttttcttcttttctttttttatttctataggtttttggggaacagttggtgtttggttacatgaataagttctttggtggtggtttctgagacatttggtcacccatcacctaagcagtatatactgtaaccattttgtagtcttttatccctcccacctttcccctgagtccccaaagaccattgcgtcattgttcattgttatgcctttgcatcctcatagcttagctccagcttatgagtgagaacataggatgtttggttttccattcctgagttacttcacttagaatactggtctccagtttcatctaggtcactgtgaattccattgtttcattcctttttatggctgagtagtattccatggtatatgcataccacaatttctttattcactcattgatgggcatttgggctggttccatatttttgcaattgcacactgtgctgctataaatatgtgtgtgcaaatatcttagaaaaagccttttcttatagaacatatggtgtacacttttatgaagtgcagtgaagaggagcagaaagagtatgaatatgggactcagaaaaacccgggttcaaatttcatctctgcccatttaccaattatgtgatcttgaaaaagggacttcactggttaccttccatttttcttgatcataaaatctgctgaatagtatctgcctcaaagaactgtcatacatataaaacctgaatataatctcccaaggtttataggggaggctatatgtgaagcaccccagagaacactaaatctcaccaaccctgattagtctcagtctgcactgatgtgggcttgttcgtgacactcaggaagacttcagggcaaaggctgggaggaagaggagaacactagaaccatgaaaggctatgtcattagccgcatacattagggcattggcaacaaatggtagcagaaagttgcataggtggaggggcccaatttggtggttgaaataggaatttgaattacagaacatgaagattctcaaagtcaaatggcagcaggcagggctatattccagatgctgagcctgggmacaaggtctatcccaagggagttggcaaaagctaattcgagtgtcagggcctcagcaaaggcagctgggggattcayataggactgtaattccaggaggaaactagtggcaaaaactgagctgaggctcagaagatcagtcacatagataaggctactatggagggcttggrgacaagctagagttcagytgattaatggttggatgggaatcagcccagctcctgatggccactgggaggctggcggatgcatcccagtggaaggaaccatgacccaataagactgtcagtgacaggttctgcagagctttatgtgggggcctcatttggggcataacttgctgaatcagccagtgagagtcttcagtgtcctaagcaccaactgagagaaagaaagcaagtgacttaggcaagagttttcattgcttcctgatcaaagtggaaagctggatcttccaacctctcctctcttttccatcctttcagtgaaatccggcccaactccaccgtgcagtgggaagaagtgtgccggccctgggtctctgggcatcggaagctgatagccagcatgagcagtgactccctgagacatgtgtatggcgagctggaygtgcagattcaaagacgaccttccatgtgaatgcacaggaagctgagatgaaccctggcatttggcctcttgtagtcttggctaaggaaattctaacgcaaaaatagctcttgctttgrcttaggtgtgaagacccagacakgactgcagagggcyccagagtggagatcccacatatttcaaaaacatrcttttccaaacccaggctattcggcaaggaagttagtttttaatctctccaccttccaaaragtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcrgggtcaggttctaccctccatgtgagaatatttttcccaggactagagcacaacataatttttatttttggcaaagccagaaaaagatctttcattttgcacctgcagccaagcaaatgcctgccaaattttagatttaccwtgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcagragccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatkttgagacctcagcttggcactcaggtgctgaagggtaatatggactcagscttgcaaatagccagtgctagytctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatacwgggggcaaaatcagaatggaatgctctggtctatataaccacatttctaagcctttgagactgttcctgagccttcagcactaacctatgagggtgagctggtcccctctatatatacatcatacttaactttaytaagtaatctcacagcatttgccaagtctcccaatatccaattttaaaatgaaatgcattttgctagacagttaaactggcttaacttagtatattattattaattacaatgtaatagaagcttaaaataaagttaaactgattatatttgcatctgtgcagaagtgaatgcttttaattttcaatataacacactactaatcacaacttcttgagaaaccatccttcctccgcagtagacaacccaccctggataggaaaacaacaagcatttatcctctaaagaaaatgactctaacaggtgttaatgtcacagttttcttcacctctctctttctacattttattaactatattcactgaaggatcaagttgcatattagttcaaaaaccagcttccagaaactataaaatctctgtagatattttctcataaataatcttatgaaccattatggtgaatcagtggatagccagcatggagacctagcataacgaacacatgttatggtcttatgataatcacgtataggagatcctatattcatggcagacatcactgaacaattgtagctcagataagacctcagaatctttctcatttccaggtagcaactagcaattgattttaaactggcacacaatcaatagcttaccaatgaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggccaaaactggaagcattccctttgaaaactggcacagacagggatgccctctctcaccactcctattcaacatagggttggaagttctggccagggcaattaggcaggagaaggaaataaagggtattcaattaggaaaagaggaagtcaaattgtccctgtttgcagacgacatgattgtatatctagaaaaccccactgtctcagcccaaaagctccttaagctgataagcaacttcagcaaagtctcaggatacaaaatcaatgtacaaaaatcacaaacattcttatacaccaacaacagacagagagccaaatcatgagtgaactcctattcacaattgctaaaaagagaataaaatacctaggaatccaacttacaagggatgtgaaggacctcttcagggagaactacaaaccactgctcaaggaaataaaagaggatacaaacaaatggaagaacattccatgcgcatgggtagcaagaatcaatatcgtgaaaatggccatactgcccaaggtaatttacagattcaatgccatccccatcaagctaccagtgactttcttcacagaattggaaaaaactactttaaagttcatatggaaccaaaagagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacaaaacagagctctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacagcttatacaaaaatcaattcaagatggattaaagacttaaacattagacctaaaaccataaaaaccctagaagaaaacctaggcaataccattcaggacataggcatggggaaggacttcatgtctaaaacaccaaaagcaatggcaacaaaagccaaaattgacaaatgggatctaatgaaactcaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcgaaaagtgggcaaaggacatgaacaggcacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactattggtgggactgtaaactagttcaaccattgtggaagtcagtgtggcgattcctcagggatctagaaccagaaataccatttgacccagccatcccattacttggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacactgcatattctcactcataggtgggaattgaacaatgagggcacatggacacaggaaggggaacatcacactccggggactgttgtggggtggggggatgggggagggatagcattgggagatatacctaatgctagatgacgagttagtgggcgcagcgcaccagcatggcacatgtatacatgtgtaactaacctgcacaatgcacacatgtaccctaaaacttataaataataataataaaaactgagaaaaaaaaacattaacaactggtgaatgtaagtgaaggatatgtgagtacttattgcactgctcttgcaaatctatagaactaaaattttaaaaaataaaaatttgcaaaataaaagaaagaaaaaaagaaactggcacgcaagatggaacctgtttgtcatgcttacccttagagccagcccattccctttgatagctaggatttcatacatattaatgctatggctctaagagttatgatttagcaatgataacaagcaatgtgtctcaggtagcagcaggactgtgagttctaactctccctgagtctctacctgtgctagtcctcagtgtttttaaacaaatccttattggtgtttgggacttcaaagacaaaagaggggaaacataagaaacataaatatttctgtttctcctgggggatatctcaaacaacctcaacaacaacacatataagatgatagatagatagatagatagatagatagatagatagatagatagatagatagatatagatagatatagatagattgttttgcaaatatttcacctcatcagccctgtgacagaagtaaatataactatctccataattaagaacctaattgagcctaggaagccatctatcatggcaaatcaatctcggggtggcagtgagcagtgaaacaactctggtttcagagtcaccatttgctgtacactgtttaaatcttttgttgcctccttagagttttaagaatgctggcttaagaccaacttcaggatgctttgaagagctgcagtagaacaacaaataaaaatatgtataaatttgtattagaaatgtcatgggaaattgagtttgtgctagactcattggcaatcaaaagtcacaaaatcccagggggaaagtcactgcctatgaacattcgtccaatgttattacaaagttaatcgtcagcgaacccaaccatcaattaattcaccttttcgacaatccagccatcccctgacatccagacaaccatctagccttccaagccatctatccatcctttttttccaacaatccacccgtgcacacatcaggtatcactttagagaacagggatgcaaagataaaaattccatggttcctgcccagaaagagttcataaagcagaggagtagcaagatatttaaacagataatccacaaccaaataatagagctatgcccagggtgccataggaatgaagacagaaagatgtctaaagaagccttcctcaatgtgcccaggaatcaaggaggaaaggttcagattgaatcttgaaaaaataataggtaagttggagaccatttaacaaagaggagctcgtgtaacaacatagagagaagaccatgaacatggcccccaactggcttgagatggagagatggtaagtgtccagtgagaagaggtggggccgaaaacgcaggaatgggtcagagttggagcacttcccgaaatgagaatttgtttattctcgtctgtattgtagagtagaactaagagaggctgctaggaacaaactagatacaaaactaaaagttatgcgtggctcaaggagtgacagggccaagaaagtagggggtggaatgccctaactcaggccagtgaagaaggtgtcagaatgggggtgtggccacagttggattcaaggaagggaaatgagacatacgaggctcaagtggataaagtgggagagatagcatgtagagacagagagctgtctatgtcagaaactatagaagtgtagacagacaagttccttctagggcagccaagtaaaatcaccatgagcaggtagcgctgaagacccagaatcttgcccctcaggtcatgcttatgtctgtctttgaggcaaaattctctccaacccagtatcgaaaagaaatgaactgcttctagagacattccttcacaccttaaggcaagttcgtccttctgttctcaccaccccaactcattcagactcaagtttgccttcccaagcaccttcctttctacataagaatgaaacaaacaaaaagccttttagtgtgtctgtaagaaattactttgtcgaaacaaacaaataaatgagaaacaaagcgcctcagttgcatcgggaaaagggacagggaaactgtgttcacctcaattgccaggaattatacacagcattttctagctctaaagacaatgaacatttttaaaagatacttggtaaactagctgttgatactactcatgaactcccattcattttcacactaatcattgttctaggacttacataattacctaagtaacgtttcaatagtcccaaaactaacataaggggtcctaatgagcatttcctattagtaaacagcatgtacctataaacgaagaggattctttcctctcttttctgatttgagcaagtttagacagtgggaaggtacaatatgaaaaatatgttaccaccagatttaggatttgttataaaggtggcagattttaaatgaccataaaatgattgtcactctttccattgagaaatggggaccacattccctctcctgcccttgattttaggtgggccgtgactgctttgaaagaatgtgataaaagcaatgctgccagttctcagctccaagccttggaaaactggcagtttccacttattttctcttgaaatcctcttcgtagaagccctgagcttctgcctaaaggctcaactactctgagactcccatgctggagaagccacgggtatacacacttcaaccctgctctgagctcagccttccagcgacctccgccaaggcaccagacctgataatgaggccatcctgggcgctccagatcagccc

SEQ ID NO: 17686 - DNA, 18310 bp, Homo sapiens
acctgggaaggcctcgttgggggtgaaaccagagcccaccagaaggagcaggacggaggcagggggttccccgggagggcatcctggcaggcactgttggaaaggcagcaggtagccatataacctcaccaacaaaatgcctgcatgccaggcagtgcacagagggcttaccacattgaccccattttaaccctcagagcgaccctttgaggtagcactactactctcactattttattttttgagacagggtcccactctgtcacccacactggagtacagtggcgcaatcatagctcaccacagccttgaactcctgggctcaagtgatcctcccggctcctctgcctcctgagtagctgggagtaaacgtgtgagctaccatgctttgctaattattattaattttaaaaatttttatttatttattttttgagacagagccccgctcttgttgcccaggctggagtgcagtggtgcaatctcggctcactacaacctctgcctcccaggttcaagcaattctcttgcctcagcctccctagctgggattacaggcatgccgggctaattttgtatttttagtagagactgaatgtcaccatggtcaggctggtctcaaactcctgacctcaagtgatccacccacctcagtctcccaaagtgctgggattacaggtgtgagccaccgcaccaggtttttattatattattttgttgagacacagtctcactctgtcgcccaggctggagtgcagtggcatgatctcagctcactgcaatctctgcctcccaggttcaagcgattctcatgcctcagtctcctcggtagctgggattacaggcacctgccaccgcgcccggctaatttatgtattttttttagtagacacagggtttcaccacgttggccagctggtctcaaactcctgacctcaggtgatccacctgcctcggcctcccaaagtgctgggattacaggtgtgagccaccgcacccgaccctggctagttattttcaatttttgtagagatggggtcttactatgttgtccaggctggtcttgaactcctggcctcaaataattctcctgccttggcctccaaaagtgctgggyttacaggcatgagctaccccgtccggcctctccrtgagtaacctcagtcactggtttcacgctcacagtattagcgtacccagtsgttgacgccaggcatagtgtctgcactcatcgctgcagtcctggcatacagcaagggctcaacagaacgaacgcagtggagctgggagaatacctgaggtctgagaggaacctaagaagtccccgcccctcctctatcacatgacagttaggtaaagtgaggcccggagagagaggcttcagcggctcacccagcccccgtgggcctggatccagggcgtgaagctgtgcacgtgctccacgctgagtccggccagggtgccccccagcccggccacgcgccggctcagctccatggctagggccaggcgggccaggggctccggggaaggaggcgggggcccggggcatgctcggcttgggcgagagctgtcatcccggctacagaacagctccaccaggcgggcgaaagagtcggaggacaggcggaccagcttgctgcgcagggcggggtccgaggccagctgtagggtggaagaggcagggtccgcgtcagcagcgcccccggggccagccaatagagggccgggaggcgtggcttcccggttcaggatcgttctagatgctaaggttctaggccacccctcatccatattagccaatcaagccagactccagggtctctgccaaactacccccgggatagtggcctggaacgtgagtccctaagccatgccaggcccttgcctcaacagccaatcagggccaatctctactgtaactgagttaatctagccatgcccctggtgacctttcccaggggccaacctagtgtctacaacaatcttgccctctaccattcaattaatattaaaggacgatgtaccttgtccaagctccgaagccaatcagattccaggacacagccacaagccacacctcctctggtagtacattttcccctacattctaagccaggtcccttctatgctcagtaagattttagccactccccccacccccacattcattcacttacttccccagcttggccagtctcttgtggataatgtttctgatggccacaccctctgcatttaggccatgcccctctaaacaatcaattaaaacaactaatttacggtacagtactaccctaaccatacccctgtcattcaactattcttttttttttttttttttaaagacagagtctcactctgtcacccaggctggagtgcagtggcgcaatcttggctcactgcaacctccacctcctgggctcaagcgattctcctgcctcagccttctgagtagctgggattacagaagcgcaccaccacacctgtccgatttttgtatttttagtagagatggggtttcaccatgttggccaggctggtctcgaactcctgacctcaagtcatccacccaactcggcctcccaaagtgctgggattacaggcgtgagccaccacacccggcctcaacccttcattgaaaccttgtcccagcctctttccacctgaccatccaaagaaaatacagatccagcttctgatcccagtgccccaccattccgcaactcctgtccttgccaaggagtgggacagatgcccatcaccttctggttaatgacttctgcctcctcctccagcagggccaccagcctccgcagtatggcttccttctctgtcgatgggggaccctgtaattctggaggcagaagagaatttggctgggggcagaaccctgactatcctcccaccgccatccttctctggggctcctctgtgcctcacctgggctgggcggagatttcagctgctcttggaccagctgttccagccgctgggccaccaaagcatagaagtctggagtagctgggcctggggtgaaaagagttaatgacaggtttccaggacattggaaacttacggattctctccttcccccaactaccttggcaggtggcaatgattcccattttatttattatttatttatgtattgattttgggaaacggagtctcgcaattctcctgcctcagcctcatgagtagctgggactacaggcgcacgccgccatacctggctaattttttgtattttagtagaaatggggtttcaccgtgttgcccaggctgacctcaggcaatccacccacctcagcctcccaaagtgctaggattacaggcgtgagcaaccaagcctggccatgattcccattttataatggggtaaactgaggcccagtgagaaaacttggttaaaaatgccaaaacccttgtacttttcactttatgagatcctcagactggacttagaatgtcagagctggggccaggcgcagtggctcacgcctgtaatcccatcactttgggaggctgaggcaggcagatcacctgaggttgggagttcgagagcagcctgaccaacatggagaaaccccatctctactaaaaatacaaaaaaaattagccgggcatggtggcgcatgcctataatcccagctacttgggaggctgaggcaggagaattacttgaacccgggaggtagaggttgtggtgagccgagatcgggccattgcactccagcctgggcaacaagggcgaaactccgtctcaaaaaaaaaaaaaaaaaaaagaatgtcagagctgacagggtgcggtggctcacgtctgcaatctcaacattttgggaggccgacgtgggagggtcacttgaggccaggagtttgaggccagcctggccaacgtggcgaaaccccgtgtctactaaaagtataaaaatcagctagtatgctggcgtgcacctgtaatcccagtcactcgggaggctgaggcacgagaatcgcttgaacccaggaggtggggattgcagtgagtcgagattgcacccctgcactccagcctgggtgacagagcaacaatctgtctccaaaagactgtcagagctcaactagaccttgaagatgatctcatccaaggaaggcaaacacaagacattactgttagtatccccttccctcactcactacagacatcaccaattgatcacagcacttcctctcccaagctgtgaaccccttttcaagctagcactcccagcagccattactagtctgtccaggttcacacctatgaggaaacttgtgggtcaccttgatcaagtccagtgacctcctccccaattcctactctgctattggaaaaacaggggagcagggaagagaaagcattttccccagagtcacgcaactaaaacagccagggagatgtgattgaaaaccagcccttctgcccctctatcaggggtattcctggctacaaaagtcctaggggcagggaagtagttatggaaggaaagagacaacaaccagattgaccaaatgctctctgaaagccaacccacagaattgacagaaatctaactggggaggggagaggacaggacggttctgtcctgaaggctggtgctagagactccacacagccaccccctagctgagtgatcttaaactagcaccttatcccgtgttctgccggcttcatagatgatcatggaaatctcttaccaggctctaaaccatagcaggggcggatgggcagagagcaaggccgaggggactcagagggggctgctcctcgccccagggagcagggaagacatcttcgaaggcggctcaggaagtctgttggctcttcttgggcagggcttctggagaggaggacttcagagactgaccccaccagagatcccctgcaagcagtctctttccccaactccctccctcccccgctgaggacctctctccaaaaccccaaagacagagaatagagccagatataaagagaggagacagactgagaccaggagcaagagttaggagggagcctcaaatgctggcccctgggggagaagggccactcctcttacctaggtggagttggaacaggagacccggcagcctcaccacgcctaaggaaggcagctaggaccctcagcgtgtcttcccggagccccagctcttcagagcctgccatggaggcacctgtgagagagagggttagggactggactccaagggtttagcaagaagtggaggcttggggaccaggacttgtgagtcccaaggaaggtgctgagggcctggactcctgggtcctttggagagtgtgggtctgggggcctagactcttgagtcctcagacgaaaaagcgatcaggaaaaagactcttcgatccaaggaaaggtggtggggctgggtgcccagattcgtgggtctaaaggaggagggagctggggtcctggacttctgagtcttagagaaaaaggaactggagccccagacccttaggtctcccaggaagaagaggcttagcgccccaactcctggattctataagaggcatatgccaaactcctgaaacccttaaagcatcgggaactaccaatcccaagaggtttcagggcaaatcttcccctaggtccgcgcttcttcgccgcgcagcctgctgtgaggtgtagttccaaatctccgacccctgctggaatctagaggaccctggacccttggatatcagagaagcgggactggggtgcccaccactggatcccggccccctcctcttccctcctcaccccacccctcgtcaacaccccgctgacctggtccggggccccaccgccgcctcctccactcaacttgcggtctcctccactgaactcgtacaaactttattagttcaactttcccgcgcctgcgcactgggccgggtcgataaccggcccagcgtagaaagggcggaacgctgggtgcacgctcaatttgcatgtgacgctcccagcatgcctctggccggaaacccaaaaaagggcataggggcgggaacagcccagcgggccgtcccatcggcttttgggtctgttacccaaagaatgataaagttggttttatttcaagaagtcgatcraaaagaaagccccagcgctctagagctcagctgacgggaaagggggtgcgcagcctcgagtttgagagctacccggagcyccaagacaggggkgggttccagctgcccgcacgccccgaccttccatcgtaggtaacgcggaagagccygggagagcgttggtggcgtccgagagcgaggagcgggaaagaggatgggtctgcacggagagtggaaaggcaggctgtgtactctggggaaagtggagcaaggaaggagctacagtggccgacgctggaggtcggctgcagaaaaactagaaaaagtagggaggaaagaggaaaagaggaggcgtctacactgagggggttctagagagggaggggtggactccgtagatgggggtagttcagtctcgaaacctggggcgtgctctgtcctggaggagggaggcgggcagtcggaggggaattgaatggaagttctgtgttggaaatgttttgggagatcttctgtagggggactgtggaagggggtctacattggggtaagtgcaggaggtagaggcttacacgtgaatcgattctgcactgaaataactagggaaagaggatgctaccctgaaagtggggatacttactttcgatgatgtgggggagggaggaggtctatactggcggaattgagggagtggagggtctgcactgaagacgctggggaaggatgtgccatggatatgggaaggaaccctagctgattagagagcctctcgggaggatgggaggatgggaagaggaggtttcctgtttgtacccccgaaaatatgggtgaaggacctgtgccgtggcccgtgagaaggaggtctgrgtgcggaaactccaggccaggtgggtccgggggaggccggtcgcgcccaggaaatgccctatacgcgcaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggtgcgtgcgacgacctgggacgctggaaacccggagctgcgcgctgggcggaaaggactcctagtgggcccggctgagaaggcggaggtggcgcgcgaggggcgggctcgtgccaacgctggtgggtggggctagaacgggaggggcggggctagccggatccgctgactgatggtggggcgcaagcagggttggagctgcagggttacgggaataaaaccgggaaagccggttagtacgcaaaggaaatgcatcctgggggtttggggctttctagaggccggggctcttggttgtaggatagatactgggggatggttcttgaaacatcagaggtgaggcctggagccccaaatctgaggttcctaactaccgaattagtatatgccagaggtggtaaacagtgtgaggggcggggttatcacagagggtgtcgcggggcaggtggtgcacgggattagacaccaagttggacttggaagcctggcttagaaagaaaaggtttttgggccgggggcggtggttcacacctgtaatcctagcactttgcaaggccaaggcgggaggatcgcttgagcccaggagtttgaggccagcttgggcaacataggctccatctctttaaaaacaaaagcgaaacaaaacaaaaaccaaagaggtttcaaaggcttttgaagaggccgagcacagtagctcatgcctgtaatcccagcactttgggaggccgaggaggacggatcacctgaggtcaggagttcaagaccagcctggccaacatggtgaaaccccatctctactaaaaatacaaaaattagccaggtgtagtggtgcccacctgtaatcccagctactcaggaggctgagacaggagaatcgcttgaaccggggaggcggaagttgcagtgagctgagattgcaccattgcattccagcctgggtgacaggagtgaaactccatctcaaaaagaaaaaaagccttttgaaaactagaggtgggggatggaggtaggtgggacggggggatttggggatggaccttgcagagttagaacttgccagggaaagagggtggtgttaggactcgggagacagggttagggccccaggagcaggatctaagtcgtcctcccccaccrtcctgacaccactgttgccccaggcctgggccgaggccactggtgcatatgttcccgggagggataagccagacctgccaacctggaagaggaatttccgctctgccctcaaccgcaaagaagggttgcgtttagcagaggaccrgagcaaggaccctcacgacccacataaaatctacgagtttgtgaactcaggtctgccagcttggggttcgtgtgggaggctggggccccaagggttcctggcactcctactcccctcaccacttttctcaacaggagttggggacttttcccagccagacacctctccggacaccaatggtggaggcagtacttctgatacccaggtgagaatgtgcccaactttcatgcccctcagtctccgacctgtctccatgggccttgtcctctccctctagacgatccccccactcccctgcctccagcctgcccctcacctgagccagtgctgaccctgtctgtccctgccccggtctcctcaggagaaaattccaagtcttcacccagcattcaaggcccgagcacaccttcccgggatttcatggatttcgattcgcagggggctgtcagcctcttgggaactgaaaaactccctcaccttgatcctgctgaggcccaagctgggggagcatcccctctgaaattctacccagcctgctttgcccaggtcttacctgcatagagccagatccttgggttggaatggtagcacctggcgttcattagtgtttgtttggctgttgatgccatggctggctctgtccccaggctggaagccccttgaaggcagagctcaagcctgacctccctgcgttgctgagaacagacctggtccatatgaagtctccagaaaaggatatggaaatgcctgattctctttttttgtttccctccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaaggtgagtgtcagctgcaggctgggagggctgaggtctgggcggcagcccctgattctcaacccctctccccttcatgccgctgctgccgctgctcagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggtgagtgagacaggggcttcgacctggccagtacaaagcagcctgcacagtggttaacaactcaggattggccgggcacggtggctcacgcctgtagtcccagcactttgggaggctgaggtgggcagatgacaagttcaggagttcgagaccagcctggtcaacatagtgaaaccccatctctactaaagatacaaaaaaatagtcgggygtggtggcacgtgcctgtaatcccagctactcgggaggctgaggcaggagaattgcttgaacccaggaggcggagattgcagtgagctgagatcgcaccactgcactctagcctggtgacagagtaagactccatctcgaacaacaaaaaaaaaagaactcatgattaggactgaattcagacgctggctgcccttggcccgctgtataaccgaggcaaaggactttgccctgagcccgtggaatccaaggatggtctcctctctctacctgcctgccagcgctggggtgagacacaggcccagtacacagagcctgctcagggaattagctgccactgtcatcatcatcgtaactaatgatggtgaacagaccaatagcaggaaagctacatcccttagggtttcgctgtgcagtggcactttctgccatgatggaaatgacagtcacctgcactgtccggtgcagcagccactagccacaggggccaagcactcaggtgaggcgagtgcaaccaggacgtgattcgttttaattggttacaatttaaactgaaataaccttacatgactaatggctgcaattggacaatgcagcctcagacrggactgaatgccaaccagcttctccagattcactgagcatccttgggagcatgggccccctactctgggcctgttatgaatgctgaggcttgggggcttgggggtgtggccttccaacaaccccaccctgatgggagggagggagggagggaaggaggggactttccccaaacaagcagtcccctggtcgaggcagcagagggccttaggtcaggggaggtggtgggggttatcattcaagtttacggggaagggtgggtagagggtcctcttctcatccctgactaggctcctgggcccccagatctgattaccttcacggaaggaagcggacgctcaccacgctatgccctctggttctgtgtgggggagtcatggccccaggaccagccgtggaccaagaggctcgtgatggtcaaggtgcctgcagacctgagtccctggggctgaaaggggtggccttacagagggaagaggttgctcccaggaactccaactcccagagggccctctaaaaaactgcaacttccaagatctctgcaataaccagtttttcatccccgggagctccttcccatggcctcacctgcagaacctgttttgaactctctaaaccagtggcccccaaactatttggcaccagggaccagtctcatggaagataatatttccacggacagggaggtgtggtttcgggatgaaactgctccactgcagatcatcaggcattagattctcttaaggagcagccgatccctcacgtgcgcagttcgatagagtttgtgctcctctgagaatctaatgctgccgctgatctcacagaaggcagagctcaggcagtaatattcccccacccgctgctcacatcctgctgtgcaacctggtccctaacaagccgtaggggggttggggacccctgctctaaaccatgtagaagctggtggactcaagttttagctgccattgtgaggccatggctgtggctcccaggagtcaagatcacagactgctcagccctgacgtgtgtgtgtgtgtgtgtttgtgtgtgtgtgtaaaactacaactcccagcagccctaggcctatggttcagttacagcagggggtgtgtgtgtgtgtgtgtgtgtgtgtgtgtgtgtgtgtgtgtgtgtaaaactacaactcccagcagccctaggcctatggttcatcctaggttacagcaggggctgcagggagttgtagtcctccaagccctgactcctaccttggtggacagtggctgggtgttttccctgactcctgtccccacttcccctgcaggttgtgcccacgtgcctcagggccttggtagaaatggcccgggtagggggtgcctcctccctggagaatactgtggacctgcacatttccaacagccacccactctccctyacctccgaccagtacaaggcctacctgcaggacttggtggagggcatggatttccagggccctggggagasctgagccctcgctcctcatggtgtgcctccaacccccctgttccccaccacctcaaccaataaactggttcctgctatgatcacttgtgcgtgtctggtgttgggtgccctctgacccaatatggttgttattcccgctcagggtctcagtttacccatctgtgcagctatatacaactcaggtgctcaatgcatgaagaccaagcactgcagggggcagctgacacctcctcacttctgcccagggacctggtgggtgatggctgtccccgtgttgtagaccaagacacaggctgggagaggcgcaaaggtcacagagtaggaaacacaaagactagccagaacccaggccccctgccttgcctatgaacagtttgggcaagtggtccttctccttccaggcctcaggctcccctccacgtggggctggaggggtcttggtaaaggggctctgcggccaccctggagcctgcaaagcctgcctgcctggtgaccctgggcactgtcacctctcctggttgggccgcagttctgggtgatgaaactggcagaagccagcgcagccctgactcacccttcggcccttgctgctctgtgcctcagtttccctctcaggacagttgatgagatcaccccagcttcacggggctgctgaaaagagaagccaactcaatggggaacacagatcctgctctgggagcaattccaaggcaggcacatggcacccaggagccgagctgggaagatgctgatcaggtggggtccggcccctgcctccctgtgagcagctcgctcccagccagagactgtgctaagtgctccacctgtgtcttgttcaatcatcacaacacccactacacagataagaaaactgaggcccaggggaggcagctgccccaagtcacagtctggtctctgtctcccatcctcagcctcctgggggtccctccccaaccctctggcaaatttgtctccgaaaacaaagggttagaaccatggggctcaggggtaatgtttcatgaaatctttaatgaaattggggagaggggcacaaacagaagggaggggcactggggacaggcttgggggcaagggaggtggrcacggggcagggcagggcagggggctctcctcttccctgcagcaaccctcccccagtcatcccactgacgggggagggaggtggggaggtggagccataaatacgtccagagtttcaaagaggtgaggggcgaagagctggccagggctctcagagagggggcaggggcaggcccgggccacccttgtctgggggccctggctccttgggcggccgtgggggccctggggggtcccctggcttgcgaccgtgcttgcggaagtagcggtagcgctggacgtaggcccgcaccaggttgctcaccttcactgggttgatttccccacttttgctgtggcagatctggggggccggggacagttggagtcaccaccaggctcccggggccccatccacccaggactgttgggcgcagcttggaactgcggtaggaggagcttccccaataaccaggccaaagtccctctgtccccctagacgatgggtgccccagggccagcggaacaggcccaggtggccttgagaaaatcctgtcaccctcctcacctcccagactgacctcctccccgtctcccatccgcgtccatctgtctgcacacatctgtccctccagctcgttctctccccggcctgtgtctgcccctctctccgggtgcccaccttgtggacggccttcctcaggatgtccttgtactcctccttggtgatgtccttcytctgatagtatggcttgatggccagcttcacctcctccaccgcccgctcctgcgtgtgcagcttcttcagatactggtggggtggcgacagcgggggaagacacagcaagggccagtgagtacctgcggaacctccacctccactcgcctctgctgccagcctaacctctctggccgtccagctgctctcaggctggaagtcctgctgagggtctgtcccatgcgccctctgctgcaggtgcccgggaccaaaggccaggcctgggcctctgcatgtcactgaacatctcctccaggccgaaccctgggctgctccaggcctggccgggaccaggacatgtgtgtcgcctgccctcacaaagttcagtctgatgagaagacaggcattggccaagaaattgcagctggttttgaatcagactctagaggcggggctgtagaaaactgcacagggcttttcaccgcgggagcggggaggactcagtttaggtttttacagtactgctctggtcacccaggggatggagggggtggctaggggtgaggggcactggggagtgggggtggggactgaccttgagcccatttgtatcagaagcctggtctgccactccctgtctctgacccctgggatgctcagccaaacctttttgtggctccttttttgtttctttgtttttgagacagggtctctcattgtcatgcaggctggagtgcagtggcacaatcactgctcactgtacccctggtctcctgggctaaagcgatcttcccacctcagcctcctgaatagctgggactagatgtgccacccccacgcctggctaattcttgtactttttgtggcgactaggtctcactatgttgcccaagctgatcttgaactcctgggctcaagcgattcacccgcctcggccttgcgaagtgttggaattacaggcatgagccaccgtgcctggccacctttgtggctcatttgtaaaacggggacagcacctatgggcagtactacagcgacacacatggaggacatggcacaggctgggtacagagcaaagactcaatccaggggagctgtgcctgttccaagggggatggccatgggatgaaaaggggaggacgcaacagggacagggcagagagcctccgaggcaaggctcttcccgcctgtggccagcaagctaggagatcccgcagccgcaggctcggggcagcagctgcagccctggcctcaggcagaatccttgcaaaagcagacaggaaacctctagccagagagccacgtgggaccagagaagaacaggccttctgcaggcacaagggacagtcccttggcaccacccttggagaagctgccctcccaagccaggtgactatcaaagtaggggcaggtaaactgagtcctgggaagggcagggcacaatggctagccgactccaggagcaacatcagtgacactgtctgacgagctactgagctgttagggaactctgtggccagaagagacacaggctgccctggagggacttctcaggcttgcctggccccacaggatgtgggtctctagagagacgctgctccccaacacccatctcggatgggcaaagcggggcaaagggcagagcacagaccagggcagagcaagggccactgtagaccagggggtcctcaccgtccgagtcctgcagcgcaaggcacaagctacggacaagtgaccgactaaactgcagccccgcctctgcggctcacacaggatgtttaatggggtttatacagctttatctggcacggtacacagctgtgtaagggtggccaacgtcaccgtctggctatgggctactagactgtaagaaaacacatctaggctgggtgcagtggctcatgcctataatcccagcactttgggaggctgaggtgggagaatcacttgagctcaggaatttgagaccagcctgggcaacatagtgagaccccaactctacaaaaaattaagaaatgagctgggcatggtggcgcgtgcctgtagtcctagctacacaggatgctgacgtaggaggatcccttgagcccgagagatcaaggctgaggctacagtgagctgtgactgtgccactgcatgccagcttgggtgacaaagcgagaccctgtctcaaaaaccaaccaaccaaggccgggcacggtggctcacacctgtaatccctgcactttgggaggccgaggctggcagatcacctgaggtcaggagtcaagaccagcctggccaacgtggtgaaatgccgtctctactaaaaatacaaaaattagctgggtgtggtggcgggtgcctgtcatcccagctactcgggaggctgaggtaggagaatcacttgaaccctggaggcggaggctgcagtgagccgagatggcaccattgcactccagaccaggtgacagagcaagactccatctcaaagaaaaacaaaaacaaaaacccacatctagacctgaccaagagagaaacagctccagagcccaggagtaggagccggccagagcagctgagtaagaacctacattactgtctgcctggcacccattctcccctgcttcatctacaaacaggttcttgagttttcattcggaaaccaccctcccccactcacagagacggagacagcgcgagcaacagataatcaaggggtgggctgcagcgcggggcatctcttccagggtgtgtatatgtggtgtgtacgcacacagccccacacacgcacagacgcgattttcctttggacacgcctaacgcatttcctgctcacccattccagcaaagtggagttccttatggttccatgactttggtctctacggccctgtctccctgcctcagtctccctttctccttgggcccccgcgtctcagttcctgtccatattctctacagaactgtcagcaccgccccacctctccccaggccagctcaccttatctgtgtccccacggccctcagagctgctgctgccctctctcttgtcagacgtggcagccagcccggtgggggtggggggggtcgaaccgcagccccccagagggaggctgccaggaagcaggtagctggaggggccagggggcagacccaaagaggtgggcacaggagctggggtcatccccagacttgagggtggctttctgtggctgaggatctgtgggacgaggacagaggggtgatgagtaaagggaggtggaggggaagaggggacgtgcaccccactgttcccacgctgacttccccacagctgaggcaacaggctcctcttcaggccgataccttgccccagagctgccaggcccgcggttcctctcctaacccgaggcaatggacaaaagaaggggcggcagggactctcccccaggggagcccacctggttggtggcctggatcagctcctgggccttcgctcggctcgccaggttggcttcttccatcttgaagagaagtgcagtcactgcaggaggcagagaggtgacaacatgaagatgggagaggtgacaggacaggagctggtgaacctcacctggacacctgctgtcatctcctgcccttggccccagaacagccacaaagcctcacgctcagaactgggaaaagggggccttggccaatgagagaacagcccataccacgaatgttcttgggactccaggtgtgtgggtgcggggttggccagggtcatgcagtgatgagacagtggcaggagtgagattctgcctcctgacccgctgtggccagtcccaacctctctccccacctctgcagtctggtagaggcaaccgccatccgtaaggaatacgatgccctgctcaagccattctttctggtccctctctcctactccccgtctaggggaatcccagaacccagcccaccactccagtctgtgctggccaccacctgctctcaccggcccctctctcccagtacacccaggcacctagagcctggctggcctttactcacccccaccctcccagtctatgtccctataaacctctccctgccagggcaccccactgcctctaagtctgtaccctccagtccccatcctgtctcacctgccccagcaccaccctcccccaggggacactcacaggccaggacgccgctggtggtgcagtccacaccagctggcagattccagggcatgggcgggggcaacgtgggcagctgggagacacgggaagctggcccgtcctccgcccccgagtcaccggctgtggaccc

SEQ ID NO: 17687 - DNA, 20774 bp, Homo sapiens
gacagtgcccagggtcaccaggcaggcaggctttgcaggctccagggtggccgcagagcccctttaccaagacccctccagccccacgtggaggggagcctgaggcctggaaggagaaggaccacttgcccaaactgttcataggcaaggcagggggcctgggttctggctagtctttgtgtttcctactctgtgacctttgcgcctctcccagcctgtgtcttggtctacaacacggggacagccatcacccaccaggtccctgggcagaagtgaggaggtgtcagctgccccctgcagtgcttggtcttcatgcattgagcacctgagttgtatatagctgcacagatgggtaaactgagaccctgagcgggaataacaaccatattgggtcagagggcacccaacaccagacacgcacaagtgatcatagcaggaaccagtttattggttgaggtggtggggaacaggggggttggaggcacaccatgaggagcgagggctcagstctccccagggccctggaaatccatgccctccaccaagtcctgcaggtaggccttgtactggtcggaggtragggagagtgggtggctgttggaaatgtgcaggtccacagtattctccagggaggaggcaccccctacccgggccatttctaccaaggccctgaggcacgtgggcacaacctgcaggggaagtggggacaggagtcagggaaaacacccagccactgtccaccaaggtaggagtcagggcttggaggactacaactccctgcagcccctgctgtaacctaggatgaaccataggcctagggctgctgggagttgtagttttacacacacacacacacacacacacacacacacacacacacacacaccccctgctgtaactgaaccataggcctagggctgctgggagttgtagttttacacacacacacaaacacacacacacacacacgtcagggctgagcagtctgtgatcttgactcctgggagccacagccatggcctcacaatggcagctaaaacttgagtccaccagcttctacatggtttagagcaggggtccccaacccccctacggcttgttagggaccaggttgcacagcaggatgtgagcagcgggtgggggaatattactgcctgagctctgccttctgtgagatcagcggcagcattagattctcagaggagcacaaactctatcgaactgcgcacgtgagggatcggctgctccttaagagaatctaatgcctgatgatctgcagtggagcagtttcatcccgaaaccacacctccctgtccgtggaaatattatcttccatgagactggtccctggtgccaaatagtttgggggccactggtttagagagttcaaaacaggttctgcaggtgaggccatgggaaggagctcccggggatgaaaaactggttattgcagagatcttggaagttgcagttttttagagggccctctgggagttggagttcctgggagcaacctcttccctctgtaaggccacccctttcagccccagggactcaggtctgcaggcaccttgaccatcacgagcctcttggtccacggctggtcctggggccatgactcccccacacagaaccagagggcatagcgtggtgagcgtccgcttccttccgtgaaggtaatcagatctgggggcccaggagcctagtcagggatgagaagaggaccctctacccacccttccccgtaaacttgaatgataacccccaccacctcccctgacctaaggccctctgctgcctcgaccaggggactgcttgtttggggaaagtcccctccttccctccctccctccctcccatcagggtggggttgttggaaggccacacccccaagcccccaagcctcagcattcataacaggcccagagtagggggcccatgctcccaaggatgctcagtgaatctggagaagctggttggcattcagtcctgtctgaggctgcattgtccaattgcagccattagtcatgtaaggttatttcagtttaaattgtaaccaattaaaacgaatcacgtcctggttgcactcgcctcacctgagtgcttggcccctgtggctagtggctgctgcaccggacagtgcaggtgactgtcatttccatcatggcagaaagtgccactgcacagcgaaaccctaagggatgtagctttcctgctattggtctgttcaccatcattagttacgatgatgatgacagtggcagctaattccctgagcaggctctgtgtactgggcctgtgtctcaccccagcgctggcaggcaggtagagagaggagaccatccttggattccacgggctcagggcaaagtcctttgcctcggttatacagcgggccaagggcagccagcgtctgaattcagtcctaatcatgagttcttttttttttgttgttcgagatggagtcttactctgtcaccaggctagagtgcagtggtgcgatctcagctcactgcaatctccgcctcctgggttcaagcaattctcctgcctcagcctcccgagtagctgggattacaggcacgtgccaccacgcccgactatttttttgtatctttagtagagatggggtttcactatgttgaccaggctggtctcgaactcctgaacttgtcatctgcccacctcagcctcccaaagtgctgggactacaggcgtgagccaccgtgcccggccaatcctgagttgttaaccactgtgcaggctgctttgtactggccaggtcgaagcccctgtctcactcacctacaatgaagggccccaggtcaaacacgcctccttccttgtccttggggacctcgccatcaggcccatgcccgctgttggggagcagctcctcgctcactgcccagtatgtgtggcagtgccccagccgctgggcccagagccactgcccggcccgccagagagccagtcccccacccaggcagctcagcacatgcctcacgtagctcatcactcccctgtctgtcagggacatgccagggtctggcagtgtgactggccatccaggcagcgtcctgtctcccacttcggaccccaccagccgcaggccctccgggcaggagatggtctgctggaagacttggcggccccggtagaaggctgtcacctcgaactcccactctgagcagcggcagcagcggcatgaaggggagaggggttgagaatcaggggctgccgcccagacctcagccctcccagcctgcagctgacactcaccttcccccggcaccaacagccgcttcagtgggttctcagagggccccaggtttgggaagggagtgggattgtccaagctggggctccgcaggggctgagggcagggctcaggggctacagccaggcttgggggtcccggatctgggagtggggccaacaccatgttacccagtaactcatccagaatgtcttcctggagggaaacaaaaaaagagaatcaggcatttccatatccttttctggagacttcatatggaccaggtctgttctcagcaacgcagggaggtcaggcttgagctctgccttcaaggggcttccagcctggggacagagccagccatggcatcaacagccaaacaaacactaatgaacgccaggtgctaccattccaacccaaggatctggctctatgcaggtaagacctgggcaaagcaggctgggtagaatttcagaggggatgctcccccagcttgggcctcagcaggatcaaggtgagggagtttttcagttcccaagaggctgacagccccctgcgaatcgaaatccatgaaatcccgggaaggtgtgctcgggccttgaatgctgggtgaagacttggaattttctcctgaggagaccggggcagggacagacagggtcagcactggctcaggtgaggggcaggctggaggcaggggagtggggggatcgtctagagggagaggacaaggcccatggagacaggtcggagactgaggggcatgaaagttgggcacattctcacctgggtatcagaagtactgcctccaccattggtgtccggagaggtgtctggctgggaaaagtccccaactcctgttgagaaaagtggtgaggggagtaggagtgccaggaacccttggggccccagcctcccacacgaaccccaagctggcagacctgagttcacaaactcgtagattttatgtgggtcgtgagggtccttgctcyggtcctctgctaaacgcaacccttctttgcggttgagggcagagcggaaattcctcttccaggttggcaggtctggcttatccctcccgggaacatatgcaccagtggcctcggcccaggcctggggcaacagtggtgtcaggatggtgggggaggacgacttagatcctgctcctggggccctaaccctgtctcccgagtcctaacaccaccctctttccctggcaagttctaactctgcaaggtccatccccaaatccccccgtcccacctacctccatcccccacctctagttttcaaaaggctttttttctttttgagatggagtttcactcctgtcacccaggctggaatgcaatggtgcaatctcagctcactgcaacttccgcctccccggttcaagcgattctcctgtctcagcctcctgagtagctgggattacaggtgggcaccactacacctggctaatttttgtatttttagtagagatggggtttcaccatgttggccaggctggtcttgaactcctgacctcaggtgatccgtcctcctcggcctcccaaagtgctgggattacaggcatgagctactgtgctcggcctcttcaaaagcctttgaaacctctttggtttttgttttgtttcgcttttgtttttaaagagatggagcctatgttgcccaagctggcctcaaactcctgggctcaagcgatcctcccgccttggccttgcaaagtgctaggattacaggtgtgaaccaccgcccccggcccaaaaaccttttctttctaagccaggcttccaagtccaacttggtgtctaatcccgtgcaccacctgccccgcgacaccctctgtgataaccccgcccctcacactgtttaccacctctggcatatactaattcggtagttaggaacctcagatttggggctccaggcctcacctctgatgtttcaagaaccatcccccagtatctatcctacaaccaagagccccggcctctagaaagccccaaacccccaggatgcatttcctttgcgtactaaccggctttcccggttttattcccgtaaccctgcagctccaaccctgcttgcgccccaccatcagtcagcggatccggctagccccgcccctcccgttctagccccacccaccagcgttggcacgagcccgcccctcgcgcgccacctccgccttctcagccgggcccactaggagtcctttccgcccagcgcgcagctccgggtttccagcgtcccaggtcgtcgcacgcacctggaagattccgaaatcctcctgctgtgcatcctgccgtaggccgtgcttccaagggatgcggaagcgcgtgcggctcttgttcacccaggccacgccctccagttgccccaggtccagctgcgacaccagccagggcaggatccgtggctttggggttcccatggtccggcctgcgcgtatagggcatttcctgggcgcgaccggcctcccccggacccacctggcctggagtttccgcacccagacctccttctcacgggccacggcacaggtccttcacccatattttcgggggtacaaacaggaaacctcctcttcccatcctcccatcctcccgagaggctctctaatcagctagggttccttcccatatccatggcacatccttccccagcgtcttcagtgcagaccctccactccctcaattccgccagtatagacctcctccctcccccacatcatcgaaagtaagtatccccactttcagggtagcatcctctttccctagttatttcagtgcagaatcgattcacgtgtaagcctctacctcctgcacttaccccaatgtagacccccttccacagtccccctacagaagatctcccaaaacatttccaacacagaacttccattcaattcccctccgactgcccgcctccctcctccaggacagagcacgccccaggtttcgagactgaactacccccatctacggagtccacccctccctctctagaaccccctcagtgtagacgcctcctcttttcctctttcctccctactttttctagtttttctgcagccgacctccagcgtcggccactgtagctccttccttgctccactttccccagagtacacagcctgcctttccactctccgtgcagacccatcctctttcccgctcctcgctctcggacgccaccaacgctctcccrggctcttccgcgttacctacgatggaaggtcggggcgtgcgggcagctggaacccmcccctgtcttggrgctccgggtagctctcaaactcgaggctgcgcaccccctttcccgtcagctgagctctagagcgctggggctttcttttygatcgacttcttgaaataaaaccaactttatcattctttgggtaacagacccaaaagccgatgggacggcccgctgggctgttcccgcccctatgcccttttttgggtttccggccagaggcatgctgggagcgtcacatgcaaattgagcgtgcacccagcgttccgccctttctacgctgggccggttatcgacccgkcccagtgcgcaggcgcgggaaagttgaactaataaagtttgtacgagttcagtggaggagaccgcaagttgagtggaggaggcggcggtggggccccggaccaggtcagcggggtgttgacgaggggtggggtgaggagggaagaggagggggccgggatccagtggtgggcaccccagtcccgcttctctgatatccaagggtccagggtcctctagattccagcaggggtcggagatttggaactacacctcacagcaggctgcgcggcgaagaagcgcggacctaggggaagatttgccctgaaacctcttgggattggtagttcccgatgctttaagggtttcaggagtttggcatatgcctcttatagaatccaggagttggggcgctaagcctcttcttcctgggagacctaagggtctggggctccagttcctttttctctaagactcagaagtccaggaccccagctccctcctcctttagacccacgaatctgggcacccagccccaccacctttccttggatcgaagagtctttttcctgatcgctttttcgtctgaggactcaagagtctaggcccccagacccacactctccaaaggacccaggagtccaggccctcagcaccttccttgggactcacaagtcctggtccccaagcctccacttcttgctaaacccttggagtccagtccctaaccctctctctcacaggtgcctccatggcaggctctgaagagctggggctccgggaagacacgctgagggtcctagctgccttccttaggcgtggtgaggctgccgggtctcctgttccaactccacctaggtaagaggagtggcccttctcccccaggggccagcatttgaggctccctcctaactcttgctcctggtctcagtctgtctcctctctttatatctggctctattctctgtctttggggttttggagagaggtcctcagcgsgggagggagggagttggggaaagagactgcttgcaggggatctctggtggggtcagtctctgaagtcctcctctccagaagcyctgcccaagaagagccaacagacttcctgagccgccttcgaagatgtcttccctgctccctggggcgaggagcagccccctctgagtcccctcggccttgctctctgcccatccgcccctgctatggtttagagcctggtaagagatttccatgatcatctatgaagccggcagaacacgggataaggtgctagtttaagatcactcagctagggggtggctgtgtggagtctctagcaccagccttcaggacagaaccgtcctgtcctctcccctccccagttagatttctgtcaattctgtgggttggctttcagagagcatttggtcaatctggttgttgtctctttccttccataactacttccctgcccctaggacttttgtagccaggaatacccctgatagaggggcagaagggctggttttcaatcacatctccctggctgttttagttgcgtgactctggggaaaatgctttctcttccctgctcccctgtttttccaatagcagagtaggaattggggaggaggtcactggacttgatcaaggtgacccacaagtttcctcataggtgtgaacctggacagactagtaatggctgctgggagtgctagcttgaaaaggggttcacagcttgggagaggaagtgctgtgatcaattggtgatgtctgtagtgagtgagggaaggggatactaacagtaatgtcttgtgtttgccttccttggatgagatcatcttcaaggtctagttgagctctgacagtcttttggagacagattgttgctctgtcacccaggctggagtgcaggggtgcaatctcgactcactgcaatccccacctcctgggttcaagcgattctcgtgcctcagcctcccgagtgactgggattacaggtgcacgccagcatactagctgatttttatacttttagtagacacggggtttcgccacgttggccaggctggcctcaaactcctggcctcaagtgaccctcccacgtcggcctcccaaaatgttgagattgcagacgtgagccaccgcaccctgtcagctctgacattcttttttttttttttttttttgagacggagtttcgcccttgttgcccaggctggagtgcaatggcccgatctcggctcaccacaacctctacctcccgggttcaagtaattctcctgcctcagcctcccaagtagctgggattataggcatgcgccaccatgcccggctaattttttttgtatttttagtagagatggggtttctccatgttggtcaggctgctctcgaactcccaacctcaggtgatctgcctgcctcagcctcccaaagtgatgggattacaggcgtgagccactgcgcctggccccagctctgacattctaagtccagtctgaggatctcataaagtgaaaagtacaagggttttggcatttttaaccaagttttctcactgggcctcagtttaccccattataaaatgggaatcatggccaggcttggttgctcacgcctgtaatcctagcactttgggaggctgaggtgggtggattgcctgaggtcagcctgggcaacacggtgaaaccccatttctactaaaatacaaaaaattagccaggtatggcggcgtgcgcctgtagtcccagctactcatgaggcygaggcaggagaattgcgagactccgtttcccaaaatcaatacataaataaataataaataaaatgggaatcattgccacctgccaaggtagttgggggaaggagagaatccgtaagtttccaatgtcctggaaacctgtcattaactcttttcaccccaggcccagctactccagacttctatgctttggtggcccagcggctggaacagctggtccaagagcagctgaaatctccgcccagcccaggtgaggcacagaggagccccagagaaggatggcggtgggaggatagtcagggttctgcccccagccaaattctcttctgcctccagaattacagggtcccccatcgacagagaaggaagccatactgcggaggctggtggccctgctggaggaggaggcagaagtcattaaccagaaggtgatgggcatctgtcccactccttggcaaggacaggagttgcggaatggtggggcactgggatcagaagctggatctgtattttctttggatggtcaggtggaaagaggctgggacaaggtttcaatgaagggttgaggccgggtgtggtggctcacgcctgtaatcccagcactttgggaggccgagttgggtggatgacttgaggtcaggagttcgagaccagcctggccaacatggtgaaaccccatctctactaaaaatacaaaaatcggacaggtgtggtggtgcgcttctgtaatcccagctactcagaaggctgaggcaggagaatcgcttgagcccaggaggtggaggttgcagtgagccaagattgcgccactgcactccagcctgggtgacagagtgagactctgtctttaaaaaaaaaaaaaaaaaagaatagttgaatgacaggggtatggttagggtagtactgtaccgtaaattagttgttttaattgattgtttagaggggcatggcctaaatgcagagggtgtggccatcagaaacattatccacaagagactggccaagctggggaagtaagtgaatgaatgtgggggtggggggagtggctaaaatcttactgagcatagaagggacctggcttagaatgtaggggaaaatgtactaccagaggaggtgtggcttgtggctgtgtcctggaatctgattggcttcggagcttggacaaggtacatcgtcctttaatattaattgaatggtagagggcaagattgttgtagacactaggttggcccctgggaaaggtcaccaggggcatggctagattaactcagttacagtagagattggccctgattggctgttgaggcaagggcctggcatggcttagggactcacgttccaggccastatcccgggggtagtttggcagagaccctggagtctggcttgattggctaatatggatgaggggtggcctagaaccttagcatctagaacgatcctgaaccgggaagccacgcctcccggccctctattggctggccccgggggcgctgctgacgcggaccctgcctcttccaccctacagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggtgagccgctgaagcctctctctccgggcctcactttacctaactgtcatgtgatagaggaggggcggggacttcttaggttcctctcagacctcaggtattctcccagctccactgcgttcgttctgttgagcccttgctgtatgccaggactgcagcgatgagtgcagacactatgcctggcgtcaacgactgggtacgctaatactgtgagcgtgaaaccagtgactgaggttactcagggagaggccggacggggtagctcatgcctgtaatcccagcacttttggaggccaaggcaggagaattatttgaggccaggagttcaagaccagcctggacaacatagtaagaccccatctctacaaaaattgaaaataactagccagggtcgggtgcggtggctcacacctgtaatcccagcactttgggaggccgaggcaggtggatcacctgaggtcaggagtttgagaccagctggccaacgtggtgaaaccctgtgtctactaaaaaaaatacataaattagccgggcgcggtggcaggtgcctgtaatcccagctaccgaggagactgaggcatgagaatcgcttgaacctgggaggcagagattgcagtgagctgagatcatgccactgcactccagcctgggcgacagagtgagactgtgtctcaacaaaataatataataaaaacctggtgcggtggctcacacctgtaatcccagcactttgggagactgaggtgggtggatcacttgaggtcaggagtttgagaccagcctgaccatggtgacattcagtctctactaaaaatacaaaattagcccggcatgcctgtaatcccagctagggaggctgaggcaagagaattgcttgaacctgggaggcagaggttgtagtgagccgagattgcaccactgcactccagcctgggcaacaagagcggggctctgtctcaaaaaataaataaataaaaatttttaaaattaataataattagcaaagcatggtagctcacacgtttactcccagctactcaggaggcagaggagccgggaggatcacttgagcccaggagttcaaggctgtggtgagctatgattgcgccactgtactccagtgtgggtgacagagtgggaccctgtctcaaaaaataaaatagtgagagtagtagtgctacctcaaagggtcgctctgagggttaaaatggggtcaatgtggtaagccctctgtgcactgcctggcatgcaggcattttgttggtgaggttatatggctacctgctgcctttccaacagtgcctgccaggatgccctcccggggaaccccctgcctccgtcctgctccttctggtgggctctggtttcacccccaacgaggccttcccaggtccccattgacaatcacagccacctgcacaccctcccaccgccctccttcccccttcctgctttacttttccttccatagcactttgggccttccaacagatggtggaattgacttgttttacttgtcttctggtttatttttctttgttggtgtctcccacctctaacacatcagcttcaggagacccagaagtcttcccctctccttttcttactttatctccagtgccggtttcagagttggattgggctccagcgtgctggccctgtggcttggcgactgtcgcagtctccctgagcggcactctccccactggtccagtgagcaccgtctcatttacctgccttggggggtcgctgtgggtattcactgagagagggacacaagccaggctctggatggaaccggtttccctggcaggagctggtcaagtgtgtttgaggagcagggaggaggaggccagtagggctacagtagggtgagcgggcgacagatgagaggaggagaggcgccgggccagccaggaccctgtggtcacggtgagtgacaactcggactttgactctgggtaagccaaggtctctgagcagcggagggacaggcgctgatttaggcgctaatgggcgccctctggcggctgcctggggacagactgctgggggcgagggcagaagtaggggcacagggaggaggtgagtggatctcacccaagtcgggggcggtggagaatgctggatttaacttagcggtgaagctgacagatttggctaatgggccagatgtggggacagactaaaggatgctggcccgagcagctgcagggcgacatcttaagttccccgagatggggaaggtgtggggatgggggcgatgggggtggggagcaggactggaggtggtccggtctacagtaagatcagaactcatagcacatgttgaggggaatggatataagtgttgggctcagcaaagaagctcgtttattttattttattttaatttttcagatggagtctcactctattgcccagactggagtgcagtggcacgaccttggctcactgcaacctccacctcctgggttcaagcgattccctgcctcagcctcctgagtagctggggttacaggcgcacaccaccatgtccggctaattttgtagttttagcagagacggggttttgccctgttggccaggctggtctcgaactcttggcctcaagtgatccacccacctcggcctcccaaagtgctggaattacaggctgagctaccacgcctggacaatttcttaaaaaatttttttaaagtaggattgatagcagatgagttttctcggtgggccaggtcctctgctagggatttcaatggaatgatcccatttaaacccactacaacctcatggggctcttattgtcctcgtcttgtgggggcagagaggaaaagtccccagcatgcagagtgttggaatctggatttgtacacaaagccacgactctgaattgttcaaatcccaagactctcttccccatctctgactctgtcccccractcttcactctctctggatctctgtctaatcccactccagtgtcctgaccctcctygagctcaacctttcctcctcctgctaggaccctgccccctcayccctgtgcccttctgtctgggtctctgtccccttgtstgggtgtctgtcaccctccgctctctggttcctcgccttcccgtctctaatctcacagggctgatgtggacgctgctgtatggggggaacacctgccctgctcacagggctctgccacttttcccttccaggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaartattcaattgtctgttcttacacttgggaactaaagttttaaggagaggagatttggttcagagatttctgtggcttacgcaaattgaggaaagaaccagttcattcattctagaaatatttatttgcagcacctacaagagcctgtctcctggacatgtaacatatttgagagaatacctgtaaatattccagcaacttgcatttttttttcctattgcacgatctggttattctagctaatgctgtatgatggtcatggagtctttccagtgaattccacagaaaggtacagtctaacttcacctgtgtctaggacaccaccctcttcttgtttttctcctcccattgctcctttcaagtctctcttgctggtttctcatctacctacagaccagtggtttgtctcacacacaccccccactctccctttttttttggagatagggtcttgctctgttgcctatacttgcactgttatatagatacagtggcactatcatggctcactgcagcctcaacctcctgggctcaagtgatcctcccacttcagcctctctagtagctggaactaaaggcatgcgacacgacgcctagctaatttttaaaaaagaatttttatgggaggccaaggcaggtggatcacttgaggtcaggagttcaagaccagccaggccaacatggtgaaaccccatctctactaaaaatacaaaaattagccgggcatggtggtgggtgcctgtaatcccagctacttgggtggctgaggcacgagactcgcttgaacccgggaggcaagaggttgcagtgagttgagatcacgccactgcactccagcctgggcaacagagcgagactccgtctcaaaaaaaaaaaaattgtagaaatggggtctcccttatgttgcccaggctggtctccacctcctgggctcaagtgatcctcctaccttggcatcccaaagtcctgggatcacaggcatgagtcactgtgcctgggcggtttgtctcctttatagggccatatcccccttcacagagtaatgtttgtaaattaataagtgaaatgtacaggattacaaaccgaaccaattacagttgatcctcagtatttgtagattatttgcaaatttgcatccttgctacaatgtattcataccccaaaaattaaggcagtgcttttgtggtgttttggagggcaatgcttatgcacagagctgcaacaagctaaagacctgatgtgcatatttgcagctgggctcctcttgcttcagctcaaacactggaaacaaatgtccttttcttggtttgtttagtgccatgcttttcaatttttttttttttttttaaagttagagtctcggtctgtcgctcgagctggagtgcaatggcttcatcctggctcactgcaacctccacctcctgagctcaagcgattctcctgcctcagcctcccaagtagctgggattacaggcgtgtgccaccagtcctggctaatttttttatttttatttttatttattttattattttttgagatggagtctcgctgtgtcgcctaggctggagtgcagtggcaccatctcagctcactgcaacctctgcctcccgggttcacgtgattctcctgcctcagcctctggagcagctgggactacaggcgcccaccaccacacccggctaatttttgtttttttagtagagacgggggtttcaccatattggctaggctggtctcgaactcctgagcttgtgatccgcccacctcagccttccaaaatgctgggattacaggcgtgagtcaccgcgcccggccaaattttttttttttttttttttgagacaagagtctcgctctgtcacccaggctggagtgcagtggcgcgatctcagctcactgcaagctccgcctcccgggttcacgccatcctcctgcctaagcctccacgcccggctaattttttgtatttttagtagagacgggggtttcaccatgttagccaggatggtctcgacctcctgaccttgtgatccgcccgcctcggtctcccaaaatgctgggattacaggcgtgagccaccgcgcccggccgcctggcgtaatttttgtatttttaatagaaatgggggtttcaccatgttgcccagactggtctcgaactcctgatgtcaagtgatccgcctgcctccgcctcctaaagtgctggaattacacccgtgagccatcgcgcccgaaccctattgtaaattttaagtctcaggcgtttgccagcggcacgccagagagtatagcctgcgcggaggcccagaaaccaaagagcgagctcattccgggattggagagaagtgtgagcagagggaagtagagggatcggggagaggaggggcaggacccacgcattcggccctttgcattcagcttcattcaactaggaactttttctgcaaatcaaggaaagcttcccggaggaagtggtgcctaagctgtgctctgattcacgtttagaagctgaccagacaaagagaggtgggcgttcctggcagggggagggacttggcaaaaaccaagtggcttgagaggggttgatggttttaaaaaacttggaatgattatgtcaagggctagggatttaatgtgttgacgacggactcctattcctcacttgcttcgggaccccagctatgcccttcctctctctgggcctctcaccgattccgtttttcccccaggtaatgagcacaagctccctttttcctccagactccccccgggttgggaggatccaccgagtggacgaggagtgataattcctttgagccaatcgttggtgcctgaagccccgccttcttccctacccgtgggccaattgccgtgttctccttgaggccggccgcttggcgagggtgggccaaaggctgcgtgacgtcgcttccggataaaccaatggcagcgattaggaggcgggtcgttttggtgatggacaggtgtttcaagacgcccctttagcgcggggctccccgggaagctttgaggcggtgctgggtgtaaaggggagggcattcctggtggattttgcccaatcaccagtcgcgcttcttgcaatagacgggcagttttccccatcccgggtcgacttgagggggcgggattctggacgccagagttggcaaacccctgacctatgatggacgtattctctagccaattactagacggtattctcagacgggccgcctccattgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgagcgcttggagcgccgccgtgggcgggaggcggctttgggtcggtgtttcacgcctctgtggtggggaaagggctctaagttggcgatatggggttggaggtcccccgccgcacacgggggcgccgcacgttccacatccggggatatcgtttgaggtgacggctccctagcttccaagggccttcggcatccggcctagcggagggtcttatcccccctcccacgtggaggagggctgggggcgcttccggccaggcccccacgtggccgctgcgcggtgggtggggagggggtgtgccgagtccagtggcccggcggctccacgtgcgggacaaaggccccgcccccggccgggaaggggcgcccaggggggcggggagggggtccgaccctcctgacgcccccagccctcctccccggggacctgggcacacgccgtggggtgtgatcgacctggggccctccacgatgtggggagtctcttgggaggagcagtgcttctcagccctttaccaacctccttccgagctccgggggcatctgttgggatatcggacccggttttgtgcgttctgggttagggactggaggaaaaccaagaatggggtcccccgccgaccccgtttcccctcccagaattctccccctcgcccagggctttaggagttgggggatggggcatgcccctgtgacctccctctgggtggtggtggggcatctagatagagattttcccattaataggcgccgtgcacccccttgtggccatttctgggtgtgtgggagggacatctttttcatggggcgtgtcctgaagcccacctcccctcggatttcttcctggcgggcggagggaggagggtatgtccgctgggaaggagttgtgggaaatatgtaggctgagagctttaccctactggagccgtttatctcccccgggtctttgtgagggtgcgagatgacctccttcttcctgaagccctgtgcagggtcctgagccctggggtcctgagagtgggtgcctgaaatggtttcgagtgaggtttggttctcgtgcagccatgtgggggaggtttcagtcttgcgtttcaagccctctggggctggggttgtctggcggtagttttcagtggtattgagaaataggcccgagtgggaaaccccctcagcacctttcttcttataggcatccccgctagcttgggagagctggagggagggtgcttggagcctagtaggtcatggcctgtgacgtggcccttcttggagacttggatagtggtcacatctggaagagatgtaatctgatggggcctctgtccttccaccccttacctatggcattggctggaggggcaggtcagctctcagctgtcaggatgcagctcccaggggtcactgtaatgacttcccaccctcttggctgtctcctgcacctggggctctatggatggaggaaataactttcccagaggtggcctcaggcttggccgcacctggaagtcttcagggcctgggatgggtgtctgaatgggggcgatggcctgactccccaagccactttttttttttttttttttgagacggagtcttactctgtcacccaggctggagtgcaatggcttgatctcggctcattgcaacctccgcctcccgggttcaagcgattctcctgcttcagcctcctgagtagctgggattacaggcacccgccaccaggcccagctaatttttgtatttttagtagagatagggtttcaccatgttggtcaggctggtctcaaactcctgacctcaggtgacccacctgcctcggcctcccaaagtgccgggattgcaggtgtgagccaccgtgcccccaagccactttctggagtcctctcattcttagagggtccaggagctgcccatcttccctgggaccctaccttcgtgggcagagggtcataagggagggggttggttccagctggttttgtttggggctcctgagtccaaggcaggagctggggtctggggtactagctctggggaagtacccgtgtgccacacctctattctggaatcctctcagacatgagactggtttgcagaggtggcagatgccctgtgggcatatcctgccagccccgctcccttctgctattcatggcaccctaggataggggtgtgtgtgtcaggaagtgtcacctaatctggaggagattaggtgatgagagggagcgacagctggcggtggtgggtgccaattcccctggcctggatgggggaggtgtgtggtcagctgcctggccagagaggggcagcgtgggggtgggccaccatctctccagccacagctgggataggagacccccctttcttctcccctcacttttcccaccctttcttaaacaccccacctcattacttgcccccttcgccaccactccccaccaagaaggagaattgctggaaacccaccccccggccagagcccaggttccgccacccagccctcccacagccactcccagtagctaatcctttttccctgttactctctcctagaattttgtagccaccttggctaatgggatgagcctccagccgcctc

SEQ ID NO: 17688 - DNA, 24567 bp, Homo sapiens
tcttggcctgcagaaagcatcctcacatggtctttcccctgtgtgtggcttgcagggggaagaggtggcaggggatgagggaaatggtggatcagaagatatctggtgcctcttccccatcttgtaatgacaacagttctagccccacccttataactttatttaactttaattacttctttaaaggccctatctccaaatacaataacaagggcaggagccagacccttggaatataattctctcttctccatgtccagctgagattttatggcccgttttttcacacttgtccctttattttgccattccattcatctggtaaaattccaactttggatgaaccaaaccatcaacattctccttgcttgcatccaaccagctgagctctgctgagaaattgatcccactagaaatttgtagtcatcaccccttaagtgggccctcagtattttcctattatttcactacattcctcaggtctccttttcccttctcccattatatattgttttcttaaaccatcttgactactaaaaattttcatcacacgcacacacacaaacacacacacaccactctctgataaccagatctccaactccatagcaaaaataaaaactatcagacagcagctccctaccaaatctacaaacaactgtctcagttaagatgcaggttaggttgccctgacaatagaggaaaaaaactgtaacgagttaagactgcagtttctttttcatgcagaagaatcagggatgataaaatggtttgagagtataggagacccagactccttccattttgtcactctgccatccctaatatgttaccctcactgcatgattgaaggtggcttgctttcctatttacattcctattgccctcccataggggcaaagaggaagagaaggtccatttctctcctttaagaccttgatgtggaagctgcacatatcacttctacctacagacactacctagtcatagtgtgcattttttgcacttagctgcaaaaaggtctaggaaatgtagcggttaatttgtaggccataacttattttcatctataatcatctttttctactaatttcctctcacaattgagtctctactgcaatcaaaagctaggatcctccacttccgctctggattgcatacatccctgacttctcaggaaccttgcattattaattagccattctcctgtatctttagtctttttatatattggagtaattccatctgccaaaaaaatgaaaaaaagagaaagaaagaaaggaagaaagagagaaagaaagaaaagaaagttcaagtccacccatcttaaaaaaaaaaatctttcatttgacatcctcttgcagctctatcccctttccttagtaactacatttcttaaaaacttgtctgaagtcatttactccacttcttcccaccatattcagttttcaggacatctaccctgccttctgcctcaacaacctcactaaaatggctctttctaaggttgccaaagatctccaggttactaattttggaccacatttctcattcctcattttgcttacccaggagcagcatttgaatgagttcaccagtttcttcttgcacctcttctcttttagcttttatgatgcttcactctctgggtttcctcctgtccctctgtctactctttcttggtgtcttttgcaggctcatctttctctatccagtctttaataatgacctctaaaagtctgacttgatccttcatttgttcttattctacacactctaattctgtggtttgcattacttcctatatgatctgtatatttagcttcctaatggaattctacttaggtatctaatagacatctgaaacttaatatgtccaaaacagaacagatttgatggtgggagtttctctgtgctagttactattttctctatgaagttggagtctaggttgagagtgaagaatgctctgtgtctctgtgtgtgtgtgtgtgtgtgtgtgtgtgtgtgtcagggtgggagaagaaattagagattttatgagacgagaaaatttaaaaacaatattgtgtaaaatgagagaaagaaggtaatcagggaaatttggtaagacatctactcattctaagcagcacagtatgaacaactgaattctgatttccaaaatccctgactttgacttctggctctttcacctagtagctttgtggctttgggcaagttacttaaactctctctaagccatagttttttcatctaaaatagtgatcaacaatattggacctaaattcatggttcttcatgaagattaaatgtacttacaggtaatgtgccttgaacatcataggtgatcatcaaatagtttatattgagttaccagaaaccttattcattttttatctcatccttctttctcaccctccacatgcaaattatctttaaattctgtttctacctcctagataggtcttagatcaatcttttccactacgtccatgactttaggtcaagccactaccatctctcacccaaattactgtcatagactcccaattggtcccaccttttaagttgctccccacactaactccactgcaatctttccaaatctttctaaatcttaacaaatttccaatgctcccaattcttccttgcatggcttgcaagagtctgcatttgctgcctcatgagatagaaggtgtatgatttgtctgttgctgttgtaataaattaccatgaatgtagtggctaaaaacaacacccatttattagctcacagatctattggccagaggtctacacagtgtggctgggttctctgctcagggtatcagaaatcaaggtttcagccagactgaattctcttctacagactcgggggaggactgaagtctctgttcttttgctggctgtcagctagagactgctgtcaactagaggccactctcagggcttgtcctgtgccctccttcaccctcgagccagaaaacagccaccattcgttccttgccacattatcccctccatcttcaagctatcaacagtgtgttgaattcttctcattcttccaatctctttgatttcctcttctgctaccagcaagaaaaaaagaacccttggcttttaaagaactcatgtgacttggttaggactagccagataatctgtctatcttgagatcaactgattagtagaattaactccatctgcaaaatcccttttgccatataacataattgtgggagtagtatctcatcatatgcacaggtccatccacacacaaaagaagattatataagggtgacagtcattggtggtcatcttctaattctgcctacccaaggagaggaagccaggggaaatatccctgaagaatcgtagcttgagctgagatcagatggatgagtaagtgttaactaggtaaggaaggaaagaagaagcttccagagagcatatggaaaagtcatgcaactgaaggacatatagcaaaaaaaaaaaaaaaaaaaagaaaagaaaaaagaaaaataaaagagaaaaaagaaggagtgaccaaaaaaaggctaatgtgtttacagtggagagaataagaatcattgtgactcttatttgaaataatgtgatttgaaataatgtggctagagaggtaagtgggagccaggcctcacaggctttctaaattctgttaatatgttttctcattcccaaaagcaaaggtcaaaagagtgggatagtcagatttgtattctgagcatagtacttcggctttaaggtgaagtatagatgtagagaggcatcagtaaaatgtggtggcccatttaggaggttaggagtgtggttcaagagtagggtaatatcagtggacatataagcaggcagattcaaggaacactcagtagctaaaatgaacaggactttgtgattgattcaatatgggagtgatgtagttatgttccccaggaagcagactctcaaacaaagattactgtggaggatgtttactaaggagcgttcttggagttaacacctgtgcaagagagaggatgaaaataggattgggcaaaaggagaagctgagtagtaattcagtcccagcaaagacctcagtcaaccatatgaagggttctaggggtgtgagcatctttcagagttgtccaccactgggttgaggggattaaacttttatacctctgtgctgatcggtcattggatatagaatgcccaagaaagggagcataaccttggatgagctggctttcttctgcttaggcaactcctgaagggttatgacagctgagggccatcttttaggagcactctccacagctggaaaataaatcctccatttttgaagagggttctgggctttgcatcacagcatccagcgcaggggtgaaggagcataggggagtaaggcatcaataataattcctaaatttctgatttgtacatcctggtgggtgcacttaacgaccatatattacaatcattggcttgcttgggaaaatcccactagagtaggtgctactgaggggcaaactatattggacaactagtgcatacccctagaactggcatagtttgctaaataagtgaatgtccatctatttctattttcactcccctctcccttacatcctttgctcccttccctcctcatcgtactgtcatccaatgtgggaaaacttgagcaggttatctgaggccccacctgtgctggagcggaacaaatagcaaatcaagctcctctggtccaggctctctgatgggcaagacaggcagtaccaggaggaaggaaagggggagcagttgatgacatctcaggcataaactgtctttcaactctctttcaatgcttcagcccctataaactcagggctggctgaaccaggtcctctccaaaagattaattggataagggcctgctgaatcccccataaagccagactccattctctaatttgctcttccactgatgcccgcccccaacctcttacagctactgctgggggtcagaagaatttcacatcgtattggagttcatccggaatctgaagaatggataggaatctggagataggaatctggagataggaatctggggaagaaaaggaatggataggagaatgcatagggagcagggctgaaatagtagaagaggcaaatcctgccccgagaagctgaacccagttcagtcctgcacccttcagccctgttcccgctgcaccgcagtgacccagtccccttctagccccctctcgtgggaacctgacaccctacacaggcagctctgcctgcactgagagcaaacagggagcgttagcgtgtcgggtgggcgtgggcgctgcctggagacggtggagaaagccaaccttctccttctcttttgcctgcgctgggccggcgttagaattatatcccatcctcaccttactctggtttatccttgtcagtgcttgccaccacycccaactgccctcaacactcaagtcagaagcttcctcccgggagcccttttccctggcaaggcttccctggagccaaatctcggccccggccccacccccactcccgcccagctgtggagggctccttgggacccttaagtgcaagcctgagtgttaagcctcagacaggagatggagggtgcggagacagatgcaggagctaccccaggcccgcagcgaggagctgcagggaactacggtagcaatagtgtcacggtcactgcggccactgcaacacagtacggtaaatgcggctctaggctcagactaaagcatccgcgcctcagcaggtgacgcacgcagacctggtctccaacgccacctccacgttccctgatacaccagagaaagatgctggatccgtggcagccgtctctacccaacccctcctaccctcccttccccgaaacctccccctacgctgccaatactcttgtcttcaatctctctctctctctctctctctctctctctctctctctcttctctcattcctgggaatcgggggtgggggcgggtgataaagagaggtgggcaggagagaaatctctaagaggagacgggacacatctagggagggggcgagcctggaggacagtcgcacagggaggggcagaactcccgagccagggagggggtgcacagtcacctggmgggacagaggctggcggagggacgggaacccaggcggggcgagccgmgggagagtggagggcaggcgcctgggctgggggcggggaccaggcggggcagggggcagggagaggagggcggcgggagcctgagccggaatcgcagcgtgagcaggtggagccgcgktgggagcccgccgggtcgagctgagtaaggcggcgggctcggcgggggccatggagctgctmaagctgaaccggagcgtgcagggaaccggacccgggccgggggcttccctgtgccgcccgggggcgcctctcctcaacagcagcagtgtgggcaacytcagctgcgagccccctcgcattcgcggagccgggacacgaggtgggtgcctccctcagccccccccacaagctatttctcactgtaccccagaacactaatagagtccccccaacgagctccacactacctcctcaaacgtccacaccgtgcctctcatagtactccctcagcccccaaacagctcccctcacaccttcacccccacagcctacaacttcatcacagcttcacaccacctggtcggaactccttcacatcctggtcccctgaatacacctagagcccctgctcaccccaaagcacagccccttccccaacacgcagcccctcctagacaccagtcagaaggcgaggacctcctcttgccaaccctgcagatctccttttccctcttacatccagttcacagagccacaacagagaagggaaggaagaaaggaaggcaggactgggaaaagaagggggctggttgagggagggagcactctggaaagcttgaatgcgaagctgaagttgtgatcacatctgacaccccagcccccagccatcccaaaaaagatcctcaaatctgaattaggctggacactaggggatgctccttagagctgcctgcctccatttcactccttctcaaacccctctgcctccctagttggagctttcgaggctctgtgccctctctctttgtctgcaagtaatgtctccagctatcttccaagctctctctccagccctaggctaggtgctgggggcacagggcaaactagacccagtctggaccctcatggcccatagccaagtgcagagagaaaccaagcaaatggaaaaatcacagacacaatggaagtcccatgaaagggtctaaactgtgggcaccaaaagaacttcacagaggctagaaccttagagctgggtcttgaagttsagtrggcagaaaaggaaggagtgggattctaggtgaaggagcaatgttaagcagaaggaaatttttctaaactcaaraagggaaagttggaataaattgtaatccaagtatttatttaccccacgaaataatctatgctttctcagccgagttgttacacactcacacttggattctgtcattcagccaatatttattgaaccagagattgtgctaggcagtgggaatgtaagttgaacaaaaccgacacaattcctacttcacagagctcaragtttaatgggcgagacagaaaagcaggggattgcagcacaaagtggaagagccttgacagggaaaagatagtgggaacacaagtrgarcacctctagcccagcccagcctccttgagaattaaagttggcctcttgaggaaatgagctacaaagtcaaaaaaattagggaggctggctctaagcttcctgttggcaaaaaaaaaaaaaaaaaatatatatatatatatacacacacacacacacacacacacacacacacacatatacatatgggagagccagccaagtgaacgggcagaagaggcagaaagcatcccaaataaaaggacaagatgtataaraagctcaaagtttgaattcatggcacttttatccactgtgacatagttttgagtgactagaacatatatcttaagaagggaataatgaacaggctggagaccagcctagagggtttgcagagagcctgctaggcctgaccatggaayatggactttatcgcaagggcaataggaactactaaaagattcggtagtactaccaggattagttctataatgtggagaacggattggaagacataagatggaaggcagggggatactttasaaggttactrtattacactgttctgggtgaaagatgatgctagctgagactaaggtaatggcaagggagatggagagaggtggatagatttgagagcctcttctggaaatggaatcaacagattagaagcagagaggatggaagaggtcaagggatgacattcagatttctaacttggacaactgaatggatattggtgctatagcaattgtatacaatgagaaagataacaaaacagcagaaacaggtttggaagagggaattataaattcagtttggaacccattgagtttaaatgttagtggggcatccaggtgaggttacctagtaagctgttgaatccaggggtctggaacttacaggagaggtctgaggyggaaatacagacttgaagaaggtctttgcctacaggatgtagaagccccgagaatagttaaaatcataaaattttgtatagaatgagaagaaaataggtcctaggtcaagactctgcataagaccattatttaaaagccaggcagagaaaggagaatttatgaaggagattcagatgaaaccatcagaaaggcaggagctacgcccttccagaaagcaagaaaaagagagtttcaagcaggttggggtaagtgatatcaaatgctattgacataagttacataaataaaaaacaggacagtcagaacagcatccttcacattcaataacaagaaaatatttaggagttgtaggtattgaggcttgactatggtaggttaaagattggactggtgagagaaggagttatgagaagtgaaccaaggtatgtagccaaaactttcaagaagtctggtaggcaaagaaagagagagagagagagagagagagagagagagaaagaaaagcaggatattgccaaaaatagcatgagattgaggaaggggggagtgggtatgtgcataggtttgttacgtgtgtgcgcgtgtgtgtgcacgcattttaaaacaagagctttttaaaatgtttgttggtgattgggccgagagaggaagattgaaggtgcagataagaaaggggatagtcaatagagaagattccctgtgaaagcgggatgtgacgcaattcagagcacaggtgcaaaaatttgcctcacttatctaaatgctcctcacacatttggatgttacccagccagtcagatgttacacacagagaccctgtcagccacactcattcagatattatccctgcagatgcataggttacccaggttcactccaatgttaccaataggaatttggatgttaccactttattctccttatataatccatgcagacttgagtattacccatgttcactcagatagtacccacagaaagacaaatgttaccacactcactttaatattgtccgaagtcattttggtgttacccatccatcaaacactactcactttcattttattattatccacacacaaccagatattacctatgctcacttaagtaagcttttcccagatactacccataaaattacaaatattactctcacatactcagataatacccacaaaagcttaaatattacttacattcactcaggtgctcagttatttcatttactcagattaacatctttttttttttttttttgaggcagtctccctctgttgcccaggctggggtgcagtagcatgatcatggctcattgcagtcttgacctccgcaggctcaagtgatcctcccacctcaaccccctaaatagctgggactacaggcatgtgccaccacaagtggctaattttttgtattttttgtagagatagggtttttccatgttgcccaggctggtctctaaatccttggcttaagagatctgcccacctcagccttccaaagtgctgggattacagatatragccaccatgtctggcccagattaacatcttaatttagttaacatgttaacatctaacatctgtactcaaatactacccatacatacttggatattacttctgctcrgtcagcaatttctatcattatttggatattccactactcacaagtagacctctgaatgtaatctatgcttcctgaagatgttacctacaaaatgttatctacagagagttggatattaacccttgytctttcaaatgttactacagtgactcagatattatctaaacttaaatgtaagccatattcaatcggatattacctataagcatgtagatgttaccattctccagatatgtcccacagaaataagcgtgactttcacctacccatatactatttcaaagattaaagtatgcccaacactcactctgatattacctacacacccttgcatattacttctgctccctcagtacccactatgtggattcccccattcacccagccactacccacagtcagttggatgtgatccctgcttatcatagagacaagggtattactttgatgtctgtgtgcatsggtgaacagatcaaacctgccagtagaatgcagaatttaaggcatcagcagcttcagtgttctgtggagtttttccttagaaagtcttggttttcattttatgtcacgttgtctggatttttgcactcatacttctctgccattatctagacagaacaaatacagatcttctaaacaccaggagaagaactgaactgtcccaatcttctgagtcgcctggtctgatgccagttttcctcatccccaggaagatgatgagatgatgctcacgggtagacttatcaaggcacttgtggatgtaccccagcaggtgctatctcccatccttctacccatgcctgtttcctagtcactgaagccactgtcatcactcatattccaccatgcaaacacacatcaatacacacacacacacacacacacacacgcacacacgcatacaagtctaagtctgatttattttgtgcatggctttttaaactaatggattatttttagagcagttttaagtttacaaaaattacagagtgcccatacacacacaaccacacatatacacagaatttaccctattattaacagcttacattagtgtggtacatgtgtcacaatttatragccartatcaatacattattctctaaattctagagtttacattagggttcactttttgtgttgtatggttctataggttttgacaaatgtataatggcatgtatccatcattacagtatcacacagaatagtttcactgccctaaaaatcccctgtacttcatctattyatccctcrctctgcctctccaaactcctggctctaaaattgcttttaattagaatttttcacatttctgaactgttcaacagcaaagacgtgtggagacagtggtggctggaaataagataatagctaggaatgtccagtaaaacagcagaacactgcacagttgctggtcatttttactgggactttgtcttataaatttcaggagtccccaagcatattgcaaactttataagggtaatatttagctccatctttatggtctatcacaattagccaagttcaagggcacacacatgggacatcagctggatgaatgaatgagaaattgcttttcatgcttcacagtactgtaccaatttgaggtgtggcgaattgcatcaataattagttgaagaaagayatccagggcagatgtaagcaagataatggaactagaaasattaaagaggtggaggctgggggtgggaggacaatggatttggagaagaaacagtgagtccaagataaaccaccagctcttttctgagtccaaggacctctctgacagaggtctccctcctaaaagtcctttattctccaccatacacacttactcccctcaaattttgtcacctataagccttctgtaatccttccttacagagagaggcccagcttctaaaggaaatatagatggtttgcatataaaaaacaaaagttaygcatctgaaatcataacctctcactgacccccacaaggaccttccaacatgtgtctccaaaaagacagaggcaaagargaagaagaaagggcatgctggagcacctctgcagagatgacggatggatgaggagggggaaagcaggtgcacttctgtcttgaaagacagaatcatccaagattcattaacaagcatgtgttgactgcctcccctgtgctagggatgatgagtgctagggatatactggagagcgagatggaccttgccactgtcctcaagaagctcctagtctagtggggaagacagagaattacatacatactaatacagtgaaaaatgccatggttgagtatagagagagggagaaagaggcatttagattgagatttgattaagaaggaggcagtatgggccaggcgtagtggctcaaacctgtaatcccagcactttgggaggccaaagcaggtgatcacctgaggtcgggagttcgagaccagccttaccaatatggagaaacccatctctactaaaaatacaaaattagccgggcrtggtggtgcatgcctgtaattcyagctactcaggaggctgaggcaggagaatcgcttgaacccaggaggcaaaggttgcggtgagccaagatcatgccattgcactccagcctgggcaacaagagyaaaactccatctcaaaaacaaaaacaaaaacaaacaaacaaamaaaaaacatggaggtagtatgatgaataacagagtactgcaggaacaaacagtaggaggcaaagcacattagggatcagggacttggcttctattctgattcagccccttatcaggtgtgtggtcttragcaaagaatgttactgctgagttcggtttggaagtttttgtaaatagcacttatttgatgcctacaatttctaaataaattggtttttgttatgagaaaatacagtcatgcattaactaatgatggggataccttctgagaaatgcatcattaggtgatttcattgtgtaaacatcatagagtgtttgtcacacaaacctagaaggtatagcctactacatacctaggctatatggtatagcctactgctcccaggctgcaaacctgtacagtatattactgtgctgaatattgtagggaagagtaacacaatgttatgtatttgtgtatctaaacatagaaaaggtacagtgaaaatacagcataaaagataaaccatcatacacctgtatagggcacgtacygttaatggaacttgcaggagtagatgttgctctggctaagtcagtgatgagtggtgagtgaaagtaaaggcctaggacattactgtacactactgtagactttataaacactggatacttaggctacaytaaatgtatttaataataarttaaacttagcatactgtaactttttactttataaactttttgactcttttgtaataacacagtgtaaaacaaaaaacacattgtatggctatacaaaaatattttctttttttatactcttatcctataagcatttttctgtttttaactttagaaaaaaaaaaacctttctgttaaaaccaagacacaaacacacacattgggctacacagggtcaggataaatattgccatcttccacctctacatcttgtcccactggaaggtcatcagggcaacaccacacatggagctgtcatctcctataataacggtgctttattctggaatacatcttaaaggacctgcctgagtctgttttatagttaacttttttaaaaaaataagtaagagtatactctaaaataatgattgaaagtataatgtagtaaatayatcaaccagtcacacagtcatttattatcactatcaagtattatgtacatcattgtatgtgctaggcttttatatgactgacagcacagtaggtttgtttataccagtatccccacaaacacatacgtaatgcattatgctgcaatgttacaataacattactaggtgatagaaacttttcagctccattataatcttttgttgttgttattttgggttttgtttgagacagagtctcactctgttgtgcrggctggagtgcagtggcactatcatagctcattgcagccttgaactcctgggttcaagcaatctttctgcctcaaactcctgagtagctatgactataggcaygtatcaccacacccagctaattttttatgttttgtagagacgggactttgctatgttgctcaggctgatctcaagctcctggcctcaggtgatcctcccgccttggcctctcaaagtgctgggattacaaagataagccactgcactcagctgttcattacaatcttatgagaccaccatcgtatatgaaattggtcatttaccaaaacatcgttattcagtgcatggctgtagttttcaatttgggagctaaaatgagaatcagtcaaagtatggggctctggaagagggggctgcagctttgaggctttccttctctgcaatctaggaggctctgtcccctgccctctctaccttccagctctaatccctctcatgctgaggccataggtgtgagtaattcagtcctgttcaatccaattygattttatctaaatctgcttggctgtgatgtggtggtccaaagattaatccatcttttaatagacaatgacacaaaagaatggggtcagcctcccagcccctctgcctcacacaggtgtccctcctatgagctccaacagcaccttatacatccttcagcctcactccttatcacatctgtttatgtatctgagtttacttccccactgtgagctctcaaatggcagggatcttgtcatgttcatctctttgtccccagtgcctagcacaaagggagtcctctgtaaatgtttatagagtgagaatgaatgtttggagagaattaaaatacaaggcagaagtaaaataggctgtaatagttgtgtaagaaacaggcatgggtcagagaaagaggagagtagaagggccttacagaagggccttacagaagaagtagcagtcaatttgagtcttgaccaacaagggatgaataggaattcaccagatacagaaaataagcttgtgatgaggggtagaagttgtgaggagggttggtaaaagagtattccggtctgagaaaccagcttgagcagggagagagtcacaagtgcaaatgatgcattcaagaaattgagtcatccagtggcttgcttaaatgcctgctgtacagggagggggtgggagagaaagaagtcccttctgggaggatcttgatgatattctgaggggttgcagacagtagagagtaagtatttttttttttttttgcttttgtttttagagaataaagacatgatctgatgtgattcaaaaggtagtgggttgtcaacagtgtagaatactctagcggggtcaaatagagtaggctaagaaaggacctttgaatttagcagttaaagattagtgtacttgggaagaagtatgcactgatagggcacagaatattgtattgtaatggaatgaagagtaaatgagaagacacaaatatcctcttaagaagtttgtctgcagaaagaaggaaagatttggaacgaaccttgagaagagacaggctttcttaaggaagggcagagttgggccaatttaaccaaacctcaaggggttagaaggctaaaggattcamgttcaccatttactgagcagttcatcggtggggaatgtaggcatctggctgggtagtgagggttggggataagacggaaggagggggatttgactgaatgaaggctgaccccctactgccacctctcccttttcttacccagaattggagctggccattagaatcactctttacgcagtgatcttcctgatgagcgttggaggaaatatgctcatcatcgkggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccrtcatctgcaaggcggtttcctacctcatgggtgggtgagacaaccaccccacccccacttgccactctccccgcctaaagctcttgtggatgtaggggtcttccccggttggcagggaggggtgtgaggaagtcccactgatgcttgtgtagtgcaagtttcctaggtgactccttcctttctcttcccttgtttaggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcaycgctggcccagtgcgcgggtccgccagacctggtgagcttgcccataaactatcctaggaattcctttctcacccctattagatgcttacgaccattgcccagaatcttcctccagcttcccgsagaattaccacgccaactcctattctgcatccaccaccctggagttccagtttggggcccctccccagktctctctcccttcccagcggcacccccaaatcctactcctacttcaggtacctggccacagccctagaaacactagtccttggctttttctccatctgtgattacagctggacagaaacccgagtgatctgtctgtgttgccttcaggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggtggggctggaccacgtgagcaaaatctgggmgaggcggagctttggagggcgacggggcctgctggagtgggtgggactgaaatgaaggtgagggtgagaaggaagctggaaatggagttgagctgggagcggaggtcaggtggggactgggctggagactggggggactcgcctttttctctgaccgcccaccctttgtgctcaggggctgttcaccagaacgggcgttgccggcctgagactggcgcggttggcraagacagcgatggctgctacgtgcaacttccacgttcccggcctgccctggagctgacggcgctgacggctccwgggccgggatccggctcccrgcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggkgttgaggcagggcaaatgacatgcactgacccttccagacatasraaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgactctgggatgctcctagtttgacctcacagtgmcccttcccaatcagcactgaaaataccrtcaggcctaatctcatacctctgaccaacaggctgttctgcactgaaaaggttcttcatccctttccagttaaggaccgwggccctgccctctccttccttacccaaactgttcaagaaataataaattgtttggcttcctcctgaacttcctttctggattcttctggggcaggtgaggaggcataggattttgcagtatccttctgtcaggtctctcccactgttgcacactgctgtgcacaaccccttgccagaaagcccagcctctgaggttcagcgtggctgtgcatattctttctgagttttcatcctctacctacattccaatgttgcaataactgtgaatggggatggaaaatggcatatccatgacatatcatgattcctgatcacattatcccaaagtggtgccactgttaaggtactatattaatggatgcttattaaattttgatgaaaagataaaagaggaagcactgtataataagactaagtttattcaatgtgtgtttgaaacaccagagatcagaccatgacaggtatacagaatgaatacagttaattaaagagtagggattttttgctgtactctcttccccagtgtcaaaacctggccaagattctgccaaatggaagcacttttagtagctacaacaaaaaaagacctgaataggagtctgagaacccagtctcccttttactataagaatgatctagccccagagacaggcaaagaccaacaatatcacctctttacacacaatgacaaatgaggaagaacaggaactgaggacctcactaagaggacatacgtggataatcagaggcatagtatattggaggaggggtcttttgatgcttcatcttgtaacagacaggggaaactgaggcccagagcaggaatgtaagctgcctaaggtcatacagtaagttagagcaagatagaataatggtgttgaagtagaccctgggctggagatggggaagaagacccacccatgaggagcagagacaagttttgtgggacctaaagtttataaaatcgggtactctttttttaagaaagaaaaagaatacaaaatcacagatacaaaattactgggaccctgaccagggccttgaaaggggcctgtgcaagtgatgagccctcaattttaggcctcattcacttcccagccaatatgcctctaaaatacacccactaactaccctggagaaggctgcatggagtagaggacagtgagaaaggagagtggttctgtttaccagtgctggggttgctcccatccatcgtttctacaggattctgggctgcaagaggcaggaagaaggaagaaaaggagggagaaggcgttccaagctgtcaactatgacagggatggttaaaaatagaatcccagctggtctgaggagctgcaggcagatattgggcctttctttctcatgccagcttctctgtggggtgggagtaggctggcccataggctccctagcactccaccgttccttctaaagactgcctgggactgttagccccctctagctggagcctgggctccagatgaccacgaaatggcagcctggagctgggtagagggctgggtctacagaatacttttacctccatcaccccattccatgccctatccagctgtcagatatggtctcttgagctccttccatctattttccatttcttgagatctgataaaacatttcaggtctagatttaatatcactgtccccatgaagtcctactttgtcattctgacaaagcttgtatgctcatatggtacttactgctttctctcttttgtcatagtcatctgtgttcctgcctaatttatcctatcagcctgagagcagcatgatgtagtaggaagatgactgagcctggtcgggggacagaggagggtagtggtaagatctaattctaagtgataggcattttatatacactgattcatttcattctctgaatacttccacagaacatttctcctcattcaaaagacaaataaagtgaagctaagaaagcttaaggcagttatacgaggtcctacagccagaatacagccaagaactgagctcgggtatctgacttcaaagctttttctatttccattatagtgtgttgccttctttcaagtctttccagtcctagttctatcttttaaaagttgtgtgattttgtgcacgttatctaagtgagtttcaggctcaggtgtaaaacggtaatattatattaaccttacactgccattttgaaacttaagtaaaataatgcatataaagtgcttatcattgtatcaggcacatagcataagaagagttagatgcatcaagactggaaggaagcaaaagcaccaggaaacaaagccttctgtagacaggtagccaccaataattgaacaggacagaactctgggtccaaggggaggctcagagcttgctacgagatgatattagaaagtgatatgtgtaggcaaataaatggtaggaaaaaaaaagaaagtggtgtacactggaataaaactagaaatcaaaaacaagaaaaattttggagactatacaaacacatggaaattaaacaatatgttcctgaatgacagtggatcaatgaagaaattaagaaaaaaatgaaaaattccttgaaacataatgataatgataatggaaacacaacataccaaaacctatggcatacagcaaaagcagtactaacagagaagtttatagcttgcctatatcaaaaaagacagcctaatgatacatcttaaagaactagaaaagcaagaacaaacccaaaattagcagaagaaaagaaataataaatatgagagcagaactaaatgaatttgaaatgaagaaaaaaatcaaaagatcaatgaaacaaaatgttggctttgtgaaaaaataaacaaaattgacaaacctttaactagaataagaaaaaagagagaagacccaaatatataaaatcagacatgaaaaaggaacattacgactgacactgcagaaattcaaaggatcattcgtgatgactatgagcaactatatgccaataaattggaaaatctagatgaaataaattcctagatacataaaatctaccaagattgaaccataaagaaatccaaaacctggctgggcgcggtggctcacacctgtaatcccagcactttgggaggctgaggcgggcagatcacctgagttcaggagttcaagaccagcctgaccaacatggagaaaccccatctctactaaaaatacaaaagttagccaggcgtggtggcacatgcctgtaatcctagctacttgtgaggctgagacaggagaattgcttgaacccagcaggcagaggttgcggtgagccgagatcatgccattccactgcagcctgggcaacaagagcgaaactctgtctcaaaaaaaaagaagaagaaagaaagaaagaaagaaatccaaaacccgaacagactaaaaacaagtaattatattgaagccataataaaaagtctcccagaaaagaaaagcacgagacccagtatcttcacagctgaattctaccaaacatttaaagaactaataccaattctactcaaactattccaaaaaatagaggaggagggaatacttccaaactcattctgtgaggcaagtattaccccaataccaaaaccagacaaagatacatcataaaagaaaactataggccaatatcaatgatgaatattgacgcaaaaatcctccacaaaatattagcagaccaaattcagccatacattaaaaagatcattcatcattaccaaataaaatttttccctgggaggcaaatcaatcaatgtgatacatcatatcaacaaaatgaaggacaaaaaccatatgattatttcaattgatgctgaagaaacatttgacaaagttcaacctcccttcatgataaaaccttcaaaaaactggggatagaaagaacatacctcaacataataaaagtcatatataatagatccatagctagtatcatactgaatggggaaaaactgaaagtctttcctctaagctctggaacatgacaaggatatccacttgcaccactattattcaacagtcctggaagtcctacagcaatcagacaagagaaagaaaaaaagaacatccaacttggaaaggaagaagtcaaattatcctcatttgcagatgatatgatctgatattgggaaaaacctaaatactccacaagaaaactattagaactgataatcaaattcagtgatgttgcaggatacaaaattaatatacaaaaatcagtagtatttctatatgccaacagtgaacaatctgaaaaagaaatacagaaaggaatcccccagttaataggattcctattttaaaaaagaagaaaagaacaatattaaaagaaagtaatcccatttataatggctacaaatgaaataaaatacttaggaattaacaataacaagtgaaagattcctataaaacattgacaaaaaaaattgaagaagacacaaaaaaatggaaagatatttcatgttcatggattggaagaatcactattgttaaaatatccatagtacccaaagcaatctacagattcaatgcaatgcgtatcaaaataccaatgacattcttcacagagagagaagaaaatcctaaaatgtatattaaaccaaaaaagacctagaacagccaaagctatcttagcaaaaagaacaaaactgaaggaatcatattacttaactttaaattacactacagacctataataaccaaaatggcatggcactggcataaaaacagacacatagatcagggcagcagaacagagaactcagagataatcccatacctccacagtgaacttatttttgacaaaggcgccaaaagcatacaatggggaaaggacagtctcttcaataaatggtgctgggaaaactggatatccatatgcaaaagaatgaaactagacccctatctcttgctatatacaaaaatcaaattaaaatgattaaagacttaaatctaagacatcaacccatgaaactactacgagaaaacattgggaaaactctccaggacattagactgggcaaagatttcttaaacaataccccacaatcacaggcaaccaaaacaaaaattggcaagtgggattacatcaagttaaaaagcttctgcacagcaaaggaaggaatcaacaaagtgaagggacaatccacagaagggagaaaatattttcaaactacctgtctgacaagggattaataaccagaatatataaagagctcaaacaactttataggaaaaaatctaataatccgatcaaaaaatgggcaaaacatctgaatagacatttctcaaaatgtacaaatggcaaacaggcacaaaaaacgtgctcaatatcactgatcatcagagaaacgcaaatcaaaactacaatgagatatcatctcacaccagttaaaatagcttttacccaaaagataggcaataacaaatgctggcgacaatgtcgagaaaagggaaccctcatacactgttggtgggaatgtaaattagtaaatcactgtggataacactttagaggttcctcaaaagagcgaaatagagctactataggattcaacaatcttgctcctaggtatgtacccaaacgaaatgaaatcagaggggctgagctcagtggctcatgcctgtaatcccagcactttgggaggccaaggcgggtggatcacctgaggtcaggagttcgaggccaccctgaccaacaaggtgaaaccccatctactaaaaatacaaaaattaactgggtgtggtggcatgtgcctgtaatcccagctactcgggaggctgaggcaggagaatcgcttcaacctgggaggcggaggttgcagtgagccgagatcgcgccactgcactccagcctgggcgacggagcaagacacggtctcaaaaaaaaaaaaaaagaaaaaaaagaaaaagaaatgaaatcagagagatctgcactcccatgtttattgcagcactattcacaatagctaagatttggaagcaacctaagtgtccatcaacagatgaatggataaagaaaacgcggtacatatacacaatagagtactacta

SEQ ID NO: 17689 - DNA, 45045 bp, Homo sapiens
  misc_feature (1)...(45045): n = A,T,C or G, or insertion/deletion polymorphism (see Tables 1-2)
gaaatatacacgtgtatacacacgcatacacatgggtgtactgagttgtgaagtaagatggacatttgtccatgaaatgcagtaaaaaacgtttgagaaatgctgaactaagagacttcatctgctgtttgggccacaggtaggaccccagaaagagcaagtggcaactttgtaactctattacaaagttggcaaattaatggtatttttgtgggatttttttttttgagacagtctcactctgttgcccacgctgggtgcagtaatgcaatcccagctcactacagcctcagcctcccaagctcaagccattctctcacctcagcctccagatgcccagctaattttttgtactattggtagagatggggtttcgccatgttgtccaggctggtctcgaactcctgcactcaggccatccatctgcctcggcctcccaaagtactgcggattacagacatgagccacggtgactggcattatatatttattattattattattgttattattattatttgagaaagggtcttgctctgttgcccaggctgggtgcagcaatgcaatcttggctcactacagcctcagcgtcccaagctcaagctgttctctcacctcagcctccagatgcccagctaattttttgtatttttggtagagatggggttttgccatgttgtccaggctggtctcaaatgcccgcactcaggccatccacctgcctcggcctcccaaagtactgggattacagacatgagccacagtgactggcattatatatttattcttattattcttattatttgacacagggtcttgctctgttgcccaggctggagtgcagtggtgcaatctcggctcactacagcctcagtgactggcattatatatttattattattattatttgagacagggtcttgctctgttgcccaggctgggtgcagtgatgtaatctcggctcactacagccacagtgactggcattatatatttattattattattattattattattattagttgagacagggtcttgctctgttgcccaggctgggtgcagtggtgcaatcacagttcattgtaaccctgaactcctgggctccagccatcctcccacttcagcccccagagtagctgggactacaggcagcaccaccacacctggcaatttttaagttttttttgtagagatagggggtctcactgtgttgcacaggctggtcttgaactcccggcctcaagcaatcgatcctcctgccttggcctcttgagtgctgggattagaggcatgagccaccgcactaggcctggcctttaaatataagttcttataaatatacattatgcttccccagctacattgtttgccttttcaggggtacagacttgcttcttacctctttacacgtccttttccagcacataacagtactcgataaataatgatggcattacctttctgtatccactattatcaatgaccaagtcactttttctggagtaggtgcattcaaaagccgttgaagggccgggcgcggtggctcacgcctgaaatcccagcactgtgggaggccgaggcaggcagaccacgaggtcaggagatcgagaccaccctggccaacatagtgaaaccgcatctccactaaaaatacaaaaattagctgggtgtggtggcaggcacctgtaatcccagctactcgggacgctgaggcaggagaatcgcttgaacctgggaggcggaggttgcagtgagccgagactgcgccattgcactccagcctgggtgacagagcgagaaaaaaaaattttccttttctttttttttttttaaagcttcgacccgtcaccaccacatttattcacttagactgggctctgcactagtaacaccttaaatttgtataaacatgtagtttaataagttttcttactttttatttcactggtaaatgaatgaaggcaataaagggatattatttccacatggcagacagggaaaatgaagtacagagccatgactgacgcccatgtttccgcagcacagtgggtgacagtcccactgggacaagttgctaatttctaggcgggggctttttattttatttttgaggcggactcactttgtcacccagactggagtgcagtggcccagcctcagcttactgcaacctccgcctcccaggttcaaacgattctcctgcctcagcctcctaagtagctgagattatgggcacacaaaaccacgcctggctaatttttgtatttttagtagagacagtgtcttgtcatgttggccaggctggtctcgaactcctgacctcaagtgatcctcctgcctctgcctcccaaagtgctgggattacaggcgtgagcctccatgccctgccagctggggctctttcactaggtaagtggcttatctggtttgcttttcctgccagttctctctcaccaaaaagcaagacttctgctttcatctcttggtgaagaaaaaagagagggaggcagaattttgccgttaatcatcctgcactgttgtttccagcagtaattcccctgaattagctgtcagacatctccttaggaattttaacacacaccacaggctccttctcactacagagccttcaggtggccggttctcctctgctgaaatgccttcatccttcctcttcatgagcccacatccatcccagtctgcagacatcttccacgtcacgttcctacctgaccccactccgccccacgaggactctgattcaaccatgctgaccaacagtgtatgatgtgccagtcattgcttttagggtcttctagaccctaaaagaggtatttttggaatgaggtatttttattcccattttattttttgagaaggagtcttgctgtgtctctcagcctggagtgcagtggcacaatctcagctcactgcaccctctgcctcccgggttcaagcgattctcctgcctcagcctactgagtagctgggattacaggtgcctgccaccacacccggctaattttcgtattttcagtagagatggggtttcaccacattggttaggctggtctcgaactcttgacctcaaatgatacgcccgcctcagcctcccaaagtgctgagattagacgtgtgagccaccgtgcccagcctttattcccattttagagctggtacaacccaggctcaggaaagttgagaactccagcttcttggccctccaggctttgtgctcttttcttttccccacagctcatggtatctttttccttgccaacctccttccctttatgaaacttctcgtatttctgtgtacgatgcagaagaactgcaagagttttagttccaggatgaggtaagcctcatggaatagtttgtggagggttggaaattaaataatttccaataataatttcgaataatttggccaggctcggtggctcacgcctgtaatcccagcactttgggaggccaaggcaggcagatcatgagggcaggagttcacgaccagcctggccaacatggagaaaccccgtctctattaaaaatacaaaaaattagccatgcgtggtggcacgtgcctgtaatcccagctactcgggaggctgaggcaggagaatcgcttgaacccaggtggaggttgcattgagccgagatggcgccactgcactccagcctgggtgacagagtaagactgtttaaaaataaataaataaatagtaaaagtgttaataagtggactttaattgcagtgtctattaatactaataacagcataaaaataaaaatataattgatagcctctttagtgtcacgtttatggttttattttagtgaatataaatttttgagatttgaattttcatgtccaaatggtcctggcctctaaatgtctcctaaacatatttttctttcttttcttttctttctttctttcttttttttttttttttttgagacagagtcttgctctgctgcccaggctgaagggcagtggtgtgatctcagctcactgcagccacccccctcccgggttcaaacgattctcctgcctcagcctctggagtagctgggactacaggtgtgcgccaccacgccagactaaattttgtatttttagttgtgatggggttttatcatgctggccaggctggtcttgaactcctgacctcagaagatccacctgcctcagtctcccaaagtgttgggattacagggattagccatcgcatctggccacctaaacctatgtcctccatgaggctataagattttcacctgcaaataccagcattgtttgtttctttttaaaagatacttcagtcaaggaaaggcagaaagccaggcatgttagctcatgcctataatcccagcactttgggagaccggaggcaggaggattgtttgagcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggccaacatgtataaaatcccgtcactcctcaaaatacaaaaattagcctggcatggtggcacacacctgtagtcccagctacttgggaggctgaggcaggagaatcgcttgaatccggaggcagaggttgcagtgagcccgagatcatgccactgtactccagccagggtgacagagcaagacactgtcttaaaagtaaaaataataaaaataaataaaattaataattaaagaaataaagaaggaacaccacaggggagcaggcctggtgtctgaatgttaaggtaggccctctgtggatgtgcatccttaaccttttcctgattagatcattaaaggtgcagcaatgctcctgctcatatgacttttttttttttttttgagatggaatcttgctctgtcgcccaggttggagtgcaatggcgcgatcttggctcactgcaacctccgcctcttgggttcaagcgattcttctgcctcagcctcctgagtagctgggattacaggcgcgtgccactatgcctggctaattttttttgaaatttttttagtagagatggggtttcaccatattggtcaggctggtctcgaactccagacctcgtgatccgctcacctcggcctcccaaagtgttaggattgcaggcgtgagccaccgcgcctggcaactcatatgacttttaaacacttctctttggggagagagattttagagaatgggagtaaagagaaaggcggtgagaatcccaagtactttctctatcttagagcagaagaaataaagggaagagtaaaagcccaaggcccagaaacggatttgcttcttaaagggctgttctgtgtccctacgggcctgaaggtcagtttatgtgcaatgctttttaaggtatgggttgctttcttgcattgtagctactacctccctggcctgctggttactgaccagagggagggagagggtgtgattgtttggaaagagtttaaacagtgacaagaattgaattttatttatttgttattcattgcacaatccaataacagcgatggcaatgaaaacgaaagttaatctacaatcctatcaccctattaagtcacttgtttctattttcccttttattccctcatgcattaaacattacgcaaagcactccgctagtcttggttaaagtgcagcttgtatacattctgaataaaaatttgcattttgcttttcttttcctttttgtatttctgaggctgcaaaatacatcttcacaagagtggctttaatagttacctaacattccatcctgcacgtacatttcaaggcactgccgcagtgcaatatccaacatttaagcgtcaacgccaacagattggacctagcactgcagggactggaggttggtcaaggtcaggcggaggctgccaggctaccagggtggaggaaggcgccgaggcagaggccagtgcgcccatcgcgcggctcctcggggcacctgctgccttggcgccttttcccttggccttcgyctcgcccgcagcgccctccgcakagggccccgcccgctgcgcgcgcatccccgcccccsgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggtacacggggtcggcggctgtgcgcagaggcgtccctgcgcctctcgtcccttcgcctctcgtcccttcccttctctctgccttcttgcccgcctcctcggtcacagagcgacgaatgacgagaccaggtgtacccccactgtcgctctcagccccggggacttcgggtcctcgcccttgaaggccgcaggccctagtgcgccggctccgggctgcgggtccgggagcgcgggcgcagccaaggtgcagctgcgcggcgtgcggcgccgggggaacacgtggctgctccaggaagtcgccccagggaacggctgggattcgtgggtgaccttgggctcctaaaccttcggttccccgggctccgggcgggccccgttctcactgcggaaagggacaaagctgtccccgattcggttactagcgtgttacaggcattaattagawacgggtttctgtaaacttacccttcggctctggtacaacctgatcttgccatgctctgcctgttcgccttgtgtrtggattctgttttctcaaggcagaatccgactgaacgccgcaggtgttcacattaagaatattgctagcagttctcactacaagacgggagccataggagtgacttatttgtgaaagatacttggagattagcggtgtggtcagagggctgtgctggattgatgggcgccggagaggccgattgtgtcacattctgctggacagttcttttaaggttgggagggtgggtaagaaaatacattctgattcggctcttttcggataacgctttccctctgcttactgcttgtagagacctcacttacccgggggactggattctgcagctttttccattttcttccccgttgataagaggattaaagtaggaaattgtatttggctaccccatgcttatatgctaagcttactgtgaaaattaaggttaggctgtctagagtacttgtggaccctgctggttccccccgccccccggccctgaattttgggttacaatatgcttctcaagaaaactcagagttaagataatttttgtcatcgattttgcaaggttatatrtagcatagcatccttcartttcctttggatgttcttatcaagtaatggtggctgtaaacctagcctgtgttgaagattgttagatagacagcagtttggctaactccgccctaaggcgaggcagttacttgcctctgataatgtatttaaatgtcatggagcaagattcccagctaaacctgaatcgatcacaatgctagttaaaaatgaccctcggctgggcgcattggctcccgcctgtaatcccagcactttgggaggccaaggcaggcggatcacctaaggtcaggagttcgagtccagtctgactaacatggtgaaatcctgtctctactaaaaacacaaaaattagccgggcatggtggctcacgtctgtaattccagcactttgggaggccgaggcaggtggatcacttgtggtgaggagttcgagactagcctggccaacatggtgaaaccccgtctctacgaaaaatacaaaaattagctgggcatggtggtgcacacctgtaatcccagccactcaggaggctgaggctcgagagtcgctttaacctgggaggcagaggttgtagtgagctgagatcgtgctactgcactccagcctgcgcgacagcgagatgccatctcaaaaacaacaacaaaaaaactccctactaaaccagaagagtgatggggacgggaaaagattcctggtccaatgttttcattatatttttcatatcatttggaatctcatgcatcaggcatgccccagtactgttaaagacaatatttttactcattatcaggtagttcaataccagttattacaggatagggaagtcagtcagagaaggcttcatagagatgaagccttgagctgagcctggaagaaatgaggaggacctcaaggaacagagaagaatgttggtgggtaaaaacaggggctggattctgtctgattttggagaaaatagagggtagtgaagttgttaggcagtgaatgtgttccatttcatggttcaaaacgtggggctacgttttgcctacctgagcttcattattaatgtgagaaattgaattgttgttttcagtcaccattgagaacaccaaagataacacaagtagcttagattattatttatttatttatttttgacagagtttcacgcttgttgcccaggctgtagtgcaatggtgtgatctcggctccctgcaacctccacctcccccaggttcaagtgattctcctscctcagcctccccagtagctgggattacaggcatgcgccaccatgcccggctaattttgtatttttttggtagagatgggatttctccatgtttggtcaggctagtctcaaactctcaacctcaggtgatctgctcgcctcggcctcccaaagtgttgctgggattacaggcgtgagccaccatgcccggccatcgctttgtgttcttaaaattaatttaaaacaagaaaacttgaggaatgatggttcagatgagtgttaaaacttgcaagatgttttttcctagaaaaggatgattaaaattggttcagggtggggccttccagttctggctctaatgattgggtccttactgttctggtggagtggtagtgataagctttttgtaacagaaggggcaaaagattgtgcttctggctgggcgcagtggctcacgccttcgatttccttgggatgttcttatcaagtaactaatcttagcactttgggaggccaggtgggtggatcaccctaggtcagaagttccagaccagcctggccaacgtggtaaaatcccgtctctactaaaaatacaaaaattagctgggcatggtggtgggcacctgtaatcccagctactcggagtctgaggtgggaaaatggcttgaacccgggagggggaggttgcagtgagccgagatcctgccattgcactccagcctaggcaacaagaccgaaactctgtctcaagaaaaaaaaaaagattatgcttctaagaatatggtctattgcatatggacactggtttttaaagcttgaatttaaaaagaattttttgtaataggttttagagctttttctttttcttttttattatttttttgagatggagtytcactcygtcacccaggctggagtgcagtggtgccatctcggctcactgcaacctccacctcccgggttcaagcgattctcctgcctcagcctccccagtagctgggattacaggtgcccaccaccacgcccatctaatttttgtatttttagtagagatggggtttcaccaccttggccaggctggtctcaaactcctgacctcgtgatccacctgcctcggcctcccaaagtgttgggattacaggcatgagccaccgtgcctggccagaaagctttttcttaatgccagttataataccctttgctttacaatttgcgtatacctcacagcttgctttgtgccgtgtgtgtttaatatgccctaagtgtactcgtatataggaaaagctttaaaatggtatccaataaatgtccattttgcaaatctcaggataatgtcattttcaagtatctagatgccctcaaaccaaattaactggaaaattcagatttcagttaaggcctttaacttaacttaggactttgattacagagatgtattttgctttgacaaaagttaaggttaatgtcttaaatttccagagatgataacacartttctataacccagtaacccatttaacttcgcttagattatcaattttcagccttgaacaggccacttagtttctctaataactggcctcttcatctgtaaaacagcgtaatctgtgtttcatgtttcttcttgtgtcaaagatcgaatcacttgtaggaactattcattcagtcaggatcagtatttcttccccttcccattggagatggtttgtggtatttgtagcataactggtcttgtctgccttagtcttaattttgtctttttgtatgtgtcactttcttttttttttgagacagagttttgctcttgttttccaggctggagtgcagtggcgcgatcttggctcactgcaagctccacctcctgggttcacgccattctcctgcctcaggctcccgagtggctgggattacaggcgcccaccaccacgtccggctaatttttgtatttttagtagagacagggtttctccatgttggccaggctggtcttgaactcctgacctcaggtgatccacccatctcagcctcccaaagtgctaggattacaggtgtgagccaccccgcccrgcagtatgtgtcacttttgtctactcagaacatagtggttcgtacytataattgcagcactttgggaggccaaggtgggaggattgtttgaggccaggagttcaagaccagcctgggcaacatagggtgaccttgtctctacaaaaagaaaaaaaaagaattatgtatataacaaactttaaaaaggatcccacttaatttagttgtcatgtaaactatggttaaataccttttctagaaaagtgataatgtattttaaaaatttaatgtatcatttagcctggtaatagaaagctcactaatctgatacagtagtatctttctcaataattctctattctgatacctaggttcttctgtgtggcagttcagaatgatggatcaagctagatcagcattctctaacttggtaagatattttcagttgtatttctgtgtctgcaagaatgtgaaatatacaagcatgactttaactgagtaagcatgaaataataaccccaatctattatcaggtattcatttacatttgaattggtagtcttgaggcataactgatctcacaaagagttcagccttcagtagggttaattatggaaagtcttggaagaattctcagagtggttctgggtgtggtagacggggacagcttagtagataagacgaattaaagccctgatcaaaatgttttagtaggagaagtaaaaagcaaaggcttgcggggcgctgtggctcacgcctgtaatcccagcactttgggaggctgaggtgggtggatcacctgtggtcaggagttcaagaccagcctgaccaacatggtgaaactcggtctctactaaaaatacaaaaaaaaaaaaattagctgagtgtcatggcgcatgcctgtagtcccagctacttgggaggctgaggcaggagaattgcttgaacccgggaggcggaggttgcaatgagctgagatcacgccattgcactccagcctgggcaacagagtgagactccgtctcaaaaaaaaaaaaagcaaaggctgaatgaggccaagtgtggtggctcactcccgcaatcccagcagtttgggaggtgaggcaggaggatcacttgaggagtttgagacttgcctgggcaacatagcaagcccatctctattaaaaaaaaatgaaattttaagaaacattgagtagacagtatgagtgaaagctgaaagaacatacaaaaaaaacagccatccaggccatgacgagaaggagcctaactcttaacactctgtctagacctcaattctctcttatttgtatttatttatttatttatttttattttattttttgagatggagtctcagcctgggctctgttgcccaggttggaatgcagtgtgcaatcttagctcactgtaacctccgcctcctgagttcaagcgattctcctgcctcagcctcctgggtggctgagattacaggcgtgcgacaccatgcccagctagtggtttttttttttttgaatttttagtgagaggggatttcaccatgttggtcaggcttgtctcaaacttctgaccataaatgatctgtgtgcctcggcccccccccagagtgctgggattacaggcatgagccactgtgtctggtctattctctcttttctgtcttctatcttatgcttagtcagaatttctgcttatttataactttgttttattcttgctcccttgctcccaccaacatcatggtctgggttactgcatagtatcctgaactgatttgtgcccctagtcccagctactcaggaggctgaggtgggggaatcagtagagcccaggattttgaggctgcagtgagctgtgatcacaccactgtactccatcctgggagagagagggagaccttgtctcaaaaaaaaaaaaaaatttacaaaaagggagagactgactgagaagaccagtgtgaactagcccttgactgggcccagggaagaatgytggtttgaaaggagaacaccctaaggaatatatagcaagttatagtaatggcccaataacaagcatatrcctaaacgagcttttcctaaacattcccgtgcctgttcttcatcatgcctttttccgcaacacagtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggtgagaatgaccattccaaacttcaatgttttctataaccaactctgggaagtctgttatgtcagctcagcatatagttattttgtaccttttttttttttttttttttttggagacagaggcttactctcttgcctaggctagagtgcagtggcaccatgttggctcactgcaacctcagcctcccaggtttaagcgattctctgccttagcctcctgagtagctgggactataggcgcccacgaccacacctggctaatttttttttttttttttttgagttggagtctcactctgtggctcaggctggagtgcagtggcgtgatttcggctcactgcaatctccgcctcccaggttcaagcgattcttctgcctcagcctcctgaggagctgggactacaggcgtgcaccaccacacctggctaatttttgtatttttagtagagacggggtttcaccatgttggtcaggctggtctctaactcctgacctcgtgatctgccygcctcagcctcccagagtgctgggattacaggcatgagccactttcccgtccactttatgcctttttaagtgccactaggaagacaatcatgagtagattctatacctgtcattgaatttaatctggttggaaagagagacccatgaattatttcaatacgacgtgcaagtgttttctttttatttatgtatttttttgtttgctcccactccaccaggaagcaaatgctacgctagaaaatatccgcaggacactggcggtgcagcagctcagtctcatgtttcaagggggtcttttggaaaaaactacctatgttttgaataggtagctatttgaaataaagctagtatataatttattaagtggtttaaagtatacaaaactgagatgcattatatactttaaaactacttagaatttgatgaaaaccagtattttcaaggcttacctgaaaatattaacagattaacagggatagattacaaatgaaattctgwgttcagctctggaactttgtctctttaggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccngcaccatcaagtgagtgccagctgctgtgcaagtatctagacaagtaattcaagaattatgataggccacggggaaacaataatggtgacactgtggggaatggcttgttagagaagacaagacttgtcatgtttagctaaagaggggaaggggcctgtaaaaaactgaaactatactggtaggggaaaaggtagaacttctctgggkagtctcctttttcttaaaaaattaataggcccttgatgttttccccatctttgtarcttattgcttgctgtcattctctggctctgatttttcttcttaacctcttgtaacgttgtactaagctctgctttgctgacaaggacatcagtagcttttctctgttttaggaagcaacacatgccagaagtagcctttttcatctccttgatcatgggtaactgcctgccttaagtctctagtgcttcttaatttctgtgatactcacccattaacccctaggccagtcagtatccagagacaatgtctccctctggtggaggctggaatacggtggcrtgctctcatctcaccgcagcttcatccccctaccatagcctcctgagtagctgggactataagcacgcagcaccacacccagctaatttttttttttttttttttaagagatggagtctcaccatgtctcccaggccggtctgttcttagatttttatttatttacttatttattttgagatggagtcttacgtgttgcccaggctggagtgcagtggcacgatttcagctcagtgcaacctctgtctcccaggtttaagcaattctcctacctcagtctcctgagtagctgagatcacaggcttgtaccaccatgctctgctaatttttgtgggttttttttttgtttgtttgttttttttttttgcagaaacgggatttcaccatgttggccaggctggtgtctaactcctgacctcagatgatcctcctgtcttggctcccaaagtgctggaattacaggatgaggcactgcacctggccaaatttctattttatatttatttatttattttatttgtaatgggctttctggcaaaaactagaaagcatgctagacaaattctaaaagagctgtaacacttktccatagagttttactatctttgcacatacatgcctctgtgcaaagaataaatttatcttttcctttttgcaagcttcctacacttacagtggtactataattctttagtcttaagttatggcattttctacttcatctagttgatgcttttgtgtttatttactgtacaccagaccttatggttaaagtgagagtatagtccaccccacaaaaatgtaagaactaatatgctgagtaaatagaaagaagtatgggagatcggaccaaggagcagttctgcttcagggtattcagatgcttcacaagtaggtgagaattgaaactatgcactctgttcagcacagtattactatcttagattttatagtagatctggaagctactcatttcccctaaaactatcctaagcagatacattgtgttatgatgaggctcttgaaggagtgctttgtagtgggtaaagaagctttgaagttacaagatttggggcaaaattttttttcttttgtgatattctggtcagtctagaagttttgggtcacagttcatttatctgaactatgagggataatattttgctttcaaaacaatttgtttaatccttgacttaaatgtttattttaaagtaaacttaagttcatttaaaaggcattttctcctccaggctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacaggtatgttgaaagatggtaaacttatttttatacaagtagctattttcaggtgtgctaaatatagcaaagactttttgttagtgttgttggcttttttttgaaatggagtctcgctctgttgcccaggctggagtgcagtggcacaatctctgctcactgcagcctttgccttctgggttcaagtgattctcctgccttagcctccagagcagctgggattacaggcgcacgccaccacgcccagctaatttttgtatttttagtagaggtgggrtggtctcgaacttttgacctcaggtgatcagcccgcctgggcctcccaaagtgctgggattacaggcgtgagccaccrcatgcggcccaaaggcttttaaaataaaaatcaagcttaagatttagaggtaaatttcctcaagccaaataatgcaagacatactaaatgtaagctattgtgttttttggaaggatgaccttaggcttattttaacttaatctttttaacagcgctcaaaactcggtgatcatagttgataagaacggtagacttgtttacctggtggagaatcctgggggttatgtggcgtatagtaaggctgcaacagttactgtaagtaargcaaaacagtgcatgagactcttccctattgaatcattcaaaactcatcttttctgttcttaggagttataaatttacctgtaaaatgtaaatgatcatgagatattttggttttcaaccctctaatgacacagtcaacatgcattgtcttctctctctamtcactttccccatgtcctgttttattttttctttatagtactgctagcagctgacattatctatgcctttgtttccattagaatgtgagccagatgaagaatcatgggttagttctatttactgccatgttgcagagctttggagaatgsctgacatacatagtagtatttgctaaacaaatgcatatcctccctgtggggacagatgtaaatatccatcttggctggggcctagtcttagcttgattcgttaatgcttgatctttttctatttttgttttgagacagggtgtcactctgttgccctagctggagtgcagtggcgtgagcttggctcactgcattctccaccaccacccaggctcaagtgagcctcttgagtagctgagatgtccagttaatttttattttttattttattattattattattattattattattattatttggtagagacagggttttgccatgttggccaggctggtcttcaattgaaactcctgggctcaggtgattcaccaccctcagcctcccaaagtgctgggattacaggaggaagctgcttcgcccagcccttgatctttttaaatttaggcaaatatagtcaaattaacacagaaatagagaacagatagatagaataattttcagcttaaaaatcacatttgtggctgggcgtggtggctcacgcctgtaatcccagcactttgggagtccaaggtgggtggatcacctaaggtcagagctaccagcctggccaacatggtgaactctattaaaaatacaaaaattagccaggcgtggtggtgggtgcctgtaatcccagctacttgggaggctggggcaggagaatcgcttgaagccaggaggtggaggttgcagtgagcggatattgcgccattgcactccagcctgagcaacaaaagcgaaattccatctcaaaaaaaaaaaaaaatcacatttgtaagtcaggcgtatctctagtggatacctttcggggctggtgcagttctgtgttgattccttgcctttctggatacttgtgctttatccctttgcctggctgcctataagccaggagtttagagatgggtaggttgttctgttaaagaacattgaagatttttgttcaacttcaagctttctgtattgagggcttggttgttagtgtcagtttatggctrttcatctggactcttatgagcttaggaacatcatgacacatctaaagttggtgtatgcaagtcacwttgttgtaatagatggtgttttaattttgggacagatttattatcagacctttcagttaaaacctatttctatgatgtcctcaaggctaagattgttccaggcctccagtcccatgaccagcctacataggcctctttaatctaaatgcccttcagatgaaaggcagcatgggataaaagcatgaaagacataggaggccaaaaatcttgattttattccaatagctctgacctaaaagttgtaaagttttttagaactcatgtcttwtttaggccttggcctccttttatctcttacttgggttgcctgtcttaggtttgatctataacactcttctgtctcaagattttagagctgttccgataccataatgctcattaaatctaatgtctttgttctagggtaaactggtccatgctaattttggtactaaaaaagattttgaggatttatacactcctgtgaatggatctatagtgattgtcagagcagggaaaatcacctttgcagaaaaggtgagtatgagttattataatattaaatacagtacttttggtatcttactcttcaggtaagtgatatttcttgttaatattcttacattctgaaaatcagcaatcttaaactctcataccagataatataatttattaaaatgctcaacaaatgaagtaagttccacttacctaatcagaagtgcttaagtgaaagctatttctctgtataactcagttttacgcatatacagaattcagctaaaagcatgttttataaaarggaaaattaatagccaaacatacacaaggaactagagtggaacatatcaaaagacagtggtgatttctgcatttttaaaaaaagtggcagggctcacacctgtaatcccaacactttaggaggctgaggtgggaggactgcttgagccctggaggttgtgagatgtgactcgtgccactccagcctgagtgacagtgagactcaaaaaagtggttgtcttagatgggtttttgktatttttcttttcttttttttttttttttttgagacggagtctcttgtcaccctggctggagtgcagtggcgtgatctcagctcactgcaacctccgcctcccaggttcaagtgatgctcctgcctcagccttctgagtagctgggattacaggtgcccaccaccaccatgcctggctaatttttgcatttttagtagagacagggtttcacgacgttggcctggctggtcttgaactcctgacgtcaggtgatccacctgccttggcctcccagattgctgggattacaggtgtgagccaccactcctggcctttgttattcttttttttttttttttttttttttgagagggagttttgctcttttgtccaggctggagtgcagtggcgcaattttggctcactgcaacctctgccttatggtttcaagcgattctcctgcctcagcttcccaaatagctgggaatacaggcgccagccactgcgcccagttaatttttgtatttttagtagagacagggtttcaccatgttggccaggctggtctcgaactcctgagcttgtgatccccctgcctcagccttgcaaggtgttgggattacaggcgtgagccaccactcctggcccgttactcttattttgcaaacaagtgagttaatttttcaggaagcaattaataaattaccagataaacaatttgaaatatttggaagtattataagtttagtcctctgtaaccatttggcctttagcataatgtccaggatgtattctcatttcgtatgatcagatcttcattttctgagctttatatgttttcttttaggttgcaaaygctgaaagcttaaatgcaattggtgtgttgatatacatggaccagactaaatttcccattgttaacgcagaactttcattmtttggacatgtgagttatttcttgagtaaatcaccgttttgagttccttgagttgttcttggattcctgtattagcagaaatagcactgtgtcttccttaactgctcttttttctgggagggcgttagcagtaagcaagaagatagattacattgactttgaggctttattatttgttgctaaaagtactttgtcaatagtgccttgaatttgagaatttccatatgccatgaaaacaggagtcacattgtagagccactcagatttttgaggcttcaagttggtaaactaaggttgggctgcagccttataccaaacctgaatcttacagagaagttttgaggaagtatgtgatggagtgaattgctcttttgttttcctaggctcatctggggacaggtgacccttacacacctggattcccttccttcaatcacactcagtttccaccatctcggtcatcaggattgcctaatatacctgtccagacaatctccagagctgctgcagaaaagctgtttgggtaagtttttatttgaaagcggtcttgcatagtgaggttttatgattagggaagaacggtaatatgttgattaaaatgttaaacatgatgataattttccacatttgggaatttggaggatggttagctgttaccttggtacagatataaatgaatttttctctataaagagatcttaataatggactttggacttataaacacaggagaataaggagacttataaacccagtgaattccttgtgcaagattcctggcatagcttctgctcaagtacttctgtgctgaagcacgatgcctatagcagcccattcagttagtagagagaatctgttagaattcatattggrataaaatcctattccccgaaacatccatttgtctggatttttcttctaagcaatacggtrtgattccagttaccttgtctatagattgagaagccttgcttcttaygatggtttccagagaaaccatttatggttgtggctcgctcctctggatatcctccctgtaacgttagtgtctctctttaaaaacagagcccagttccattagagtacgtagcattaattttgatttggatgtggacatatttatcatttcctgttattacaggatggagatctagtttcaggcctttatgaaagcatttatctcctgtatgacataggttytctgatcctgtttctttaacataattggatagtgaaaatatattctacttgatagtctcaaatgaagaacatctgtatataaggagtatatgaaataccatgactgttgatcatgctgagaggcctttagcataggggagtgtgtaacataccatgactattgataacgctaagaggcatttagcataggtgatttttttgactcattctacctaccacctacaaatcgtaaccaacctgtgaagccagcgtcccatcttatccttatgtagtaggggagtaataatgtttcaacctatatttatgtaagtaagccsccttaggagcagctattatttgggtaacacagaggaattagataggggaagcacargattttttttttattttgacagtctcactctgttgcccaggcaggagtgcagtggcatgatcctggctcactgcaacctccacctcctgggttcaaggaattctgcctcggcyttccaaagtgctgggattacaggcgtgagccaccgcacccagctgaggaatattttttataactgagctaagaatgtgtactatccttgttagtggtgacagttgggaaacataaaagtgtattaatattcttttatatattagaagaacttcattttgagtccatcttggtatgtattccaaatataaactacgtaagtatgtctggcagaaaggsatagttagagaagtgttttaaaatattgcttaattaatggtttccaattggctgcctgcagatcaaagtaagacgcaaatggttcaccactagagagtaagkttttttttgtttttattttgttttgttttgttttktttttttttgagacaggacttgtgctctgttgcccaggctggagtgcagtggcgtgatctcggctcactgcagcctccgcctcccaggttcaagcgattctcctcctcatcctccttagtagctgggattacaggcgcatgccaccatgcccagttaatttttgtatttttagtagagtcggggtttcaccatgtcggtcaggctggtcttgaactcctgaccttgtgatccacctgcctcagcctcccaaagtgctgggattacaggggtgagccacttcgccgggctgagagtaagttttgtttatatgtcctcttaatctgtaacttcactggacaggagtaaaccctgggcaaggaacaataactcagaacttacgcctgctttctgattctaggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccaggtaaagaccgcccccccccccccgccccgctttttttttgttttcttttctgttcctaaggatgtggctagagaaggagcgagtgtaggaatgctggcttggcttggttttatgaagtgctcaatcttgtctgtcctaaagttaattgtttatgtgttagtttcttttttttttttttgagaaagagtttcactcttgttgcccaggctggagtgcagtggtgtgatctcggctcactgcaatttccgcctcccaggttcaagccattctcctgcctcagcctccccagtagctgggattacaggcatgcgccaccacgcctggctaattttgtatttttagtagagacagggtttctccatgttggtcaggctccatgaggtcagagctcctgacctcaggtgatctgcctccctcagcctcccaaagtgctgggattacaggcrtgagccaccgcgcccagcctatgtgtcagttttattgggaggtaataaggccctaggaaattcttgttaaaaattgaccattatgactagaaaatctattctaagttattgactagaccagtgataagcaaatttcttaagggggcagataataaaccttttgccaggctatacagtctctcttttagctgttcaactctgtgggagcaagaaaacaggcacagactgtgcgtagtgaatgggcatgcrggctgtagtttgccagtccctggagttaactttaaatgcaatcaaacagccaacacttactaagaaataagtccttggacttaagtagtcagtaaatttaattagtagtgyaggaaaaaagtagctctactagtaaggtaaaattaatattctcatgtgaatttttaattcccagagtttttagtcagatttgaagtaaggctcttttatccttaatacatatactgtgcttttacctttctactgatgtgctaattctagaaaagtttagaagctgattatataagttctttcttcctcttttttcttttttaaagatcactatgttgtagttggggcccagagagatgcatggggccctggagctgcaaaatccggtgtaggcacagctctcctattgaaacttgcccagatgttctcagatatggtcttaaaaggtagagtacaaattttgattcttttgaatattggtgcactgcatacagttctagatgttatactgtgctttgctcactttgcctgcattcctgtggttctcatgctagactctagttcttaaatacaaggcagattgtcttttgttgtagctgccttttcctttgaaacagctttccataaagtgtcttaactgtgctagaaatcaccagtttctttgagacagtggagttactgagccctagtgcttagtgtggtggatccagagtgataaggtggatcatagtccctaagcaatctatttgaaagcagtagcatacctctctactcatgtactgaggcctaacagctattgaaattttgttctgttkattcatttattcattttttgagacagagtttcactctgttgcccaggctggagtgcagtggtgtgatctcactyagctcactgcaacctctgcctcccgacttcaagcaattctcctgcctcagcctcctgagtagctgggattacaggcacccacaaccacacccggccaatttttgtatttttactagagacagggtttcgccatgttggccaggctagtctcctgacctcaagtgattcacccgcctcagcctcccaaaatgctgctagtgagccaccgtgccctgcctcttttgtttatttttgagcctttctgtcctactttccactctttcacactcctacccacccacacattcaaaatcacgtcacattcttgaatctttgggtcttagggcaaactgcaatgcttaactttaatacagagtacattaatggagaaaaagatacagtgagggaagtgggagggatggagggcagtgtgatacatgtaacctcaaaaggtgctgtcacaaatrtagtttctctgcaaactcttcttgtaacttaaatttgtgaatttttattttattttagaattatttttttaaaaatccaatgtttggatttacctctgaagatttttctcaagatgtgcatcatcatgcttacactgttttcaatgatctctgggtccagaagttaaggaactccaagaatgaaattgtgaaagggtgactactggcccctgctatgtactcaaaatcttatttgcagatctcctatcttgctctttgtaggttacttwaaaaaaaattattcctattcttttattcttttacctggggtctcaaaaaaagattttgttagttttttttttcttttttggctcagaaaaaaaagattttggaatcygctatcttggaattagaccttctgattcatcttaagtgggataccttccatccttgtctgtgtataacctttcctcaggtaaagctaacttttttctctttcagatgggtttcagcccagcagaagcattatctttgccagttggagtgctggagactttggatcggttggtgccactgaatggctagaggtattctttatcatcchttcccatattggacacragcttgtgggcttaggctgttgtccagaagtgatgtttttataggtttgattttaccacttttgcctttgcgtttagtctcagtagagtccagaattgmaaatgaatccctaatgctactgtatgtgataaataaacagatttatacttattagtgttttcccttctcttctagggatacctttcgtccctgcatttaaaggctttcacttatattaatctggataaagcggttcttggtaagtatccctttcattagctgtktatgaattcaggtraacttttttgagatggagttttgctcttgtcgcccagrctggagtgcaatggcacgatctcggctcactgcaacctctgtctcccagattcaagcgattctcctgccttagcctcctgagtagctgggattacaggtgctcactaccacacccagctaattttttgtatttttagtagagacagggcttcactatgttggccaggatggtctcgaactcctgacctcaggcgatctgcctgcctcggcctgggattacagatgtgggccactgtgcctggccagataaactactttgaagtggaagaaagcttttttttttttttgagacagrgtctcactgtattgcccaggctagagtgcagtggccaatcttggctcactgcagccttgacctcctgggctcaggtgatcctcccacttcagccacctggctaattttttttgtagagatggggttttgccatgttgcccaggctggtgtcaaactcctgagttcaagcattctatgtcagctgcccaaaatgctgcggttacaggcatgagccattgccctcagcctgtatcttaaccttcctttaaatagtctgtcaagttacacagtgagcacaattgcttgtctagaacagtgggtagttctcagtgtggcccccagatgagtagcattaggaactgttacgaatgcaaactgtcatgtctaccccagacctttgagtcagaaatgggagtgttggtctaaaaactgggctttttgggctgggcgcagtggtgcacgcctgtaatcccagcacttgggaggccaaggcaggcggatcacctgaggtcaggagttcgagaccagcctggccaacatggtgamaccccgtctctactaaaaataccaaaattagccgggtgtggtgrcgagtacctgtaatcccagctactcaggaggctgaggtaggagaatcacttgaacccgggaggcagaggttgcagtgagccaagatggcgccattgccctccagcctgggcgacagagcgagactccatctcaaaaaaacaaacaaaaaaactgggctttttttttggcaacccttggggaataaaaacctattattttcttaaggacaaagtatcctgaagcaaaaaaacccaaacaaagaaacaaaaaactttaacaagcaytacaggtaattctgatggactaaagttttaggaccataagtctggactatattgaggtgagaagaaactaaactatgccatatagaatggtacttagagrgtaattcacatcctgttacgttgtggcatcactgatagaaatattggataatgaaacttctagaagagtttgaatgttcactggcagcagaaaattgacaraagggtttgaatgttatttaaagtgcagctgtacattcaacaggaatggggyaaaaaagaaagtgcagatgtagctgatgagctgagaatagtgaaatgtctacatgggggaaaaaaggaaagagttacaattaaacctctctaggttagttatttccctgttgtatgtttgccgcagaatgtgctgagtatagcaagcatactatgtatagctctaacctgggtgaaccagaaagttaaacatgaaattgctaatgggggaggctgcacatgtgtgggggcagtggatttatgggacctctaggtacctttctcttaattttgctgctgaacctaaaactggtctgawttttttttttttttttttttttttttttgagatggagtctcgctttgtcacccaggctggagtgcagtggcgccatcccagctcactgcaagctccgcctcccgggttcatgccattctcctgcctcagcckcccgagtagctgggactacaggtgcccgccaccacacccggctaattttttgtatttttagtagagacggggtttcactgtgccagccaagatggtctcgatctcctgaccttgtgatccacccgtctgggcctcccaaagtcctgggattacaggcgtgagccaccgtgcccggcctaactgctctgatatttttaaaaaaggtgacttggattaaagtatgcaaactcaaggagtagtacgagcccacttgagtsargttagcttagttgctaaagagcttgataccaaaattacttttgtttacttgatgaatgggatagttgttgcacagggccactgatctagattactgtcttatttgtcaagtacttatagttgtagaagtagcagtgtgaaaattatcggaatggagaaggggcaatgataaaacaatttattttcaggtaccagcaacttcaaggtttctgccagcccactgttgtatacgcttattgagaaaacaatgcaaaatgtgagtatatacctcattacaaaaatgtatgacttaatttttgttgaatcaacctgagataaaaaacactgatatgtaaaccgtagtcagtaacaaaaaataggaattgagaataaattttatagcagcrttatttaagggatacttgcctattgaaccatatgagatgagggctccaatcttaaagaatatgttgtttatttaggaatatataacaaaatgccatgaggcctaagctgtagtgcaggggcccacaggggattgtctatagagtcacaatgctaaggaaggcttaaatcaacttgaactatactttgagaaggccggaggaaatattcattgaataaacaattaccatagttttgaatgagggagagcatgtgaaagaaaatatttgcctatgtggggtggggggaggggagagggatagcattgggagatatacctaacgctagatgacgagttagtgggtgcagtgcaccagcatggcacatgtatacatatgtaactaacctgcacaatgtgcacatgtaccctaaaatttaaagtataattaaaaaawaaataaataaataaataaaaaagaaaatatttgcctaatgggattagaggctgtatattggagtgagtaaagttagaaacaggtcagatagcagacattggccttgatccaagagatactagggattataggatctcaagcaaggtgatcatgaatttgccagttaggttggtggcataagatgcactagaaggaagaaaccagaaacaagataggcatagtgtgaagcccagagagggcttttacaattgtgggtaagccaccatggttttgtttgtttgtttgtttgtttttgagatggagtcttcctctgtcttcctccagcactcaggctggagtgcaatggtgcgatcttggctcactgcagcctccacctcctgggttcaagcgattctcctgcctcagcctcctgaggagctgggactacaggtgcacaccaccacacctggctaatttttgtatttttagtagagacggggtttcaccatgttggccaggatggtctcaatcccttgacctcatgatctcttgaccttggcctcccaaaatgctgggattacaggtgtgagccaccgcgcccagcttttattcatttttttttccttttttttttttaagagataaagtcttgctgtgttgcccaggctagtctcaaacttctgggctcaagtgatcctcccagctcggcctcccaaagtgttgggattgcagttgtgaactaccccacccggcctaggcccacttttaaaatgttaattaagaagaaaacattttttcctcaccataactaaaggaactgacaacatgagcctagttagtaataacttaaagttgagattgttttaactatcataaataatttcttttcaagaagatataatacaagttttttatttaaaaattgttatagagtaacatgttagtgactagcctgaataaataagttccaaaaggttagttttaatgataatttcttatcttacaggtgaagcatccggttactgggcaatttctatatcaggacagcaactgggccagcaaagtgtaagttgagaaaagtgaatgaacaaactaatagaaaagcagagattctacctactacattasgtagaatctaaatctgtccttgcattgaacttacttacacctaaagatattcarctaaagaatttattttggatggggggactagcacgatagaacagtctattctttraaacactttctaaagacacattctttgtctttgcagtgagaaactcactttagacaatgctgctttccctttccttgcatattctggaatcccagcagtttctttctgtttttgcgaggtaagtctgttcatttaaatgacaaatggagagaggctctctaaaaggaagtgatctgtatttgggaatagggcattgcaatgggaatgcctgtgctatagtcaactatgtacatattcagaggagtaaaggaaaacaagtttttaaggacaaatgaygaggattacaaaattactttgaggtaattattcttggctaccaagatcaataacaaggatgacaccagtccaaggttgacaggcagttgctaggcagattttctcacgagagaagttttttggtgcaaggttgcagtggcctttgtgtaaggttgtagtttttgtaaaaaggaaaaaaaaaaacccttaatccttgttatcagacatacaagggtgagacccttctcttcagggttgcatttttgttaacactagtgactccattttgattttgacaacttgcacatatcttagttgttgggttttttttgtttgttttttgttttgtttttttttttttttttgacaatggtgacttgctctgtcacccaggctggggtgcagtggcccgatcatggctcactgcagcctcaagcagtcctcccccttcagcctccaaactgtttggattataggcaagagctacttactacacctggccatggatcttcttgtgtcaactttgagaccaaatttactgcagtgcttaaaatgttttaagaagttatayacatgtgctggatgtggtagctcacgcctgtaatcctgtagcaggrcaagccgcagacaaatcccctcagacaccgagttaaagaaggaagggctttatttggctgggagctttggcaagactcacgtctccaaaaactgagctccccgagtgagcaattcctgacctttttaagggcttacaactaagggagtctgcgtgagagggtcgtgatcaattgggcaagcagggggtacgtgactgggggttgcatgcaccggtaattagaacagaacagaacaggacgggattttcacagtgcttttctatacaatgtctggaatctatagataacataactggttaggtcagggctcgatctttaaccaggaccagggtgcggcagcgctgggctgtccacctctgccttttagtttttacttcttctttctttggaggcagaaattgggcataagacaatatgaggggtggtctcctcccttaatcccagcactttgggaggccaaggaaggcggattacgaagtcaggagtttgagactagcctgaccaaaatggtgaaaccccgtctctgctaaaaatacaaaaattagtcggacatagtggcgtgtgcctgtaaccccagctactcaggaggctgaggcaggagaatcgcttgaacctgggaggcagaggttgcagtgagctgagatggagccactgcactgcagcttgggtgacagagcaagaccctgtctcaaaaaaaaaagttatacacatgtaattattgcatgttccttcattattagttttaacatagacttgttaatctcaattagcttaattagcatttgagtttattgctaaaacttctttatgagttttaataatgaggcttggccgagtgtggtgggtcatacctgtaatcccagcatttgggaggccaaggcgggtagatcacttgaggtcaggagttcaagaccagcctggccaacatggttaaaccccatctctactaaaaatacaaaaaaattagctgggcatggtggcacatgcctataatcccagctgctcaggaggctgaggtggaagaatcgcttgaacccagggggcagaggttgcagtgagccgagatcgtgccattgcactctagcctgggcaacagagcaagatcgtctaacaacaacaamaaaaaaaccaaggctgaatttcttgagtgattgagcagtggctatctattggacagtccagctgaacagtattttcctcaggctgggtgcagtaactcacacctataattccggcacattgggtggctgaggtgggcagatcacttgaggccaggagtgagaccagcctgggtaacgtgcctagactatatctctacaaaaaattttttaaattaagtggcccagkggccagctgtagtcccaactccttgggaggctgaggcaggggggtcacttgagctaggagcttaaggctgtggggagccatgattgcatcaccacgctccagcctgggtgacagagtgacctcgtctcaaggctgcagggagycatgattgcatcrctgcactcyagcctgggtgacagagagaggcctcgtctcaaggctgcggggagctgtgattgcatcactgcactctagcctgggtgacagagtgacctcgtctcaaggctagagggagccatgattgcatcactgcactccagcctgggtgacagagagagacctcgtctcaaggctgcagggagtcatgattgcatcgctgcactctagcctgggtgacagagaccttgtctcaaggctgcggggagtcatgattgcattgctgcactctagcctgggtgacagagagaccttgtctcaaggctgtggggagtcgtgattgcatcactgcactctagcctgggtgacagagagacctcgtctcaaggtatgtttcatgtatcttctcttttttcattgataaaggcccaaacttcccagagagaaaaacatacagccttaaggaatttggctagaagtctattcagggcatatgatacgatagaacagggattctgtagaacctggaagaaagtagtcactctaggagtaggttagcttgagagaagtagcaagaatgtacttaaagcagcagataatgagatagaattggggtaaattgcggtaggaatatgttagaagcaagggtggaactgtcgtcactgttacctcgatggcgaagccagaatgtgaggctcttgctcttagaactcacgtgagtaccatagcctcgcrttgtctyrcaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggtgagcactgattccaattacgtttttattttgctgaatgtcaagtattttgaaatgtgatgtgttcctgtgtgttcctgttggaagggtgattgtagccatagtacattttaaagtgaactgaggtataattgtatgtagaattggtaacttgtttgagagaagtcgggaggctgtggattagagacctaggacagagctcagcaggtgtttcagaatccagagcagtgtcaggttttctgtcactcatgtctcccaggcagcccgtcagtaggacacggaatatgaagatctcagcaaggagttgggctgtgtgcctctcgggcgtgacccggatggaaagacagcacagctagcaggattccatctcgtagtgatctgcgcatctaaaagtcaaatattctattaaacgaaactgataagcagggtgaggtggtgcataccygtagccccagctacttctgctgaggcaggaggattgctggagtccagcccaggcaacatagcaaaatcccatctctaaataaattaataaaactaatattaaagtagcttccagattgttttatggtactaggagttgatttttaacagatctcttaattgaagtaaatcactgacaaccgaatctttttatatcttttttatttttatttttattttattttttttgagagatgaagtctcgctcttgtcccccaggctggaatgcaatgacatgatctcggctcactgcaacctccacctcccggctttaagcgattctcctgcctcggctccccaggtagctgggattacaggcgtgtgccaccatgcccagatagtttttgtgtttttagtagaagccggggttttaccatgttggccaggctgaagtgcagtggcgagatctcggctcactgtaagatgcgcctcccgggttcacgccattctcctgcctaagcctcccgagtagctgggactacaggtgccggccaccacgcccggctaattttttgtatttttagtagagccggggttttaccatgttggccaggctggtcttgaactcctgacctcaggtgatccacccacctcggcctcccaaagtgctgrgatcacaggcatgagccaccacgcccggcatcttatgtctttcttgaaactaattgtaactgttgaaaatggaacttaccaggtggaaataactaaatcctgaagtaccttgaaccaaaatgttttcccctatagggacattttccyccaaaaggagaattgaactggaaacaatatagtacataggattatataattatgttcaatttcttaatgagaatggttttcttacatgctgggctcaaatatgagtgtatatcacagtccatagagcttggaacccctgtgcaaggtgctttcggagtcttgagcttatctgcgagttccttttatcagaatcttacttaacgcacgttaaattagaaaggcatacaaaagaatgtccttagaaataaaacttctcatagcgaataatgtctgtttcaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtaagtgaacttttgggaaaggaggaactaaagtatgtgtaaaataaccgataaatcttacacttctgcaaagtggacaaactctaggagtctagaattcctttaagaagggagcattaatggtttagctgtcattttctgtttctgctgtctaattcagaacttagtcaaacctagtctttttggaagagacttgctgtaaaacttccatgtatgctccaatggggaaaagaatctgaacacatttaaagttttcctttgtaaaatgaatcagtttcctttaaaaaaattttttttttttttgagacagagtttcactgttgttgcccaagctggagtgcaatggcacggtctcggctcactgcaccctccacctcccaggttcaagtgattctcctgccttagcctcccgagttgctgtgattacaggtgcccaacaccacgcccggctcattttttgtatttttagtagaaacggagtttcaccatgttagccaggccggtctcgaactcccaacctcaagtgatccacctgccttggcctcccaaagtactggtattacaagcgtgagccgctgtgcccagcctcctttagaattttaaccttagaagattagcattagcctggttctcagcattcttttttccttactctgctatagaaagtctgatcagctggctgggtacagtggctcatgcctgtaattccagtactttgggaggccgaggcaagcggatcacctgaggtcaggagttcaagaccagcctgaccaacatggagaaaccccatctctactaaaaatacaaaaattagctgggcgtggtggtgcatgcctgtaattccagctgctcaggaggctgaggcaggagaattacttgaacccgggaggtggaggttgcagtgagctgagatcgcgccattgtactccagcctgggcaacaagagcgaaactctgtctcaacaacaacaaaaagccgggcacggtggctcacacctgtaatcccagcatgaattgcttgaactcgggaggtggagggtaccagtgagccgagatagcgctgttgcactccagtctgggcaacaagagcgaaactctgtgtcaaaaaaaaaaaaaaaaaaaaaaagtctgatcggcattcttaaatttgggacattttacatttgaagtgaactgttgttttactacaaaagtcacagggcygtgtaaattgccttgtgtgttgttttcgtaggtggagtatcacttcctctctccctacgtatctccaaaagagtctcctttccgacatgtcttctggggctccggctctcacacrctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcrtgctaaattttcagtagggctrcaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagcwggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatmctggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagamacattttgtggtcattaagcattgggtgggtaaattcaaccactgtaaaatgaaattactacaaaatttgaaatttagcttgggtttttgttacctttatggtttctccaggtcctctacttaatgagatagyagcatacatttataatgtttgctattgacaagtcattttaactttatcacattatttgcatgttacctcctataaacttagtgcggacaagttttaatccagaattgaccttttgacttaaagcagrgggactttgtatagaaggtttgggggctgtggggaaggagagtcccctgaaggtctgacacgtctgcctacccattcgtggtgatcaattaaatgtaggtatgaataagttcgaagctycgtgagtgaaccatcattataaacgtgatgatcagctgtttgtcatagggcagttggaaacggcctyctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattytagaacttgcatgacctttactgtgttagctctttgaatgttcttgaaattttagactttctttgtaaacaaatratatgtccttatcattgtataaaagctgttatgtgcaacagtgtggagattccttgtctgatttaataaaatacttaaacactgagttgtcatttctttagataaattttttaaaaagagcagttttaggctcatagcaaaattaaacagaattcccacacatccactgtttctgccacttacacatcctccatgacggtcaacagcttgcgccagagcggcatatttgttacaatgggcagcctacacgggtgcaccattagcaccgtcagcatcattagtctactgtttacgttagggtttgttctacggtttttgacaaatatgtaatatcattctagtagcttacagaatagtttttattgctgtaaatcttgtgctctgcccattcatccatctcttctataaggccctggtaaccacagatcttactatatccataattttaccttttccagactgtcatacagttggaatcagaatatagccttttcagattggcctctttcactaagcaatagcatttgtttcctccatgtcttcatgacatgatacctcatttctttttagcacagaacaatattctgttgtctgcagttaccatagtttatctagctcacctacttactaagtaatcttgcttctaagttttggcagttatgaataaactgataagcacctgtgtgtatatcttttctgtgaacataggtcttcagctctttaggtaaataccaaggtacatgattgctgctgtcttctaagtgggcgatctcagcccactgcagcctccacctcaggcagttctcctacctcagcctccgagtagctgggattacaggtgtctgccaccacgcctagctaattttcatatttctagtagacgtggggtttcaccatgttggccgggctagtcttgaactcctgatctcaggtgatccgcctgcctcagcctcccaaagtgttgggattacaggcgtgagccaccatgcccagcctctattggcaatttctaaatatacaatatattgtcaccatataccacatatgtaattttatttatttttgagacagaatctttgctgtcgtccaggctggggtgcagtggcgctatctcggctccccgcaacccccacctcctgggttcaagtgattctcctgcctcagcctcctgagcaactgggattacaagtgtgggccaccaygcctggctaatttttgtatttttagtagagatggggtttcaccatgttggccaggctgatcttgaactcctgacttcaagtgatctgcccacctcagcctcccaaagtgtgtgattacaggtgtgagccaccaccacgctctgcctccttttttttttttttttttttttcccgagacagtctcgccccatcgcctaggctggagtgtagtggtgccatcgcagctcactgcaacctccacctcccaagttcaagcaattcttgtgcctcagcctcctgagaggctgggattacaggtgtgctccataccgtgtcttcaaactcccttgtacctcaagcaatgcacatctcagttttggctagccacatttcaggtgctcagtagccacatggttagtgggcaccagctctatagcaaaaggcgtaattgttgagagttttcttattttggccttctaccgtgtggttaccaaaaaatccatcacacaattgaatctcattgctatgagtgccagccaggattcttaagtatggccacgaaaattgtggcccctagaattggaagcctaattgcctcacctatgccccagctttcccgtgtccaaattagccacattcatacccttgagaagcaagatgattattaaactgctgtattctacgggagaaactgcctatgtgaaaggtcatgggttaggaagctgtcctaaacaaatatttgtaaaacacctggttatctgcaagacagctttgcctagaattcaatatcagataccaatgtcttccttgtggctgtcaacaggtttaggtgctgagttaaataaagcctttgcagtttgctgcatttgccctttaagctgcctcatgcttaatccaccccaaatggacagctttgtataattttcttttcttttttttttttttctgaaatggagtctcattcttgttgcccaggctggagtgcaatggcgtgatctcagctaactgcaacctctgccttccaggttcaagcgattctcctgcctcagcctccccagtagctgagattacaggtgcatgccaccatgctcggctaatttttgtatttttagtagagatggggtttcgccatgttggccaggctggtctcgaactcctgacctcaggtgatccgcccgccttggcttcccaaagtgctgggattaaaggcgtgagccaccgcacctggccagctttgtataatttttaatgccttttttgaaaatattcacatacggtcaaagtgcagaaaagtctgtattaaaaagtattttcctcttagtctccagagttgtcatccctctaaatctccacaattaccaatttttctttttttattttgagatggtctcgctcttgtcacccaggctggattgcagtggcatgatttcagcttgctgcaacctccgcctcctggattccagctatcctacctaagcctcctgagagtagctgggactacagacaggcaacaccatgcccagctaagctaatttttgtattttttgagagatggggttttgccttattacccaggctggtctcaaactcctggactgaagtaatacacctgcctcagcctcccaaagtgctgggattacaggtgtgagccactgggcctggtcatttaccgatttcttatgtacattttcaaagttgtctgtgcataaatgagaattctataccagatcttcctaaaagcatatatgggggctctggttccacagtcaccacataagcctcctacaacctatccctcctgctgcttacagccagaagctcagtaagacggggggaaaactctcccaaacctgagatgtaaacaaaggtaggcaaacagtggaggggagtaaaacttggagaagtgacctcaaaagggaaagaattggcaggaaccaaaagaggaacaaacaaaaaaactggtgaagtggcatgctgagtccagccatatcaataattacattattgacatgttaacattctaatcaagactgatgattaaaaaacaatcaaggcccatttatatgctgcctataagaaactttaaagacagatgaattgaaaggggaaaaaatacaatatgtacactagcatactatgactggaatggttatataaatataagattaaatagactttgaacagatagtaccgtaaagataggaatattttataattgtaaagagagccattcaggaagatagcagacttataaatacgtatgcaccttaaaatacatgaaaaagaaatgaaaattctgccattaaaatagattttaacacccatttcttagcagtaaatagagaagctagaccaaaaaaatcaggacaaattatttgaaccactgtatcagccacctcaatctacttgacatttgtagaacaccacattcaacaactgcaaaatatactttttttaggtatatgtggtatattcagcaagatagaccatatactgggtgatacggtttggatttgtgtccctgcccaaatcttaggtcaaatcgtaatccccagtgttggaggagggggcctggtgggaggtggttggatcacgggggcggaatgcccccttgctgctgtcatggtagatcccacgagatcgggtagtttgagagtgcgcagcgcctttgctgtcttcctccttctccagccgtgtgggatgcgcctgcttcccctctgccttctgccatgatggcgcagtccctgaggcctccccagtcatgcttcccgtgtagccggcggaaccatgagccaattaaacctcttttctttatgaattacccagtctcaggtagttctttaaagcaatgtgagaatggactaatacattgggtggtaaaacaagtctcaatttttttttgttttgtttttgacttggagttttgctcttgttgaagattatgtagctcgtttcgggaagcttctatcttcttacgatctgcagcatctatcctgtaaacaatagccttgactcgtcgctgtcacacgggctggagtgacgtggcgcgatctcggctcactgcaggctccgcctcccgggttcaagcgattcttctccctcagcctccgagtagctgggattacaggcacccgctaccacgcccggctaattttttgtatttttagtagagatggggctttcaccgtgttgcccaggctggtctcgaactcctgacctcaggcgatccacccgcctcggcctcccaaagtgctgggattacaagcgtgagccaccgcccggccggtcctggatctttattgtgacatgacctttagttactttcctcgtgttgaaacccactgtggccgtcatatctccgctgaattcacctgacgtgatggcagtgacgaaggtggccttgcccgagtactgcagcccacgagcatcggctccatctcctccttccagacgagcgaaggggaccgtccggcaggcggcagatgagcgctagcatgatggcggctgtgagccaggacgaccctccacaggagcagcctccacccgagcccacgacggctcctccaggcccgcgccacacaggcgggcacaggccggcggtagcggccttaatttttttttttttttttaaagacaagctcttgctatgttgcccaagctggtcttgaactcctggcctcaagtgatcctcccacctcagcctcgagttgctgggattctaggtgtgagtcactgcgtctggctctctgaacaactttatgtccccaaatttgacaacttaaatataagtagacgaatttattgatatattcaaattaccaaaattaacgtaaaatcaggacatctgagtagacccatatatacaattattatttttaaatctgcatgtctattttacttccatcacaaaaatattacctatataaaattgtggtccactttcttctccttgacctcaaatttaacactttttgttcctttttttttttttttttttttggagagagcatctcactccctcacccaggctggagtacagaggtggctcactgcaacctccacctcctgggctcaagcgattctcctgcctcagcctcctgagtagctgggattacgggcatccgccaccattcctggctaatttttgtatttttagtaaagacggggtttcaccatattggccaggctggtctcgagctcccagcctcaggtgatccgcctgcctcaccctcccaaagtgctggtattacaggtgtgagccaccacacccggccaatttccacactttaatttcactcaagtaaaagcaggatcacattcctgacataagaactaatatttcacatcattagtttggattcgatatgttcttgattggttgtttctcgggaatagtaactcatctttcctacgtgttatttctcttttattgattgaggaaataaatgtaatgaccatcatagatctgtgacgaatatctctttcctgtgttcagtaagacaggtgtacataggtgtaattcaaaaccgtaacgacgccgggcgcagcagctcacaccggtaatcctaacactttgggaggccaagatgggtggatcacttgaggtcaggagttcgagaccagcctggccaacatggtgaagccgcacgtctactaaaaatacaaaaattacctgggcgttggtggtgcgtgcctgttatcccagctacttgagaggctgaggcaggagaattgcttgaacctgggaggcagaggttatggtgagctgagactgcgccactgcactccagcctgggcaacaagagcgaaaccccacctcacaactcaattacacaaacttttttagaacatagaggaggaacaattgtccaacttgttatgaagccaacataacatgcccaaaac

SEQ ID NO: 17690 - DNA, 15804 bp, Homo sapiens
ccaaactgctgggattacaacaagcatgagccactgtgcctggccttgatttttttttttttttatgataatctgtagttagatgaagtttttaaattttttgtagagatggggtctcactatgtcacctaggcttgtctccaactgctgacctcaagctgtcctcttgccccagccctccaaagcattgggattactggcatgagccattgcatctggctttttttttttttttgagatggggtctcaccatgttgcccgggctggcttcgaatgcctaggctcaagcaatcctcccttctcagcctcccaaatagctgggattacaggcacgtgccaccacgccaggcttgttttctttccctgtccctccctctctatttcccactctcttcctccccaattcttctggccctataaaatcacatttgtggcctgtaccctgctaggctcgaaagacaccaaagtgaatccatctccatcctgaggcttgaaaaggcagcccaaaggtggcagttctcttgttcagcaagcactccctacggtggagggacacaggaacgcagacttggacctcagtgcagcaagtcccagccacagctgagcactcgattcctcacaaccccaagaggcagttaggttcacagagagatgatgccagcgtccatggtcaccagccagcctgtggcagggctgggattcgaacccaggctgtgcatatttacccactctacccaatggcctctcagcagcagagtggctcagagcctgggtttgggaggtgtggaggcttggattctgcccttgacacattttgtgagcatgagtgagtgacttaccctgtaagcttctataagtggtggtgaccccctctgtaagtgggggtggataaatgctgaccacatgggcttgtgtcgaccagatgaggtccttcaggtaatgcagtcatagcagggcctgggacgctgacctcagcggtagggaacccctgggcgatgggttaggagaagggagcccttgagggaggcctgagagcaagcccaagcctccagccggggtgagcctagagggcttcctggaggtggagtctagcctggcactcagggtgggtggaaactgatcgtcattttgcccacaggaatcctcgtagcycactacctccagagcatcacgccttgcctggccctgggtggagagctggtctaccaccggcggcctggagaggagggcactgtcatgtctctagctgggaaatacacatgtgagcctggcgcctgggtccgagggtggaggggctgggcccctggactcctcctgggtctgagggaggacgggctagggccctggacactcaggtctgagggaggaggcctgggttcccagatgcccaaatccccttggtaatgagaccccgcctccaccccactctctgacagtgaacaactggttggcaacggtaacgttgggccaggcgggcatgcacgcaacatactaccacaaagccagtgaccaggtgagtgggtgcagggactagctggtgctgccaggggctgctgggcctggaagtccaggtggggccacttgctaattctcatgtgttgctccggcccctccagctgcaggtgggtgtggagtttgaggccagcacaaggatgcaggacaccagcgtctccttcgggtaccagctggacctgcccaaggccaacctcctcttcaaaggtaaaggtctcggttcccctacgcgggaaacaggcaggaggtgactcaactctgagtggatgtgtgggccaccacaggtgctggaggacagtgtgctgccaccctgtgggcctccacattaccggggaacacttgttaaaaggtaggtggggccgggtgcggtggctcacgcctgtaatcccagcactttgggaggccaaggcgggccgaggtaaggagattgagaccatcctggctaacacggtgaaactccgtctctactaaaaatacaaaaacaaaattagccgggtgtggttgcgggtgcctatagtcccaactactgaggctgaggcgggaaaatggtatgaacccaggaggcggagcttgcggtgagccgagatcgtgccaccgcactccagcctgggtgacagagcaagactccatctcaaaaaaaaaaaagtaggtggacaaccctctactatgttttatgcttggaaaaaaaaagtaggtagagcagccaggcgtggtgactcacgcctgtaatcccagcattttgggaggccaagccaggtagaatacttgaggccaggagttggagaccagcctggccaacgtggtgaaatcccctctctactaaaagtacaaaaattagccaggtgtggtagcgtgctgcaactgtagtccccgctacttaggaggctgaggcacaagaatcacttgaacctgggaggcggaggttgcagggagttgagactgcaccactgcactccagcctgggtgacagagtgagactccatctccaaaaaaaataaaatgaaataaataaataaatgttaaaaaaaatctggtggagcatctgatgggtgtttgggccaagctggagctttgtccatcccctcttatttttctgcacttgactctcttatttttctgagactggtctccctctgtcgcccaggctagagtgcagcagtgcaactgcggctcactgcagcctccacctcccgggctcaagcagccttcccacctcagcctcctgagtagctaggaccacaggtgtatgccaccaggcccagctaatttttttgatagttttgggagacatgggggtttcaccatgttgcccaggctggtctcgaactcctggactcaagccttggcctcccaaagtgctgggattataggtgtgagccaccacacccagccagggtagaaggcactttggaagcctcgagcctgccccattcatcttacgttagtggaaactgaggcttccagaggtttcaaggtcacaactaaatccagaacctcatctcaggcacactggtcgtagtcccaatgtccagtcttaagtcttcttggatatctgtggctcacagattttgggtgtttgagcctcctgctgagcactgctggggccacagcggtgaccagccctgtcttcacgggactcagtgagaggaacagattcatccgcagagtgggcaggactaggttgggggaacccaggggtctagagggcttttcagagggcaggggtcactgagcggagagcagaggaggagtgagccatttgctccagcgtgaagttgttggtgtgatggggtttcagggtggcaggagcagtgtggttaaaggtctggaagctgtcggcatgtggctggtatccaaggtggccaggaactctgcatggatatggtgggaagctggcacgcctctcacctcagctcttccctgcaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccagaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaacaacaaaaaatatacgtgggaaaaaaaacgatgggaggcctccgttttctcaagtgtgtctggcctgttttgagcatttcatccggagtctggccgccctgaccttcccccagccgcctgcagggggcgccagagggccggagcacggaaagcagcggatccttgatgctgccttaagtccggctcagaggggcgcagcgtggcctggggtcgctatcttcccatccggaacatctgccctgctgggggacactacgggccttcccttgcctgagggtagggtctcaaggtcacttgcccccagcttgacctggccggagtggctatagaggactttgtccctgcagactgcagcagcagagatgacactgtctctgagtgcagagatgggggcagggagctgggagagggttcaagctactggaacagcttcagaacaactagggtactaggaactgctgtgtcagggagaaggggctcaaggactcgcaggcctgggaggaggggcctaggccagccatgggagttgggtcacctgtgtctgaggacttggtgctgtctggattttgccaacctagggctggggtcagctgatgcccaccacgactcccgagcctccaggaactgaaaccctgtctgcccccagggtctggggaaggaggctgctgagtagaaccaaccccaggttaccaaccccacctcagccaccccttgccagccaaagcaaacaggcccggcccggcactgggggttccttctcgaaccaggagttcagcctcccctgacccgcagaatcttctgatcccacccgctccaggagccaggaatgagtcccagtctctcccagttctcactgtgtggttttgccattcgtcttgctgctgaaccacgggtttctcctctgaaacatctgggatttataacagggcttaggaaagtgacagcgtctgagcgttcactgtggcctgtccattgctagccctaacataggaccgctgtgtgccagggctgtcctccatgctcaatacacgttagcttgtcaccaaacatacccgtgccgctgctttcccagtctgatgagcaaaggaacttgatgctcagagaggacaagtcatttgcccaaggtcacacagctggcaactggcagagccaggattcacgccctggcaatttgactccagaatcctaaccttaacccagaagcacggcttcaagcccctggaaaccacaatacctgtggcagccagggggaggtgctggaatctcatttcacatgtggggagggggctcccctgtgctcaaggtcacaaccaaagaggaagctgtgattaaaacccaggtcccatttgcaaagcctcgacttttagcaggtgcatcatactgttcccacccctcccatcccacttctgtccagccgcctagccccactttcttttttttctttttttgagacagtctccctcttgctgaggctggagtgcagtggcgagatctcggctcactgtaacctccgcctcccgggttcaagcgattctcctgcctcagcctcccaagtagctaggattacaggcgcccgccaccacgcctggctaacttttgtatttttagtagagatggggtttcaccatgttggccaggctggtctcaaactcctgaccttaagtgattcgcccactgtggcctcccaaagtgctgggattacaggcgtgagctaccgcccccagcccctcccatcccacttctgtccagccccctagccctactttctttctgggatccaggagtccagatccccagccccctctccagattacattcatccaggcacaggaaaggacagggtcaggaaaggaggactctgggcggcagcctccacattccccttccacgcttggcccccagaatggaggagggtgtctgtattactgggcgaggtgtcctcccttcctggggactgtggggggtggtcaaaagacctctatgccccacctccttcctccctctgccctgctgtgcctggggcagggggagaacagcccacctcgtgactgggggctggcccagcccgccctatccctgggggagggggcgggacagggggagccctataattggacaagtctgggatccttgagtcctactcagccccagcggaggtgaaggacgtccttccccaggagccggtgagaagcgcagtygggggcacggggatgagctcaggggcctctagaaagagctgggaccctgggaasccctggcctccaggtagtctcaggagagctactcggggtcgggcttggggagaggaggagcgggggtgaggcaagcagcaggggactggacctgggaagggctgggcagcagagamgacccgacccgctagaaggtggggtggggagagcagctggactgggatgtaagccatagcaggactccacgagttgtcactatcatttatcgagcacctactgggtgtccccagtgtcctcagatctccataactggggagccaggggcagcgacacggtagctagccgtcgattggagaactttaaaatgaggactgaattagctcataaatggaacacggcgcttaactgtgaggttggagcttagaatgtgaagggagaatgaggaatgcgagactgggactgagatggaaccggcggtggggagggggtggggggatggaatttgaaccccgggagaggaagatggaattttctatggaggccgacctggggatggggagataagagaagaccaggagggagttaaatagggaatgggttgggggcggcttggtaaatgtgctgggattaggctgttgcagataatgcaacaaggcttggaaggctaacctggggtgaggccgggttggggccgggctgggggtgggaggagtcctcactggcggttgattgacagtttctccttccccagactggccaatcacaggcaggaagatgaaggttctgtgggctgcgttgctggtcacattcctggcaggtatgggggcggggcttgctcggttccccccgctcctccccctctcatcctcacctcaacctcctggccccattcaggcagaccctgggccccctcttctgaggcttctgtgctgcttcctggctctgaacagcgatttgacgctctctgggcctcggtttcccccatccttgagataggagttagaagttgttttgwtgktgttgtttgttgttgttgttttgtttttttgagatgaagtctcgctctgtcgcccaggctggagtgcagtggcgggatctcggctcactgcaagctccgcctcccaggtccacgccattctcctgcctcagcctcccaagtagctgggactacaggcacatgccaccacacccgactaacttttttgtattttcagtagagacggggtttcaccatgttggccaggctggtctggaactcctgacctcaggtgatctgcccgtttcgatctcccaaagtgctgggattacaggcgtgagccaccgcacctggctgggarttagaggtttctaatgcattgcaggcagatagtgaataccagacacggggcagctgtgatctttattctccatcacccccacacagccctgcctggggcacacaaggacactcaatacatgcttttccgctgggcgcggtggctcacccctgtaatcccagcactttgggaggccaaggtgggaggatcacttgagcccaggagttcaacaccagcctgggcaacatagtgagaccctgtctctactaaaaatacaaaaattagccaggcatggtgccacacacctgtgctctcagctactcaggaggctgaggcaggaggatcgcttgagcccagaaggtcaaggttgcagtgaaccatgttcaggccgctgcactccagcctgggtgacagagcaagaccctgtttataaatacataatgctttccaagtgattaaaccgactcccccctcaccctgcccaccatggctccaaagaagcatttgtggagcaccttctgtgtgcccctaggtactagatgcctggacggggtcagaaggaccctgacccaccttgaacttgttccacacaggatgccaggccaaggtggagcaagcggtggagacagagccggagcccgagctgcgccagcagaccgagtggcagagcggccagcgctgggaacyggcactgggtcgcttttgggattacctgcgctgggtgcagacactgtctgagcaggtgcaggaggagctgctcagctcccaggtcacccaggaactgaggtgagtgtccccatcctggcccttgaccctcctggtgggcggctataccyccccaggtccaggtttcattctgcccctgtcgctaagtcttggggggcctgggtctctgctggttctagcttcctcttcccatttctgactcctggctttagctctctggaattctctctctcagctttgtctctctctcttcccttctgactcagtctctcacactcgtcctggctctgtctctgtccttccctagctcttttatatagagacagagagatggggtctcactgtgttgcccaggctggtcttgaacttctgggctcaagcgatcctcccgcctcggcctcccaaagtgctgggattagaggcatgagccaccttgcccggcctcctagctccttcttcgtctctgcctctgccctctgcatctgctctctgcatctgtctctgtctccttctctcggcctctgccccgttccttctctccctcttgggtctctctggctcatccccatctcgcccgccccatcccagcccttctccccgcctcccactgtgcgacaccctcccgccctctcggccgcagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgygcggccgcctggtgcagtaccgcggcgaggtgcaggccatgctcggccagagcaccgaggagctgcgggtgcgcctcgcctcccacctgcgcaagctgygtaagcggctcctccgcgatgccgatgacctgcagaagygcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtgatttcctctaagccccagcctcagtttctctttctgcccacatactggccacacaattctcagccccctcctctccatctgtgtctgtgtgtatctttctctctgcccttttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttggggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttcattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttttttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttctcctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaatttttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaacctctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctatctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtggcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgctccgcccaccttggcctcccaaagttctgggaatacaggcgtgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggcttacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataaaagcagatagagtgtttgggggaggtagccagccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacaggcatgcgccaccacgctcggctaatttttgaacttttttgtagagatgaggtctccctatattgcccaggctggtctcgaactcccaggctcaagtgatcctccctcttcagcttcccaaagtgctgggattacaggcatgagccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagatggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggaggtagggagggaggagggtgccactgatcccctgaacccctgcctctgcctccagagtgcccctccggcctcgccatgaggctcttcctgtcgctcccggtcctggtggtggttctgtcgatcgtcttggaaggtaaaagtgggatgggagaattgcggagttggagatttggaagagtgaaggtggctacaggcctggggtcccggcttagaggacctctgagagctccggggccccttctgggtcgtggttgcctcatcgtggtcgggtgggtctccaggttctcccaggctcagtcccgcaggcgccaaatctgcgcaggagagcactagcaaccgatgacgtattgaggcccacacctctgggattggctgtcctgcttcgacagccttgaaagtgggtaagctgggtggggggctctgggagaggtcagtgctgagtaaggcaattcccagcagcttgagccccaccaggtcactccagtattcctccccattctttttttttttttttttttttctcttgagacggagtctcgctctgtcgccgaggctggagtgcagtggcgcgatctcggctcact

SEQ ID NO: 17691 - DNA, 81210 bp, Homo sapiens
gtcctgtttctttttctttctctcattttaatccttcttgagctttttcaaatgtgtcatgtttaaaagtggactcatcctttcttttcttttttttttgttcttctttctttttttttgagatgaagtttcgctcttgttgcccaggctggagtgcaatggcgcgatcttggctcaccacaacctccctgtcctgggttcaagatattctcctgcctcagcctcccaagtagctgggattacaggctaccagctaattttgtatttttagtagagatggggtttctccatgttggtcaggctggtctccaactcctgacctcaagtgatccgcctgcctcagcctcccaaagcgctgggattacaggcatgagccaccatgcccggcccatcctttcctttctaacccagttcctggttgtccccctgctgagtagacagcaccagccatggcctcagccaggcaccccactctccctcacagttcacattttcagtgagtgctaggctttctacttccttctctctaattcactcttcattttctccaaactcctgctatcccccaggaacagggaagcatcctctcttgctagattatagcaggagcctccctatctcctgagatcatccaggctgatcttgctaaatgttcaactctgttcctgtcttgcccctctttaaaccatatacttccatagaattaagcccaggttcttttgtcaattgttttcctttttattaattaattaattttttttttgagattgaatcttgctctgttgcgcaggctggagtgcaatggcgtgatctcggctatccacaacctctgcctcctgggttcaagtgattctcctgcctcagcctcctgagtagctgggaccatgggcacacaccaccatgcctggctaatttttgtatttttagtaaagacggggtttcagtgttggccaggctggtcttgaactcctgacctcgtgatctccccacctcagcctcccaaagtgctgggattacaggtgtgagccactgcacccagccttattattttttagagatggtgtcttgctgtgtctcccaggctggagcgcagtggtgcgatcatagcttacctcagcctcgaactcttgggctcatgcattcctcctgcttcagcctcctgagtagctgggaatacaggtgtgcaccaccacatctggtcaatttttaaattttttgtagagatggagtctcactatgttgtccattctggttttgaacttctggcctggaaccttccatcgatcctcccatctctgcaagcctagacatttaacatggtctagaaggcctccatgagctccatctcacctcttttttgctccttccgctccggacctttacaagttgtggccattccaaactcctttcacttctgattatctcatgttctctctcacctccccgcccatgcaatgaggttcctccccaactagattcttattcctcttagattctcagagaagccttccctgaaagaagccgtctcccatctcccagattgggttaggctcctcctgtgtgctgacttcattgtctctctccaacattgcttagaacgctaagttgcaactttatgtctaattgattgctccactagtccataaaatctaggaggaaagggctgtatccttagcccttgacacatggccttgtacatcttaagtttgcatatgaaccgctttatttacctgggatattatcttacttaatccccaagacaaccctatacgttgtgcatgattattccaatggtcattactgttattttaaatagagatgggggctcactatgttgcccaggctggtcttaaactcctgggctcaggtgttcctcccaccttggcctcctaaagtgttaggattacaggcatcagccaccatgcctagtcgattatgccccttttaatggatgagcaaagagtcgaggttccactggttttccactgcagtgtctctgctgaaggattaaaaaaaaaaaaatcacagggctgtgctggactcctgggacttccagaggacaagtccctctcttcagtgaggctgacctacacagagccagccctccttcccctcccagccacagctgtgtgttggaaagctagaggcctgggcccctaataaagagcagacctcccaatctcctcgttccttccccctcccctcatatggtttttcaaattaaaagcaactaaaaccaaagacctaaggagcaggagagggcagaggcacaacaacatccctaaactgaggaagggggctctctagcgagggagggggtatccaaaagccagatccagagggttccagtcctaccagtctgtcccaggctctaaggagtgtatggcccaccgggctgggctggaccaggaaacaagctcttgtcctcaggtctgtaaacaggctgcgttgttaggaaccctctgcttctacttcctgaagagcaagccccccaaacccagaagagaggctgcaccttgagatccagccagcaaggtgggtgcggagtcctggggagggaactttcacctcaagctgcacagacccatctcgatctttttagagaattcctccttttccaggactagtgccgttctgaattctgagcgtgcaaagagactccttagagctagcttccgagcctcagctggggcagaccagaggccagggcgtctctctgtctgcggggaccccccacatctgtgcgtcacctccaccacctccgggcaaaggacccttcctcgctggacccagggaggcggctattccagatgcagccaagggttaaagggggtgggagaaggagcagttagcaccgttttcttttgcaaaccaccaaacgggcccttcattttcaaattgtgaagccagaaacatcccccgttcccttgccccgcccatcaccatttgaaaaaaagaattcacaagtttaaacgtgattttcacaactaacggctttgataactgttaaattcgtacggcttctagggcaaacggacctgaattcttcaaggaaagtagaattggcggtggagctggggggcagaggaggagaagacacaaaaagccaactcagtgggaagcgccctcaaagccaaaggtgtggcgctcggagctgtggccgccctcgcccgggagtcggggccaggagaacgggccctggaggcagggcagggcacggcgagattttgcttttgtttttagtgaccattttgatctggttgtaaaaagtttacgaggccttctttttgaaagtcagctaatcgactgcacctttttatacccttgccctcaatttcatgtcgcctgctggcctagacgcgcaaggcggaggacagaactgtcacagtccctacccttttctcccaacttctcggcccggctcaattcgggagttgggcctccttcctctcggctcgcagcctccccgactcccactttggggagaaaacccacattcttaaccccttgataatccctcaaggaaaaaacaaaacacccaaccccaagaggtgaaaattagaatccgggcgcgggttgagatcttgcgcaaaactggccaagcccagtgcatgtcgctcctctcctccgggtacataataggggggctggggcccttccccccccccccccacaaagggggcccagtggggaagcacaagaaagggggagaaaagacccgcacccccccctcaggagggcaaggtttctagccccctgcggctccgggaccacccaggacccggggcgtcgtgggaccgatctcgaaggatcttagaacgacactgggagagcgcggcaagaactagccccaccttcccccgacgccccggactgactgccgggcgcagacccgacttctcccgaaccagcctcggaccagccttagaaggcggaaaacaggattcaaacccgcctatgagcagtggtaggggcgggggctgtgggggcaggactcggcttaaggaaccaaccgcctcggttcgagggcctcctgtccggaggttgctcctgaccactgggtttattttgcttttgcagaggaggcagatgttgacctctcttctttgcacagtctctccgcaaaattttcccccaaccatttgctttcttgcgccaccccccaccggggcactatccctggagtcagctcctcaggcctttaaaccttccagaatgtcacacatggaaacctttagcaaatgtttgttaatgatcataacaaaggcatcattcaaattaggcaggtaattactaccagaaggacaactgggtgctcgcttgctcatccattgctttctgctttaaactcccgaggagtcgctgcctggagacactcccgcccggactgcttctcgggccccattaaacggctctgaaatgaactgtgaagttaccatttgtgggcggagagcgctggggccctgcggacggaagaccctggcttgaccggactaacagtgtcgccgaagcaaagcagcccctctgggtaggctgtctgtctcgcctcctaccctctggggcaactagcctaaaaacccggttctcaacttaacagcatgtggcccagcacccgcttttgccttttattccgcactctgatttttggggggatcgtttgttcccgctcattttctacaaacattacggtatcctgttagcattccgaacarggggctgttcatatatttgccttcaatgatttcctgaagggacatgtggaagtaatagcgagcggtgcagtcacccaagctgaagatgcacgagagcgggtcgcgtagaagaactgcggcaatgggacccccagcgcagccccaggcgccctgttttcgaggctgacatcccaagatcctgtcctggttaggcacagcaccgcgcccgttggagtacttctctgtgactctcccctgtccactgcactgtgtccaccctcctggtgaaggaggagacggctgttggacatgccagtcccaacctggccactttggccattttcagagtgcgtgtgttggggtggggttgagggagaaggatgaaggatgacccccaaccccaacaggagaattcaaaaatcagagagcgatgaaggtgaacgcgctcccctcccccgctgtcgctgggaagccccactctgcccaggtctggttcctggagcatcagcgccccctttccctcgccggcaggatcgtttcctcccgacactggcctctcgccttgggcgcaggrtttggggctcagctgtcaattccaaggaattcgtagggttcgacccacgcggcgggagggaacggagggagaatcaaaaggcatcctcccccacgacgcggaggcggtggtacgattcctcaaacgcccaagcttgagctttttttgtatgcgagatagaagccagggcaacctcgcccagataaccccgaaaacaaaggcacgaccagataagtgacttcaagggagtaaaggtcgttctatcggagaacgttccaaacctacacagaccctcttttctttgtaccgtatttcagaccacccagtcttgtacacacacacacaccacacaaaacaaaaacccatcattgtcatattggactcaacagtttgcccaatcctattaaataactagcaactatatagcccttcccctaaaagacccctagttcaaaacggcgcaaccgcttggagatttctcccgagggccctatttctcgttgggccgagtttgtagaagggacatttcttgattctagatttatattctctctgggtattaaatgcaattttgtatgttccttttcttcttttcaaagagaatacaaaactatagcagtctaagaaaataaccccaaaatggggaggcaaactcattctggaaatgatgggctgtttgtagtttcacaaaacctctttcccggcagagcaccaacacctcccccttccaccaccccccatcccatctggtctgcttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaaggtaagggaaaagaaaaaatgattttttgtttataagggaagtccctgatcagactctgggactggagaaagcgaagtaacttcaaactttgggcgacaagaaaaaaaaaaaggagctggattccagttgtgtgtccagagagtaatttttttttttcggaataaacttcacttggggacgggtgggagataaccatagagttagaaagtctaggtattttttttaaacacacattttccagacctatttttaaaaacaatgtttttctaacaaccctatggcctcccaaagaaattgtttaggcttacatttttgaggtttcttttgggagtgggggtggtgttcgtgaatactgggccgaacaccaaggaactgggggtggaggcagaggtgtttgccctcttcttggcagtgggtcctggaaggcgacaggttttaaatgagtgttttcattcctcgcctgcggtttggcgggacagcgctgcagcccatggtgtggagcgcggctgggggaccagggggaggtggggagaggggagcgtggaggggagcgtggaggggggcgcgcgaaggggttgcggggcgcaggaggcgggctgggctcggctggagaccggacctcggtgttggcctacagcacagggagccggccgaatgcgcgtgattactggacggcgctgctctgggagagagtcggggccagatttggcgcggcggtgaggcggctgcgggacaagcagaggcgcgcgggcgtgggcaagggtttggggcgctctggagcggtttgttgggtcagtgaggtgccagggagagcgggtgcctgccgggcagtgtgctcgggttgcacgccctakcgcgggggcgacagcggcggcgcgggcgggcggtctggaataatgacaaacacatttggccctgagtgaagaagtcgtcgtcgcctcgcattccagcaactgggatttgaggaatttcgaaccgcacaccaaggggccctcattgtgctccgtggcccccgcccccgcctgtcttcccgcgccccctcctcggtggaatcatttctgcattgcccgggggctctgctttcgctcagttctggccgcaggcaggaagagaggaaaggtctccaggaaggtgccgaacttcttgtgaggaagttagggacgacttggaactggggaaacttgtttgcaggtaagacagaaaggtgggaggtaaaccatattctccctccgggcacccgagccctggacaccccctacccggcacccttctccgcgcgggggtgcgtggcacttgccgtctgagctcgcccagcgctgctcggtcctctctagttggccttttttccattcctctccctgccggcttcagagccgtctgtgcgtacttctccttcctctgctgtctacccccatggaaaccagatttacacacgaaattaactccgcccggctgcgcccagggagcgggcggcgtccatttggcattgaatatgtgggatcagctgttctattccgggagggtgtcggccaggtcggagcgacgagtgtggcccaacccgagtacgttgccagagggagccaggagcctgggccgggccaggtgtgcgagagctgccgatggcctggcctcgcgtcttggtcgggaaggacttgctggcctggcaggctgtgcgttgtgcatccctcccgcagccagagcgccggtcccgcacttcgctccccgaattgtgctaagacctcaggatgtgcgcaaggagtgcctggaagaacttgccactcactccatcttcctgggtgggaggcaagcatggatggggcccmtatcaggtccctaccgccccgcgtccgaaaagccgcgggctgggcggtgtgggaaatggctttttggctccgaggccaaattgctcaatgttttggaccgactcgcctcgccgcggtcgctcctgacaagaactagacagatttttggagcagggagcatccagggcaaacgcacgacagtcctccgcagtgcatctcaccggacaaacatccccggagccacaggaggggaggaaggggctctccgggcgtgcgcacctccccagccgccgcgctgtcycatccccgacccctaatctggtcaacctggaccccggcactgctgaattgcatcccctcttctccctttctcctcggcctcctcctttccacaaccctcaagatgaggaggccctgcctcgactccccgacaggcgcaaggccgaccagsctcgctttgacgccctggtcaggccctgcttcggagcttgcagttttgggttgacccaagtgcagctggacctcgttcacaagagtgaggggaagccaagaatgaacccgtcgttagcccccggtgccctggctcttgtttaaatccttagatcgagaaggacttgaaggagatcccaggctcccagctctgcgcccctgggccagtttcctctcgggacgcggactgaggagggatgcagggggaggggcattgggccgggctttccagctgcaaacacgtctggcgccgaggcgggcccattttgtgcctcctggggacggaccgtgggcggcgcgcagcggcgggacgcgttttggggacgtggtggccagcgccttcctgcagaccccacagggaagtactccctttgacctccggggagctgcgaccaggttatacgttgctggtggaaaagtgacaattctaggaaaagagctaaaagccggatcggtgaccgaaaggtgtgggtctcagggttccccgggtctaactcgccgggtccaaccgcagcatcagccttggggcggcagataatctttcggtctcgcctggggcgcaagatgcaggatcgggggcaaatggcttctcccaacttccccctaattcgggttctgccagatggttgtcgtttgctgaagtggctcggcggcatttccttttgttttaaactgatcaatgagcgaacctgggatgggctgaaaaagtagattgtaggagggaataatgggaaacccgacttggggcgcctccttccctgcctcctactgcagtttctcggcccccgcgaaaggggagcgacaagcgcgggtgggcgcggactcttgagggggcagaggcggctatggcgcgtgtcgggcaaggtggcaccagaaggcacttttgtgtgtgtgtgtgacaagagtctcgctctgtcgcccaggctgaagtgcagtggtgcgatctcggctcactgcaacctctgcctcccaggttcaagcgattctcctgcctcagcctcccgagtaactgggattacaggtgcccgccaccacgccaggctaatttttgtatttttagtasagacggggtttcaccatrttggccatgctggtctcgaactcctgacctcaggtgatccgcccacctcggcctcccaaagtgctgggatttacaggcgtaagccamcgcgcccggccaggaacggttcttaaatgccgagagggcgcatgctagctctcctcagcattcccggtgagccgctacccacggccgtgcggctctcgtgcccataggaggcgctggcgagckcctgtaaccctaaacccctcggcccctttccccccacccgcccggattctcttcccgctctcccccctctctccacacccgcccggccccctctcgggtctcagttgaaaacaatgcaaacgcagagcgtcgtgcctggggcgcagcggcctctgcagctctgaggttcagagcgcggcgcgcaggggcgcaggggcgcaggtccccggagcggctgggcatcgccgccaaccccgggacaaccaagccgccgaggacttggtggaggtgggagggagagcggaccgcgcagtgttcctctgggtcccggggtcagaagccggacagtggcgggggctggacagtccgagcgcagagcctcccgggcgaagtctgcgcgcagcactcccggctgcgctgtcggggaccaggagcctgggctgcgggcgagctagctggcgagccgggtaagattcgcggggctgtcgcgccctctagtgggctccggggacgcatcccgctttccccagccccgggcggtcggcgccgctatctcagtggagcgcagcgctggaaccccgggggcccggagcggaggctaatctgggtcacctttcccctcctccgggcagccagtggactcctcgcaggctctgtgtgggcccgggaggcgccgggtggacgagagggggccgaggtctctgggtttggattgagaatgggacgtccttgtaattcaatgtgggagaagcaggggagtgtggaggaggacgggtcccgtgcgttcttggggggcaggcgccgtcttctgcgttccagcccctcgccagctcccttgccccgcgggcggcctgttgctgtttgtttgttttacgaccctgcgttattgtgcaacggtaacagtcgtttccaatcagctgcgcggccgtcgcggccctcgccaggctggtttatgggggcggcggtggcgcgcggacagataggacagcgcggcccgggaacggcgtcgaggtccaggcggtccccctgccccgagggggcggaaatgctgaggtggcgagagcgtgggttgcacagaaccctagtagcgagtccggctgagcctctgcggcctagcccagcagcgtcgtcttcccggctccgaagacgtcttcccgaagccccgctgccccggcgcaccagctcccggtgatggggatgatgatggggatgatggggagatgtccccgaattctcctggggtcccgaggagatttagccattttcaacagcagttttcctatttctgcttaaaccccgcgggctttcaactgaggtcaccacgaaagctaaaagtacaacctaaggaaggaagagactggaaattaacatttggggtagtggagctcagaattcctcgcagcggcgtctgtgtcgcaacccgtggacgcacgtccttggaccaacactgccatctgctggccactcgtaagaactactgcgacccgctgtgagaatgggcttcgcggagaccattaggaaggtgctttattttttattttttatttattttttgctcagtaggaccgtaataggtgactgattttcttttgctgtgaggctacaagaattgctggaagacaacatttttatttcgtggaaatttgtgttgtgtttctccttggttgttaatgctttgcatttacatrgtgaacatcttattatcagagctggcctgtgaggagggtagtgggggggcattgatgttcccgtttctgagtgaggagacctatgtcggggccttggtgacctcaagccgaatgctcaaactgctactgctactcctaaggttgtgccattaggagtcacacccgtttggtgatattcaaaaggatatgtcattttattctcccgtggttaaatatatggtgagaggagagcaggcatgtttatgagcccagattgtcccataaaaggctcctgtttaaaaacactccagccccctcccattactggaatgtctgatggagctccgggagatcaaaacaacaaaacaggctctggtagggtgcagaggtcctggtaaacacaccctctgctggaaaacagggagaagtttccaccagtgtagacctgcacttggtttgcctgggctgaagttaggagactgcgtagaaaaaggaaaatgtgtaattttcacagttagaattaacttaggagagctgaaattaactgagcctcggaaatctgaatcttgaagtcaccagtggcttttggggctgtgagagagtctcctgtggtctttaatcatgtgagggtggggtgaaattcaatattcagtggttctgcaatgggatgcactgtgcaattggtgattgagaagccaactctctggctttaggagaagaatgtcttgctgttagtccttctggaaatagagccttgcattgcctactgtctgtttacactacctttgcacattgcctttggttatagagtcatgtccaatggctctttacttctgtttgcagggcaggagatggcaccctgttaaagagaaaggatagtagctgcaaagtcatttgtttctctgtttctgtgactgtatatattggctcatctttgaatggtctttatagccacaccaggctggaggtaacagggtcatgggagtggactgctggtgtgggctgaatcagagttcagatccatgtctccaggaggtaggaggtgcagggcaagtcatgtggcttctggggcatccctcactttcttagttaaggagaagttgaaggagccgatctaaaatatcttgggagtctgcagaaaaagtcgtgaaaatcaaagcactttcaattaaactatataatttagtccttacaagaatgccacagggcaagcaaccagtcaggccttggtagtcgtgcttcctagaagaaaagactgaggttcagagagttggatagagtatcagatttgggatcagtggctagtccaatgtgatttccatcctttcttctgagagaaagcataagaaggccaagaggatggtggaaaagcacaagtcacctgcctgagagtcaacagggcggggggtctctttctcagtttgttcctctaagttatggcaaatgttttttgagctgtgattattgagaatgggggctgaagttcaacatgtagttggcatgagggaagtaattatgattgaagaaaagatttgggtgaaatctagtgttcttccctgcaaagggggttgttctcacggattcttatggtgccatgtttctcagaatttgtagyttcagttacttatatttgcacacctgactttagatgagctccagaatagcagttactaattaaggatgagcatttagagtagataaaagtggcaggaacagcaagactcactcccagagagcctcactacaggwctaataggtgaggaaattccccatgtttcccatttttcttcattacctccctgtggggcaagcactgccattattcatgagtaaactgtctgagttatagataagtaatgacatgaaacttcacaaacacgctgagcacagtggctcacgcctgtaatcccagcactttgggaagccgacgygggtgaatcacgaggtcaggagttcgagatcagcctgaccaacatggtgaaaccctgtctgtactaaaaatacaagaaattagctggccatgatggtgggcacctgtaataccagctactcgggaggctgagacaggagaatcgcttgaacttgggaggcagaggttgcaatgagctgagatcatgccactgcactccagcccaggcggcagtgcaagactccatctaaaaaaagaaaaagaaagaaagaaaaaagaaaaaaagaaagttcacaaacaggcctgatttctacccagggaaccactgttatcagagattggggtttggaatcttaagcaacaaacacatgtttattctcttccttcctgatggcttgctcagaggacctgtttccattgcccactttttttttgagacagaatcttgctctgtcacccaggctggagtgcagtggcgagatcctggctcactgcaacctctgcctactgggttgaagccattctcctgcctcagcctcccgagtagctgggattataggtacctgccgccatgcctggctaattttttgtatttttagtagagatggggtttcatcatgtcggccaggatggtcttgaactcctgacctcaagtgatctgcccacctcagccttccaaagtgttgggattacagatgtgagccaccacgcccggcctcattggccactttatatgtcagtaaataatctttcctggcagagggtccactgtatctggaggcactgaaggaaatctgggagtgtctggccagggcaaagcactgcttagagcttgcacaggaaaagcagtgagcccttcttttaagctggagaaagctttaaagatgcatctttggcaagtcttgccaaagaaatatgggttctaaatgtgataaaaccaaagacatcaagctggctctggaggccttgtttgaagtttgctgagtggattgtcagtgggaggctgatatttatatgtacaaacacacaagcattactgctaattgtggtaaatcaggctggccagcctggctctggggcccactgtgcctgccaccgcagcagtgtggaagccttgcatcccaggcacatgtcaggatcctcggaggccatcagccagccagcattgtgtgaattgcatttgggttcacagcactgtaattgtgtttctcctgctgtggtgagcaaaggaggaaaatggaaggaggaggtataatttgccctaggaaatagtcaggcaagtaggtggcacacaggggtgggatatggctaaaacactgaccttcccttgagagagaccatatggtgaagtggagagggcatggcgtttgtatcacacgaccttgtgttcaaatcctggctctgtcactggctgtgtgactttgggtcatttgcaaaacctctctgagcctcaactgccacttcttaaaatcagctctaagtaatcacagggttattcttcacaaacacagcatgcacatgcaaactttggcttagtaaataatggtttctccttctcttactttgttttctacataccccactccccttcctgtgaggagccttccacctttttctctgtgttctcttcctctcccattttcctggtagcattcaataaaacagaaatctgatttctgcaaagtaggccaccttacggtagaaatacatgattaggccccaccaaaaactttgattaggctattatcttctggatcctggatcccctccaaccaaaccaaacccaactagggctaaacacagcaatatatgaatacattgaatttctctctcactctttcttttttttaaaccagtttactcaggaatcacatgcacacatattttagcttccaaagccaatgatggaacaaattgtgtcccattaggctcactccattgtatgagttagcatcagaggagttcataccagagtgacttcatcttgaatagggcctaggtaagaagaggatgagacctgctgggctgcattcccaggaggttacacatttgtagtcacaggagagaaaggagttggtataggagttgatagatacaggtcataaagaccccagtgataaaacaggttgcaggccaggtttggtggctcattcctgtaatcatagtactttgggaggccaaggcaggaagattgcttgagcccaggatttcaagatgagcctggacaacatagtgagaccttgtctctacaaacaataattttaaaaacatgagctgggcatgatggtgcaggcctatagtcccagctactggtctgaggggcagttgggtggcaggctgagatgggaggatggaggctgcggtgagctgagatcaggccactgcactccagcctgggtgatggaataagaccctgtctcaaaaatagataaataaataaataaataagccagcaaaaccagaatgcagtgaagaagctggccaaaacccaccaaaacgaagatggtgatgaaagtgacctctggtcatccctactgcttattacacactaattataatgcattagcatgttaaaagacactcccaccagtgccatggcagtttacaaatgccatagcaatgaccagagatactctatatggtctaaaaaggggaggaaccctcagtcctgggaattacctgtccctttcagggaaaactcatgaatcttctaccgcttgttgagcgtataatcaagaaataactataggtatactcactcaagcagccatgcagttgctgtgcccatggagtagccactcttttattcttttactttcttaatatatttgctgtcattttactcttttggcttgctcttgaattccttcctgcatgaagccaagaacctttgtgacctcccaggctgaaccccaattttgagttccaccctatgacatcttttctggtgaccaatgaagggacaatggtaacctcccgttgactttaaattaaaactgattggcactgtttgggcttcaccggtgggtgagtctctccttgcccagattcaacttgctaacatttttttctcttcaattttggctcctttgtccttcctaatgttcttcattttggacagatgggaaagtggctgtgaggcctctggcttagcagcctgatagcagcctcctgttgtctgggtgccccagatgggagcacgcctggctggccacatcttttgcaacccaccttgtcatcccttctctgggaccttttctctttagtttcttttttaaaaaaaattttaaattatttatttatttatttatttttagagatagcatctcgctgtgttgcccaggctggagtgcagtggcataatcatggctcactgaagcctggacctcactggctcaagtgatccttccacctcagcctcctgagtagctgggactataggcatgcaccaccacgcctggctaaattttgtattttttttgtagagacggggttttgccatgctgcctagactggtcttgaactcctgggctcaaatgatctgcctgcctcagcttcccaaggtactgggattataggtgtgagccactgcacctggcctctctttagtttttaatgactggctgtttgacttctctgctcttcaggctgaaattcttatttcatgtttgtagtctttgccttggctatttggcaactgtttaaggcaagacacttggttttgagagttctcccgttgtgttgaccctgggacaccagggtcattgttctgtagctccaattatgttaggtctcatgcttttgggtttcactattggccaccccccagatgctctggggtttttggcatttggtgtggggacccttgttagctgatactctgggcttttcggcatttggatgctccagggtgtttggcactgacattcccctctagcattgtgggttagagtcccacccaggggaaatcttggttttgccttttcttgttttctactctaaagttatcattttctataaaaacattttcttttcttattgtcactttgtttaatgctttgctccaggaggtgggaatttgcaggggaaaataattgggctctccctatacttagaaaaacttctgtgtctagtagagatccttgttagacaaagggacagtggtgagtcccagagaactcgtcactagggtgccttttaggcaattggagcaaattcaaattagcaaactaagtttggccatttggataagtcccagttttgtcagggaaataatttgggtccagctatcttttataaaatagtgcgtttgcgttcctacattatggctagagctcaaagataaaagctattggatctttgtttatgtgtgtgtataaatgtctagatgtgtttatgtgtatgtacatttattatgttatatattgtatctacagggtaccaaattggcttataaataaaagagtgctcataaaaagagtaaataagtccaagcatttctcaagctcatgtaacttaagtttactaaaatttagagttactaaaaattcatatataactctgtataaatgtgccaaagaagatatgctcttagtgaaaataaattctttttggccaattcagatgtcatttatatgtggggtttaaaatatgaatttcgaaagaaaataaaaacaagtagaaagaaataaaaaacaataagcagtggagagagatgtgaggaaagttatgaatatgaagacgtatttttggtaaggaatgttataaagaaattttatgagaaaggatcttatatgataaattcttgtcctaaggtagaatgactgattgtttagaaaagaaggaaatataggacaagtcagaaagtccaagcatgttgtagatgacctatgtaagtcacgataaagtttatacaagagaatttattaaaatttagatgtaattagccataactgaaaggaaawttatttatttatttatttatttatttatttatttatttatgatttattttgagaaggagttttgctsttgttgcccaggctggagtgcaatgtcatgatcttggttcactgcagcctccgcatcctgggttcaggcatttctcctgtctcagcctcctgagtagctaggattacaggcatgcaccaccacacctggctaattttgtatttttagtagagatggggtttcatcatgtttgtcaggctggtctcaaactcctgacctcagttgatccacccaccttggcctcccaaggtgctgggattacaggcatgagccacctcatgcacccagccaggaaatttatatataatactctatctaaattttggtgccctatgttaaaacaagtttttcttcaagtattggtttgctttcagtaagattgcaagaaatattgacttttaattctagaatctgtttcctttgaaggcctctcagatttatatcttttccttttcccttgaaaaggtatagcctttgcaagttcaaaactgacttccctagactccttttaggaaaagcaatacagtggttgtttcaggctgtggctcaatagctaagcctttgttctttcatggtggtggcctgggttcagttcctggcttagagaatgagaggtttccagtttgctacttctgggacttttgtcatttatttattctttttgtctccatcgacagcttctgattttctcacttgaatttttttttctgtgagctaccttaagggtaatgttggatcttgtaaaaattgcttgccatctctttggagatacctcttgtgtccatggttaagttataaccttggttaaggcctgttggtttcactagggaaaatacctttaaaaaaaggcttaaaagccagagatgttggctatttgtcctggctagagtctggtattaagggatttaaaaggattttttaaaggacctctatagttataagtcagcttaattaaaaatggatattccatagtcatatttatatatatatacacacacatatatatgtatgtatgtgtgtatatatatatatttaaaagacctgtatgatttttttcttcttggaacttatttttttgagagaaagtgttttgtgtgtttgttgtttgtttttcttctcagtggactgaattatttctccattctgtctttttaccccctttaatgaccatattagaggacctaagataatttctgacagcctgggactccttgggaggaaacagaaggtgccacagacctcgttttgggagaaacctctgttttcctcatggaaccccaagagctgtaagcagagagttctccctcagaatccaaggctctgctctgtttacgtcacattacctgacctttgtgacttttgggggcatcagaaattactttgcattatgagggaacctttagcattggtgtgtattacctaggtaggatgtgtacttttagggattgcagttgcttacatgagtggttattactacagaccaatacttctttcttctcacatttaaatgaaaaaaaagcatgctcttgggcatccacctatgaatggaggatgggctgatttgctttaggttggccaccagcctttggggaacatcgttgcagtgaaatgcttggtgaaagcattgcactgtctgatcgcatagtgcacttctatgcacttctgcctgatgtcctaggctcaacacctgctacataattaagatcacttacttatcaggtttttaatcaaaatgaaatgttgctaagagttaacattatagcatatgtaattgagattactggagaaagttttacctacaagatatgtaaggaaagcaaaatgtgtttttggtaaaagattataggaaggtgtgccagtatagttttttattttgcttactttaatgggttaaaggattgttttaagtttgataggagaaagctgaagcatgagcaagttgtggaaggtatatgaaagattaacattttaaaagaaattctgtgtgtaaacattggctaaagttaaaggaggaggttggagccaagatggctgaataggaacagctccggtctacagctcccagcatcagcgatgcagaagatgggtgatttctgcatttccatctgaggtatcaggttcctatcactagggagtgccagacagtgggcgcaggacagtgggtgcagcgcaccgtgcgcgaaccgaagcagggcaagccattgcctcactcggaaagtgcaaggagtcagggagttccctttcctagtcaaagaaaggggtgacagacggcacctggaaaatcgggtcactcccaccccaatactgcgcttttccgacgggcttaaaaaaaggcacaccaggagattatatcccgcacatggctcagagggtcctacgcccacagagtctcgctgattgctagcacagcagcctgagatcaaactgcaaggcagcagcgaggctgggggaggggtgcccaccattgcccaggcttgcttaggtaaacaaagcggctgggaagctcgaacagggtggagcccaccacagctcaaggaggcctgcctgcctctgtaggctccatctctgggggtagggcacagacaaacaaaaagacagcagtaacctctgcagacttaaatgtccctgtctgacagctttgaagagagcagtgattctcccagcacacagctggagatctgagaacgggcagactgcctcctcaagtgggtccctgacccctgacccctgagcagcctaactgggaggcaccccctagtaggggcagactgacacctcacacagccgggtactcctctgagacaaaacttccagaggaatgatcagacagcagcatttgcggttcacgaaaatctgctgttctgccgccactgctgctggtacccaggcaaacagggtctggagtggacctttagcaaactccaacagacctgcagctgaggatcctgtctgttagaaggaaaactaacaaacagaaaggacatccacaccaaaaacccatctgtacatcaccatcatcaaagaccgaaagtagataaaaccacaaagatggggaaaaaacagagcagaaaaactggaaactctgaaaagcagagcgcctctcctcctccagaggaacgcagctcctcaccagcaatggaacaaagctggacggagaatgactttgacgagttgagagaagaaggcttcagacgatcaaactactccgagctacaggaggaaattcaaaccaaaggcaaagaagttgaaaactttgaaaaaactttagacgaatctataactagaataaccaatacagagaagtgcttaaaggagcagatggagctgaaagccaaggctcaagaactacatgaagaatgcagaagccttaggagctgatgcgatcaactggaagaaagggtatcagtgatggaagatgaaatgaatgaaatgaaatgagaagggaagtttaaagaaaaaagaataaaaagaaacgaacaaagcctccaagaaatatgggactatgtgaaaagaccaaatctacgtctgattggtgtacctgaaagtgacggggagaatggaaccaagttggaaaacactctgcaggatattatccaggagaacctccccaatctagcaaggcaggccaacattcagattcaggaaatacagagaacgccacaaagatactcctcgagaagagcaactccaagacacataattgtcagattcaccaaagttgaaggaaaaaatgttaagggcagccagagagtaaggtcaggttacccacaaagggaagcccatcagactaacagtggatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattctgtcaccaccaggcctgccctaaaagagctcctgaaggaagcactaaacatggaaaggaacaaccggtaccagccactgcaaaatcatgccaaattgtaaagaccattgaggctaggaagaaactgcatcaactaacgagcaaaataaccagctaacatcataatgacaggatcaaattcacacataacaatattaactttaaatgtaaatggactaaatgcttcaatcaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaggaagagctaactatcctaaatatatatgcacccaacaatacaggagcacccagattcataaagcaagtcctgagtgacctacaaagagacttagactcccacacaataataattggagactttaacaccccactgtcaatattagacagatcaacgagacaaaaagttaacaaagatagccaggaattgaactcagctctgcaccaagcggacctaatagacatctacagaactctccaccccaaatcaacagaatatacatgtttttcagcaccacaccacacctatcccaaaattgaccacatagttggaagtaaagcactcctcagcaaatgtaaaagaacagaaattataacaaactgtctctcagaccacagtgcaatcaaaccagaactcaggattaagaaactcactgaaaactgctcaactacatggaaactgaacaacctgctcctgaatgactactgggtacataacgaaatgaaggcagaaataaagatgttctttgaaccgacgagaacaaagacacaacataccagaatctctgggacacattcaaagcagtgtgtagagggaaatttatagcactaaatgcccacaagagaaagcaggaaagatccaaaattgtcaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagaagaaaagagagaagaatcaaatagacgcaaaaaaaaaaatgataaaggggatatcaccaccgatcccacagaaatgcaaactaccatcagagaataccacaaacacctctatgcaaataaactagaaaatctagaagaagtggataaattcctcgacacatacaccctcccaagactaaaccaggaagaagttgattctctgaatagaccaataacaggctctgaaattgtggcaataatcagtagcttaccaaccaaaaagagtccaggaccagatggattcacagccgaattctaccagaggtacaaggaggaactggtaccattccttctgaaactattccaatcaatagaaaaagagggaatcctccctaactcattttatgagggcagcatcatcctgataccaaagccaggcagagacacaaccaaaaaagagaattttagaccaatatccttggtgaacattgatgcaaaaatcctcaataaaatactggcaaacagaatccagcagcacatcaaaaagcttatccaccatgatcaagttggcttcatgcctgggatgcaaggctggttcaatatacccaaatcaataaatgtaatccagcatgtaaacagaaccaaagacaaaaaccacatgattatctcaatagatgcagaaaaggcctttgacaaaattcaacaacccttcatgctaaaaactctcaataaattaggtatgtaaatgggacgtatctcaaaataataagagctatctatgacaaacccacagccaatatcatactgaatgggcaaaaactggaagcattccctttgaaaactggcacaagacagggatgcgctctctcaccactcctattcaacatagtgttggacgttctggccagggcaattaggcaggagaaggaaataaagagtattcagttaggaaaagaggaagtcaaattgtccctgtttgcggatgacatgattgtatatctagaaaaccccattgtctcagcccaaaatctcctgaagctgataagcaacttcagcaaagtctcaggatacaaaatcaatgtacaaaaatcacaagcattcttatacaccaataacagacaaacagccaaatcgtgagtgaactcccattcacaattgcttcaaagagaataaaatacctaggaatccaacttacaagggacgtgaaggacctcttcaagaactacaaaccactgctcaatgaaataaaagaggatacaaacaaatggaagaccattccatgctcatgtgtaggaagaatcaatatcatgaaaatggccatactgcctaaagtaatttatagattcaatgccatccccatcaagctaccaatgactttcttcacagaattggaaaaaactactttaaagttcatgtggaaccaaaaaagagcccgcatcgccaagtcagtcctaagccaaaagaacaaagctggaggcatcacgctacctgacttcaaactatactacaaagctacagtaaccaaaacagcatggtactggtaccaaaacagagatatagatcaatggaacagaacagaaccctcagaaataacgccgcatatctacaactatctgatctttgacaaacctgagaaaaacaagcaatggggaaaggattctttatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacatagggcatgggcaaggacttcatgtctaaaacaccaaaagcaatggcaacaaaagccaaaattgacaaatgggatctaattaaactaaagagcttctgcacagtgaaagaaactaccatcagagtgaataggcaacctamaaaatgggagaaaatttttgcaacctactcatctgacaaagggctaatatccagactctacaatgaactttaacaaatttacaggaaaaaaacaaacaaccccatcaaaaagtgggcaaaggacatgaacagacacttctcaaaagaagacatttaagcagccaaaaaaacacatgaaaaaatgctcaccatcactggccatcagagaaatgcaaatcaaaaccacaatgagatagcatctcacaccagttagaatggcaatcattaaaaagtcaggaaacaacaggtgctggagaggatgtggagaaataggaacacttttacactgttggtgtaaaagtgttggtgggactgtaaactagttcaacccttgtgggactgtaaactatttggttggtgggactgtaaactagttcaacccttgtggaagtcagtgtggtgattcctcagggatctagaactagaaataccatttgacccagcaatcccattactgggtatatacccgaaggattataaatcatgctgctataaagacacatgcacacgtatgtttattgcggcactattcacaatagcaaagacttggaaccaacccaaatatccaacgatgatagactggattaagaaaatgtggcacatatacaccatggaatagtatgcagccataaaaaatgatgagttcaggtcctttgtagggacatggatgaaattggaaatcatcattctcagtaaactatcgcaagaagaaaaaaccaaatgccgcatattctcactcataggtgggaattgaacaatgagaacaacacggacacaggaaggggaacatcacactctggggactgttgtggggtgggggtagtggggagggatasctttaggagatatacctcrtgctaaatgacgagttaatgggtgcagcacaccagcatggcacatgtatacatatgtaactaacctgcacattgtgcgcatgtaccctaaaacttaaagtataataataataaaataaaaaaatttttaaaaaataaagttaaagggatattattattattatttttgtaagttaaacattaggattaaaaagcacaacagagttttctagagcactgatctactctgtaacagaaaattgtaaagggtttaaaaggtttatgagaatcttaccttatggtcaaactggttaagattgggaagatttgtctataaagttttattaagaattgggtttgacattaatactacactaatgcaaacgtgaaatgtggctttctctcttgaataagattttcatgtattattacaagataatgaaagatttttatttgctttttaaataaactataggaaaaataagggagagaaaagtgacagatcatttggaaacccaagtctcccctatatcaatgagtaaaagtttttacctttttgaaatctttgagttatcattttggctaaataaatgctttatggtgacctgggattctattttgtaatatcaactgtttaaaccttttgtatttgacaaacgttccaaactgaaattctaatgtaagtctttttctgacctgattagtccttctagatattaggtcccctaaagtccaaaagtgacatatttggcttattagatatattaaaatcatacaggaagcactttcaaatataaaatgctatttggctttctttggactatacttatataaatgtgttattggtatatgttccaaaattatgcaaaactcctataattctgatatgacttagtgtacattatcagtcataattatagttcttatgttacattattgtgtgctacagagttaaccaaatttctttgtcaattgcatctttaatcagctgtcctaagacttttgtcacccacagacaattgtcttgttttaatccttttcaaaaggtggtttataatcagctataggactctgatgggtactctaaaatgcaagcctctgataactttgaaaattgtgccattggctgggcatgatggctcacaactgtaatcccagcactttgggaggctgaggcaggcagatcacgtggggtcaggagttcaagactagcttggccagcatggtgaaatgccatctctactaaaaatacaaaaatcagtcaggcatggtggcatgcacctgtaatcccagttactcgggaggctgaggcaggagaatcacttgaacctgggaggcagaggttgcagtgagctgagatcgcaccattgcattccagcctgggcaacaagagggaaactccgtctcaaaaaaaaaaaaaaaaaaaaattgaaaaagaatattgtgccattgaaacagaaaagaaaacacaaataaacttccaggattctcatagaaacttaatatattcataaggaatgtggcccaatatcaggcaaaacaagagttaacagcatggactaaactaataaaagaccaaaacaatcttttartgactttttgcttaaaacattgcatatcctttctgttttgcttttcagagtcaagaaaacttttcctttggaaagtatttactgcttttaacaattgaaaaaagtatactactatggacaaaatttggagcatatgtctttctttttacctgatttctccagaatttgaaaactatttgggagtattcttaactaatagcaatatagttatttgyctaagtgcagtaagaatcttttcttttgtaataggacacaattaaagaaactgcttattttatgaaggctttgactagaatggtgtgctttcagatacaaacagactgctttaagggatcaaagttgacttatagagccaataaaagccactatggaaaactggccttattctttgtctatgcagtctctgtatggggttcctgacctgtggtaagtgaagaatgtcactttctgacaggcccaggagccccaagttatcttgggacatcaagaagaaaggaatgcacccaacttatacaggtatttgcaggcacagataaatctgtggctggctcaaggctttaagaagcctaatgtgagattctttttaaattaaatttccatcgaaaccaattttaacaagagcctatgtggcaaataattatttttgctgcactttatacaaataatcaggccaaatttcataagattaaaactttatggcaaacaaatttgtcccactatgatttgtctttggtaaaaatggaagctagagagagaatttgtttcaaaaactatgatayaccagttattagattctagtctcgtctgttgtttttgagtttcttctgcaatttaggcagaccctgcttattcctgagaatcaaccagtgatctatggctgttgctcagaagaaataagagggatggctaacgtaaagatctggattagtattctaattctaggcatgtattagaattggctagtgaccccatatcagcttggttttaacaattacccagttcatggaaagccttcttatttagtttacttgggataattgtgctgattttgttttactgttgtggaatatattgctgttgtcctctttgtgtaggaatgcaggaaaagcttacttaacattttcttaaattgaacacttattaatcttccagatttcaccttttgtcagaactcagagttatgatttgtcctcactgtactgacaacaggctctggtagggtgcagaggtcctggtaaacacaccctctgctggaaaacagggagaagtttccatcagtgtaagcctgcacttgggttgtctgggctgaagttaggagactgagtagaacatttgctgcagaaaaaaaagaagatgtgtaattttcacagttagaattaacttaggagagctgaaattaactgagcctcggaaatctgaatcttgaagtcaccagtggcttttgggactgtgagagagtctcttgtggtctttaatcatgtgagggtggggtgaaattcaatattcagtggttctgcaatgggatgcactgtgcaattggtgattgagaagccaactctctggctttaggagaagaatgtcttgctgttagtccttctggaaatagagccttgcattgcctactgtctgtttacactacctttgcacattgcctttggttatagagtcatgtccaatggctctttacttctgtttgcagggcaggagatggcaccctgttaaagagaaaggatagtagctgcaaagtcatttgtttctctgtttctgtgactgtatatattggctcatctttgaatggtctttatagccacaccaggctggaggtaacagggtcatgggagtggactgctggtgtgggctaaatcagagttcagatccatgtctccaagaggtaggaagtgcagggcaagttatgtggcttctggggcatccctcactttcttagttaaagagaagttgaagtaatcattctgaaatattatgggagtctgcagaaaaagtaatgaaaaccaaagcactttccattaatctccataatttagtccttacgataatgtcacagggcaagcaaccaatcagaccttactagtcgtgcttcctagaagagactgaggttcagagatttggacagagtgtcagatatgggatcagtggctagtccaatgtgatttccatcctttcttctgagagaaagcataagaaggctaagaggatgggggtaaagcacaagtcacctgcctgagagtcaacagagcaggggtctctttctcagtttgtttctctaagttatggcaaaagctttttgagctgtgattattgagaatgggggctgaagttcaacacatagttggcatgagagaagtaattatgattgaagaaatctagatgaaatccattgttcttttctgtaaaggggttgttatccctgattctttttttcttttttcttttttagatggagccttgctctgttgcccaggctggagtgcagtggtgtgatcttggctcactgcaacctctgcctcctgggttcaagtgattctcatgcctcagcctttccagtagctggaactacaggagtgtgccaccatgcccggctaatgtttttatttttagtagaggtggagtttcaccatgttggccaggctggtcttgaactcctgacctcaagtgattcacccaccttggcctcccaaagtgctggaattacaggagtgagccattgtgcctggcctgttctcactgattcttatagtgccatgtttctcagaatttgtggcttcaattacttatatttgtgcacctgacttttaggtgagctccagaatagcattactaattaagaatgagcatttagagtagaaaaagtgacaggaacagcaagactcacttccagaaagcctcactacaggtctaataggtgaggaaagtccccatctttcccatttttcttcattacctccctgtggggcaagcactgccattatgcatgagtaaactgtctgagttatagataagtaatgacatgaaacttcacaaacaggcctagatttctacccagggaaccgctgttatcagagaagggagtttggaatcttaagcaacaaacacatgttgattctcagtatttgcctcctgatggcttgctcagagagcctgttttcattgcccactttatatgtcagtaaataatcttccctggcagtgggtccaccatgtctggatgcacacrgggaaatctggtggggtctggccagkgaaaaacactcctcaggttttgcaggaaaagcagtgaacccttcttttaagctcgagaatgctttaaagatgcatcattggcaagccttgccaaagaaatacgggatctaaatgtgataaaagccacgacgacatcaagctggctctggaggtctcctttgaagtttgctgagtggattgtcagtgggaggctgatatttacatgtagaagcacacaagtgttactgctaattgtggtaaatcaggctggccagcctggctctggatcccactgtgcctaacaccagccctgcatcccaggcacatgccgggctcctcagaagcgatcagccagccagcattgtgtgaattgcatttgggttcacagcactgtaattgtccttctcctgctatgaggagcagagagggaaaagggaagggagggttgtgtaatttgccctaggaaattgtgggggagggacaggcactgggccgggtggggggcggtgcgacatggctaaaacactgaccttcccttgagagagaccatatggtgaagtggagagggcacagcttttgcatcacacaggccttgtattagaattttggctctgacaccagctgtgtgaccttgggtcatttgcgaaacctctctgagcctcaactgccccttcttaaaatcagctctaagtaaccacagggttattcttcagaaacacagcatgcacatgcaaactttggcttagtaaataatgatttctttttgttctatctactccacctccctttcccattagaagcttgctacctttcactctgtgttttcttcctctcccattttcctggtggcattcaataaagcagaattctgatttctgcaatgtaggccaccttagagcaaaatacatgatcaggcaccaccaaattaggctattatctactggatcctgtttaaccaacccaaacccaactcaggctaaatacaggaatacaagaaaacgctgaatttctcccctttctttttttttttttttttgagacagagtcttgctctgtcacccaggctggagtgcagtggcgcgatcttggctcactgcaagctccacctcctgggttcacgccattctcctgcctcagcctcctgagtagcggggactacaggtgcctgccaccacgcccggctaattttttgtatttttagtagagacagggtttcaccgtgttagccaggatggtctccatctcctgatctcatgatctgcccgcctcagcctcccaaagtgctgggattacaggcgtgagccactgcgcccttccctccttttttttttaaaacaacaacaacaacaacaacaaacagtttattcagtaattatgtatacgtattttagcttccaaagtcagtgatggaacaaattgagtcctattaggcccactccattgcatgagttagcatcagaggaggtcaaactagagtgacttcatcttgaatatgggctaggtaagaagaggatgaggcctgctgggctgcattcccaggaggttaggcatttgtagtcacaggatgagataggagttgggtaggaatggtttcataaagaccacaggatgcaagctgggtgtggtgccttatgcctgtaatcccagtactttgggaggccaacgcaggaggattgcttaatcctaggagttcaagaccagcttgggcaacatagtgagacctcatctctacagataatttttattttattttattttatttttttgtgatggagtcttgctctgccgcccaggctggcgtgcagtggcatgaccttggctcactgcaacttctacctcaggggttcaagcgattctcctgtctcagcctcctgagtagctggaattagaggcgcacaccaccacgcctggctaatttttttgtgtttttagtagagatggggtttcaccatgttggccaggctggtctcgaactcctgacctcaggtgatccacctgccttggcctcccaaagtgctgcgattacaggcatgaaccaccgtgcccagcctctacaaataattttttttttttttgaaatggaatctcagtctgtcgcccacactggagtgcaatggtgcgatctcagctcactgcagcctctgcctccctggttcaagcgatttgccttacaaatgatttttaaaaaatgagctgggtgtggtggtttcacaagatacgggtgataaagaccccaggatgcgggccgggtgtggtggtttatgcctgtaatcccagcactttgggaggccaaggcaggaggattgcttaagcctaggagttcaagactagcctggacaacatagtgagacctcatctctacaaataattttttaaaaatgagctgagtgtggtggtgcaggcctgtagtcccagctcttgggctaggcatgggggtcagctcaggtgggaggattgcttgagcccaggagttcaaggatacagtgaactatgattgtgccagtacactccagcctgggcaacagtgcaagaccctgtttcataaacaaattaaaaaaccccaaaaacctaggatgcaatgaagaaggaagccgaaacccaccaaaaccaagacggtgatgaaagtgacctctggtcatcctcactacccattatatgctaattataatgcattagcatgctaaaagataccaccagcaccatgacagtttacaaatgttgtattaatgacaggaagttaccctatatggtggaaaaaggaaggaaccttcagttctgggaatttcctccctgtttctgggaaaatcatgaataatgcacccttagtttagcatataatcaagaaataaccataagtatactcagttaagcagcgtggctgttctgcctatggagtagccacccttttttattcctttattttcttaataaatttgcttgaattccttcctgggtaaagccaagaacccatgtggcctcccatggtgatctccaattttgggattcaccatgtgacattaggagcaacttagggatctggtgcatcccaggccaagactaacatggtgatttttggggggttatgttaaaactgggggctctgcccaggcccctcagtgtggcttcttgagtcaatacctgggtacttactggccctagcacctacaagttcattcacagttccttctcactgacttcaccagtgaccactatcagtgacttcaagggagaaatgaggggggagataaaataaagtgaatggggaagagataaagaagagaggtcttttcacagtttgccagaatagtcccttcagtggttttaccccagggcaacaggagcccccttttagtttctttctcttttaattttcttttcccttcccactttttgcccactttttgccttatttgtgtctgactcaatttccgtctctttctctacttcttcattcccagatttggctgtagaaaattagaaagttcttgaacttggtttgcacgggtgcttttactttaacatgaaaatgaatgatcagcctccttctaatttcatcctagagtctactgcatccctcctaccccctgcacaggaatttagtcacacttatctctcccactttctctcccttcttcactttctctattgctcctcctttcatgcttgtacctgcttttccatgccctgtttagcctggcttgggatccagcaggttctccaagggttyctgcaagaaccccggctgggtgcccaggtctgagcctggtatgtgcctcagtatcacaaaggcctcctgtaaatgacayacattgttggaagtttcagaaattctaggtcaaaatggcactgaaatattaaggtatttaccccaacccaagcaacttttctaaaagttgtagagagtgtgacctctttattaattgaaacgtgaaaatcrgctctagtttggaagctgagaaaaaatatatatatatgtatttatttctttgttgtttgaattcttaatataaatggtttaaaggaccattgaaaactgcatgcaatcacagaaggttttggcttcaggcagctcccgccatgatcttggggccccattgattctttcatctttcrggcgtcttactgtttgaaccttgaattttaacctgggacatgtttgactaaaatgatgckgttmatrttttctgttgtgcaaaacacaaagagaactaggctycagggttgtttctatttgctaatgctgtttctgttgacttttgacttttctagtttcccagagctatggggacttcccatccggcgttcctggtcttaggctgtcttctcacaggtacggagcccagtcctctctgagttccttgtttgggtgtcttgtttttttaagctttgtgctgcatgggtttwttaccagtactctgcatacacagtccaaragagtgaaaagaaatagaaaactataggacgttatccagaatgaccacaaaccttcagttccctttgctgtattgcacttactccatttcaaaaggaatgctctccagtggcagttttagtacatatataatgttggcattgaaatgttgttagtaataatgtctaaatttacttactactctcttccttttcctaggacaaggcttctattagagctggattagataaattcaggaatggtcagctgtgggaggtggcacatctgttgtcccagccccttgagcagctgaggtgggatgatcccttaaggccaggagttcaaggttgcagtgcactgtgattatgcctgtgactagccaccacactccagcaacatagcaagacctcatttaaaaaaaatgttcaaaggaaataaataatagaaaattcttgcccaagaaatcatacttgtcttaaatcataactctcttgaggaaagatgcttacattgcttctaaatctcagagtcacctttatcttctctaggaatcaaattgatagatgaatgtttggctcttggaaaatcttaaaaactttcccaccaaaaggatcattggggtaatttgttgaagtgtgtattggactgtcttagttttcctccagatatttatgcactgcagatgttcgccatgaaaccagtgctcttctattctgaggagttagctcagcccgttagtgtctttgtcttacccatttggatatggtagaattgagcaagaccagagattcaacagttctaagctccactaagtataccccatctacagagtaataggtgatccagatgtacttacaaatcctatcttaacaagctttaggaattatagtggtcatatattgaagttgggtgggagtctcacaccaggttccaagggagattacaaatcactaattaataattaagtcataatatctcttctatcagtctcgggtttcttgttttctaagttctgtgctccatgggtttattatctgtactctgcttacacagtccaaaagagtgaaaagaaatagaaaactacaggacgttatccagaatgaccacaaaccttcagttcctttgctgcattgcacttactctattgcaaaaggagtaagtgcaatttcagtctaaataagcgagactgaaatttgagcttcgaagatgaacttagagttttcactcttgggttttacttaccaattgtgaattaaaatccgtatcatctggcaccactgcactccagcctgggtgacagagcaagactccatctcataaaaataaagaaataaataaacaaataaatccacatcatcctgctttggccctggaagtcatgagggagagacggcatgcccgagggctataagaaatggaagatgtggaattcttgagcacagatgtgctttgtgttttcttcagtctgtgtccttgcctccattcttattccatgtgggktttttttttttttttttttttttttttgagacagggtctctcgctctattgcccaggttggagtgcagaggctgactgcaacctcaatcccctgggctccagtgatcctcccacctcagcctccagagtagctaggactacaggtgtacaccagcacacctggctaatttttttatttttttattttttgtggagaccaggtctcactacgttgcccaggctggtctcgaactcctgagctcaagcgatcctcccacttccacctcacaaagtgctgggattatagacatgagcctctgcgccccagcctcatctcattttaactaaaggaaacctttgcagtgattgtgaaccataaagaacccatatgtgcttgagcccgtgccatcttgggatattttatggttacacataagagtctgaaatatggaattggaatcagacatcctctgtctatttgagtgtttggaggggtgaatctagtggggcttggtggagctatttggaacatttgctgctctcagcagatgcagtggctgttataatgggggagctttcatgggcatccaggctaacggatttttgtgtagaaatggtcattgttcatctaagctgctactgttgcttctctcagttgtcgggatgagactgtcctttctgactgcatcctattcagagcgtgcttccttttgcagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctcygatgtggaaatcagaaatgaagaaaacaacagcgrcctttttgtgacggtcttggaagtgagcagtgcctcggcggcccacacagggttgtacacttgctattacaaccacactcagacagaagagaatgagcttgaaggcaggcacatttacatctatgtgccaggtgagttggctgggtctccaggaccaagcttcttctcttcctgtctctcctgttaaatgtactaaggttttaaacatatatataaataattaatatttattgcgggaagtttgaaaaatgtaagcgaacacacacaaaaatcatttgtaatattatcaagaaatattcattgttagcatttcagagctgtattaagtttggaaagtcatctttgttatgacatgtcctgtattgatactgtataaacaatctgaaatatactcatctctattcagttcattcaagttgcacacatactcacagtgtgtccagcactgggctaagtgttgagtacacaaaaattaataggtaagccctgtcttggagttgctgatagttcattataatatcttccaaataaacactcgatttttcagattcactatcaacatacatttattcttggagagttggaaggaattttctttttccttttaaaaaagttacatatatatatatatatatatatatatatatatwtttttttttttggtaacagggtctcactctgttgcccaggctggaatgcagtggcatgatcatcatagcttactgcaatctcaactcccttggttcaagcgattctcccacttcagcctccccagtagctgggattacaggcatgcaccaccacgcccagctaatttttatattagttgagacgggggtttcaccatattgaccaggctggtcttgaactcctgaccttaagtgatctgcctgcttcggcctcccaaaatgctgggattacaggcgtgagccactgtgccctaatttttatttttatttttgtagagatagggtttcactgtgttgcccaggctggtctcaaactcctgggctcaagtgatccacagccacctcagcctcccaaagttctgggattacaggcacgagccactgggcctggcctactcctgcattttaattaaaaggacaaaagggtcgagcacaagtgatggcaatttcagtatgcagttgggtaaattaaaaaggactatggctagaatccttggttttagaacaaaacctaaactgtttatgattcttgccatccttgctgttttggcataggtgtgtcttcctacctttctgccttttctttttcagtttttaatgggctcctcttcctaccctctataactacgagtgtccccagggatctagaccctctttactttttcatgatactcttattcatatgaaccttccttcttaacaattaaaaaaaaccaaaaactttgttttgaaaagggaaggtatttagaatgtcactccaacttcattcacacttagattccttcaggaaaatcctctaggtgtggagggattttcccctgctgtgaagagaatggtaggaacgtgaatgtgttaaaggcacacgagtccctgaagttttaatccgtgtaagattgtccaaaaattcttcttgttccagcacagatgccatccaagtagcccctgcatcgctgtctgactgagatctttttattcgcaatcatgcagacgtaggggccctttctgcagctgatgtttgagactgttagaacttcttaccaccgtagcttaagtagctgtttttcttttggaaaggaaattctcaggctccttctccttctttaaattttatgtatttctcaaaggattactttttaataaacagatttctatgctatttttgaatcatactgactataggtggtaagagtttttaaaagcatttcataataaaactcgaaatattttttcctgttttaaacagagttggactgtattattttattgttaatttttgtttttagttgtttaaattttgatttagattcctggttagtatttatttatttatttgtagagacagggtctctctatgttgcccaggctggtctcaaactcctgaacacaagcaaccctcccaccttggcttcccaaagtgctgggattacaggcatgagccacaactcctgtccagtattgatatttatcatcagtattatccatcaggagacaggcaatttggtattattcatacttaaaaatcactttgtagctgtcatgataactaatgccagtggggcaattcttctggatatatgtgtaaaggtgaacttcatacctaatatcaataatgccagtgggatagtttttctggatttatgtgtaaaggtgaaattaatgtctaatagagtcttcattcttttttaaaccacagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaaygtttatgctttaaaaggtacttgtatcatctccttccttctttaaataagagtaacaggcaaaatcataaggtgcrtgtaggatttttttttttttttaaatcatcatcactggtgatcctaaattctgatttggggatttaggaccccagctaatacaatgtctgtggctataataataagcttaaaattactaaaggccaaagcttgattacccatgcaagatttcatgtttcatcagttgacttcaaaatactgtaaggaattcttttcttacataagcctcttactttcattcacattcctgactatggcggccctaaaaacaaacatacacccagggggttagatgcctagattaattttagtaacttaagaaaagtgatttgaagaaagtagtttagacttcaaccctttgatgtccacagttagtacgcttggggaagtataatacatgctgaggtcaacagatatttcctgaacactatattacatggaggaatgggtagcagcaagagtacactgttttaaaatcagagcacagctaattttgtgccaggcactgtgctaggttctgggaaagtactgagaataactgaggagcagagtggaagagaagaagagaagaaacaattggatagaaacaaagtgtctagagcagtgtggatcagcaaatgttggttgattaaatgaataaatttattagtcaaggagattgtggacgagtataaccataactaacccactgctgaggaatgcggtgttctgtttgattggaatttatttttattgttattattttgtaattctgtattataactatatgcctaattgttgtacaccatctcacaatcaagccttgtgagattttccaaattttatcttgatcaaactggtttgcaaattatttttcagggttttyttaaaaaaaaaaaaaaaaacccaaactttataagatcctggctatcctgtggatttttaggcccttgtatttgttcttttttatagcaacatcagagctggatctagaaatggaagctcttaaaaccgtgtataagtcaggggaaacgattgtggtcacctgtgctgtttttaacaatgaggtggttgaccttcaatggacttaccctggagaagtggtaggtaccctcaaaacgtgcaatggcttggagcagagcaacagggctcaraaracctgcatttgagctcggtctgtcactgatgggcacatcactgagtttctctagaccttagcttcccacctctgggatgaacacatttgattaaatggcctttaggactccttgatcaatgggagagtttgaaatgatagttcctggaccaggcccttcagaatacataaagagtgtgccgtaagccttctttttcagaagtcagacagaaataggaaggttctctggctacaagatatcaaccaaaaaattagaagagcaaaaaaaccactggattttactattgcggagacagtgattgattctcatcgtcttggcttctgtgccctgaggtttgattcatctgatagtgttgattgcccgcaccccttcctcttctgccttgttggcacccaggacaatgtgtcttcctgttccacctcctatgtgcctgacctttgcatggctcaccttcagtgaaccgttatgatgtaatcattcagcaaaggtttaatgaagtttgctcaatcccaagcactgtaccagaagctggttcagtattgcaggaagaagggaggaggggagatggaagtggggaaggggagccaccatgctgcctcttggtcactggagatttacagagtctcagtcattctaatgcattgtcactaagtgtgtaagacagccatgtgtaagaggctatgaatgcccaaatgcaggaatgactaatattcttatggagaacaaaaacgagatatatatatttcttgcctccactcctgacttgtaaatttctgctccctgttcttttaggcatttgacagctttctgtccttctatccattgatctccctccttttatccgtttctctctcccatgcatttgccgctgcttttcatttgtcctggggcatctgataggaagttgggcattttcactattgcctcacaaacttcacacagtgaagggacatttacagtccaacaaatgtacatcttccctgaaatatgaagtgatttggttcttctgttcatacttgattgactttaatccttaacacataaacactgctttytatttataggagacagcaatttttttttccaaaccgaagtacatgctatttggcttacaaatatataatcaaagtattgtttcatacagtatgttttttccgattataaaagtaatgcaggtttattgcagaaactttgtaaaatatggagagacaaaggaaaggctacttcccagagcatcactgtttatattttagggagataaagcttttatttttcatttgtatttctttcttttttttttcttttttcttttttttttttgttgtggagatgaggatctcactacattgcccaggctggtctcaaactcctgggcttaagtgatcctcccaccttggcctttcaaagtgttgggattgattacacatgtgagcctctgagcttgactgagataaagctcttaagtatttcttatccatagataaacattgaataataggtgttattctttaaatggtaatttattacattctttatccttcagcagtatagcacaaacaccttatatgtgtcattaactgtccttttaaaaaatgggctgggtgtggwggctcatgcctgtaatcccagtactttgggaggctgaggcaggagagtcacttgaggccaggagtttgagatcagcctgggcaatgtatcaagactccgtctctacaaaaatttttaaaaattagccaggtgtggtggcatgagcctgtagccccagctactcaggagactgaggtgggaggatcacttgaacccaggaggttggggctgcagtgagccatgattgtgccactgcactccagcctgggcagcagagtgagattctgtctctaaaaaaattaaaaacaaaataaaaaatctcatgattttctaagcagctagcttttattctttaggttttatcttttagagcagttttaggtttacagcaaaattgagaggtacagagatttcccatgtgttccctacacccacacatgtgtagcctcccaccttgtcaacatccctaccatccatttgttataactgctgaacctccattgacacatccatatcatccagagtccatagtttatcttagagttcactcctaggagcgagctttttaaaagtcggttttcttccccttttgctgtagaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatggtacattccgctttctaaaatgtcagttgtccatgctgctcgggatccatatgtggtaatcattatttaatggaaactcttccctgtrcagagaaaggkttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtaaagaaactctctgcccaagtatgcytttttttagtgtgcatcagaggyrgactgaggtttgtgtgtgtcttacaacccagacccaaagtcagtctagaaaatgtaacaatctgagttaagagatgcttgaaatcacatccctttaatgataacattgcaaagtggtattagtatgctggtaagtatttaatgagaagatgagaagaaagaactaaaagctctggcccctggggaaagacaggtcactggattcagctagggtggaagaaaggaagtaaaattggactcaccaggattgaatagattgaatatattccctgatgttcatcatccatatcgcaagtagacagatatggtgattacacccatgaggcagttatcacatcaccttacgtgaaagttaacgtcataggcttaatctggaacccatttgccctaattgaggactccacaggaaagaagagtagagcctggctaatcaggagagagatgtgcagtgagttgcttggatccctaccttttaatcagaatggtagattgctctcatctcttaattggtggtggagttttgaatgagtcacccctcagccacagtttcctcatctacaatgtaggataaacaataccttatgtccttcaaggcaaggaattggatcagatgatatcatgaggcctcttaaggttttaagctgtgattagaacccaagagtcagaagrtacatctcacagcacccagctaaccagccctatacttttgtcagaaatcatctcagaaagacaaagtcagtcctgtatttcaagccttcaggaggaagaacagagcctttctcatcagttccattcacctcaggatttgctttcttctttgtgaactaaattccacgtgtaattgagaagcaatgtctgagaaaatggaattttacagcctctatagaatagtaaaggaaaaatgaagtgggatactgaatctggaaggctttctgttgacacaaaatgaaggtgtacaacaaggagggcagctttccacgaggaacttccatgaggctgtgcagccagagaggaatagggtaacaaccctggtacagctaacacctccaacacgtgtgtgagcactgtctgcaagccataatccatagcagtggcaggacaggctcgccaactgagtggttctggaaagctgccttttccttttagtgattcaaggatgcttcaacgtggattttttagttcctgttatgagccagtgaatacaaagatgaacatggtagatgggggatctggcttcctggagcttaaaactccaggatgggggatctggctttcctggagcaagaaaaccagtggttttcttggccgaagaagtgaagagaacaaacagcagaggataatttggtaatcagcatcctagtgtgccccagggtactctcttaaggaaatccagtcctggagcacacccagtatggtccagcctgctgtcttcgtaggtctgagtgccccagtatttgcaaagtgttttggagcctatgaaatgctttcacacatacaatctcctttaattaactctcacaatgactctgtgctatgtgtacaattatcacgttttacacacaaggaaactgaggcatggagcattgtaataatacccgagatcttctcactccatgaccaatgcttttcttctccattccagttgctttttcaactgtgatgatttataaaggacaatcaaatgggcacatactatatttatgcacatacatacacacacacacacacacacacacacacacaaccagatgtcatttataatccatgtaaaatatttttggggaagtttctctttaataaagtttgaagagacatatattttttttttttgaagaggcatattttttctaacttttttttttttttttgagatggagtcttgctctgtcacccaggctggagtgcagcggtacgatcacggctcactgcaacctccgcctcctgggttcaagcgattcttcagcttcagcctcctgagtagctgggattacaggcatgtgccaccatgcctggctaatttttttttttttgtatttttagtagagatgggggtttcaccatgtttgtsaggctggtctcgaactcctgacctcaagtgattcacctaccttggcctcccaaagtgctgggattacaggtgtgagtcatcacacccagcctataactttttttwaataggtgatagaatcccgtgcttgaaaaataatcaaacaaaaagagaatgcattgtaagaagcctcactgtactcctgtccccagctgcccagttctcccctcctccccacrgggaaacatcttcattagtttcattaggttcttatgaaaccttccagagtttctttaagcaaaatacaagcaagtaggactgtcatatcctgcagaccgctacatacaaatacatagaaagtgtcctcattctatcctccagtgatattccattttttggctgaaccacctaaatgatggatatttaggggaagcaagtattttttaaaaaaggtaaaaatcaaaggtttttattttttatttttttaaagaaaagttggtaggctgtgtttattcattcagaagtcaggccgtggctgaactgatagctcttggagatggccattgctcatctctgaatgtctggttttctcttgtaagaattgtgtgtatgatccagaccttcagtgtgtgcactatatattgagaattccagaagagatgatatggacaagaaaaaaagatgactttactttttacagtaaaaataaaacttaaattgaagagtacaattgtttaaacaattggaacttacttagctactgcttgttgaaacaaaatcctttttttaaaagstatcgaagcaaattaaagctgatccgtgctaaggaagaagacagtggccattatactattgtagctcaaaatgaagatgctgtgaagagctatacttttgaactgttaactcaaggtatgtaaagggagtataaagataatgctagctctgtagatgagtgtcttccaaggaaagcctggcacttttctccccggtcatggaagaaaagcagcacttaggggagaagcagtgtctgcatatgtcacatatcgggaatacctctgctggactcatgaattcaggtatttctgggaggttctgggttactctagagtaggcgaggaatccctaggctccaccagctagctttatttttgtagagatggagtcttgccatgttgcycaggctggtctcctgggttcaagctatcttcccaccttggcctctcaaagtactgggattacaggtgtgagccactgcacctggcctccaccagcttrcttagcacctgcttctcaatctgagaagagagaagcagatgaccttagattgttctggagagttttgctacaagttttccttatagacattgtacagtggtccttaccagaagggagtgcccaagtctgtttacattcaggctcagcacctatccagagtcccagccatgagccaggtgctgtctgaggtgcgctcatgtgatcctcacagtaaaacctgtgatacaagcaacaccgtatatctaatttatttgaccacagatttagaaaagaatctttaaaacctaataacataccacagatgcattttggtaaatgctgctttagattatactttagctgaatccattagttgaatcctaagctataatataattttaagaacctccttgcctttcaagccaaataaccaagggactttctctctctctttccctccctcccttccttccttccttccttcttctctccctcccttgttatctcttttcctttcctttctctccttccttccctcttccctttttcctttctctccttccttccttccttgcttccttcttccctccctcctttgttctctcttttcctttcctttctctttttctttccttccttccttcctcactcactcttttcttttcctttctctccttccttccttccttcctccctccctcactctctcttttctttgcctttctctccttccttccttccttttcctccctccctccctcccttgttctcccttttccttccttccttctttcctttcttccttccttccctcttccctcactctctcttttcctttctctccttccttccttccttcattctcccctcccctcccccctcccctccccctcccctcccccctccccccctcccctccccttcccttcccttcccatttttcttctcaccatgttgcccaggcttgcctcaaactcctgggctcaagtgtttctcttccacctcagcctcccaagtagctggggctacatgtgtgaggcatcacaaccatggacttttcactttcttcactccaggttaaaaacatcacagggataaatctcaaaacaccaaaactgtgaaaatgctgctaaccatgtgggtctgtctaaactggagtgttacttgtacaactggtttcagcccctcsggagtgttttgaatgccatgtagatgagttgtgaactcatattccactttgtagtctcatatgttctgggacacgagctattccattctgacttctttctgcctcttgcagttccttcatccattctggacttggtcgatgatcaccatggctyaactgggggacagacggtgaggtgcacagctgaaggcacgccgcttcctgatattgagtggatgatatgcaaagatattaagaagtatggaaaacagatgtgtcttcttctttcgtggtcagaatatttctcccttgacacaaatgatgtcaaatacattttacttattgactataagatagggttttgggtgtgatagcttcagggtgtgtatcttttgtcatgaatagctgtgagaagaaggtccagggctctcattagaccttcaaaatgtctccaatctaaaaacaagagtgaattttaagaaccactgttctaagaagatttttactaccctggctcacatatcttatttggtgaactttgtttggtagtcggactgcatgtaaacataaatgtgactgcttagtcccttatctgcccacctgctgtttggtgggttaattcgccattccctcctccctcccccgagtcctcagccttcttaaatgggcacatgagcaatgtgtttacacttcatccatggtaactggttgtgttcagaagcctcagttgtttcttcctctagacagagactcctcatcttaacttctagggctaagaacagacttggatgttgactggggtttctagtagattccagtgtggagcaggattctaggtcttataactcaatctgaggatcatcgcaaccctagtgacaccctaggggctcttcccagtgtgagtgttgagaagggagggctccaggcctttttgaaggggtgggagattgagatcattaaatatggttgaagttgaactgttcagtttgctcataggttcaagattggggaatggtagtcatattttattaaacttgattatctctgcctgctatgtaaacacttagctttcagttgttcatgtgtgagttattccctcttcagcacatgcagacaagttttaatgttcatctgcatgtaaaataaatcagtgtgtattgccccgaaatgcagacaaggtcccaactccttgccatcttagagtgttcccgtggctccactcattgccatgactctcaggaattggccctatacttaggccctttttctctctagatgtaataatgaaacttcctggactattttggccaacaatgtctcaaacatcatcacggagatccacycccgagacaggagtaccgtggagggccgtgtgactttcgccaaagtggaggagaccatcgccgtgcgatgcctggctaagaatctccttggagctgagaaccgagagctgaagctggtggctcccagtgagttcctcaacagtcaggacaactcatcagctgagccgcatctgccccaggcggaactttgaatcccagataggggtyatatagaaatgaaggtcccaaggcagaaattcagttaygaatgctcttaaagkcatgtgggactttgttttattttgttttgttttttgagacagagttttgctctgtggcccaggctggagtgcaatggcacaatattggctcactgcaacctctacctaggacgttgttttagattcagatccaaaactgcatttttgcagaggcccctcaacattttgcttgtctaataatatagctacagtctctactttgaatgtctgtgtatgtggatggagtgtggggaaggatcttctgtctcattgctccttaaaagatagatgaagccaaaagcaatataagcaaaatgcaacttacaaaataagctttataataaagcatatgaagtagaggtgtctgcccatatagtagctgtcaattgcatttatcctattcaaattctgtccacaaggttactgttggagcaactttggagaaaatactgagttctcctgattgaattttgtccccttcttgtataaggaaagagttgatgtagtttcctgggtgtagatggtttgagagatggtactgcctatccctaaaatgaaccaggcagccctcacacttccccaccagcagtgagagattcctggctcagacacagccacactaccttgctgcccctgtgcatgtctgccaggaaacttttcattgtgcctctctctcttgtcacgtagccctgcgttctgaactcacggtggctgctgcagtcctggtgctgttggtgattgtgatcatctcacttattgtcctggttgtcatttggaaacaggtagatattttctcataaaactaaagatctttgaagccaatgagaacaagcatagcaacctagttcagtgcttggcacagagaaggagctcagcaattacatgtggagtgaacgttgttggactctactgtgtccagtcactgtgctgcttcagtgaagctctggtgcactgggactttggtaattcaccagttacctgtcctggtcatttatagaaaccgaggtatgaaattcgctggagggtcattgaatcaatcagcccrgatggacatgaatatatttatgtggacccgatgcagctgccttatgactcaagatgggagtttccaagagatggactagtgcttggtaagttccatggggtaacctyccaagactcccttttcccttgcacacaactttacaatttataggccttggcagaatagagatctgagcttgtgcttagtaagaactaggcaatggaaatttgctttcagaaatacatttctgtcttgacartaagttaattggatcattgcaatgatttttttaaatctctttccataacaaattatagttaaggaaaattttacaaagggagaagagaatatgaagagggctggcaaagatacccaccaaaattgcttttctttagaaatgacacaaattgaaaatgaatttctgtgactaaaaatgagcagatgagaaatgaatgaggacaaccacaaaatgtattttgattcagtacattctgaagatgcattagatactcctttttacatatttggaatatggaatataaaaatataggtacattttgaggcaaaatatgtaaaaataagcaagccaacttatcacaagcatttcaagtatttcaatcctgggctgagaccaagtatatgaagctttagtccaagggagtatttcttttttaaatcacattcctaatgaatgaaagcaagacaaaggcaaatgaaagtagaggtagaggttgtgttatgatgaatgatctaacagtatatatgttaaagaatgccaaatgcaggttttaattatccaccggtctcaytgcaaaatacagaagagtttaagtcttcttagagagttaggtaaactgaaatcaagcaaggcaccagagtgaaatcacctttgcaaaaattgtaactgaggaaattatgacagtgaatgagatatgacctaaccaactccattttgctttagcctccaagttgtccttgttccttcctgggcataggccgaactaactttgagaggaacttagtttatagtttgactttgaaaaaaagacaataatagccctttgccaaaacaaaccctctttttscctgggaactagactgcctttgcgggactaacgaattagctacaagattagaaagtatggtttaggggtcactgttgtaaaacctraggtcagtgcttgagatattttggagaccctgtatttcgatgcaccagctgacaccacccaggtcaataaactggctcatctgatcttggggcccctacctaggaactgactcagtgcaagaggacagcatcagctccctataatttcatctttgacccaaccaatcagcactccccttttcaccccctacccaccaaatcatccttaaaaaccccattcccccagtttcagagacactgatttgagtaatagcagaatagtagaaattcccccagtttcagagacactgattcgagtaatagtagtaatagtagaataggtctcccgtacagctggctctgtgtgaattaaaccctttttctattgcaattcccctgtcttggtaaatcggctctgtctaggcagcggacaaggagaatccatggggcggttataagagctgccccccaatttcaaatatttatatctaagctttctttattttcctgcctatttcccaacaagggatgaggagcttagggagttaaaaagtagtaaaatatggggaaaagggcataattcccattataccaagaggcattgctggtgaagcaatacctttccaggtacgattttcagtaacacagacgtgcagtaagaggcagtgttggctgttagtgtcttttatgagccaagtcttttcctggcttggctatccgtggtgagactgacaccccgggaaatgtttctctcagggtgagctctttcagggtgggacaacagcttcagtgtctttacgtatgtctcctcccaacatgaagctaattgctgtgctctcgggcatgtttagctcttggtagagtggctttcctaacaaatagggagcagtgagcccagcctgaagtttttatttagtcactccttagaatcagtgatattttgaatactgaagtatttccagtggctagtaatttactaagacaaaagatgcccctgtttgcatatggaaaacagaaggggagagagccaggaggtgtgggtgagagccccgaaggcaagaggatcccaggggctggcccagcacggagctggtagacagcrcgctcacaccagggagggctgcaccctcctttctcccgtctgtgttttctttcccttgcaagtgttattcgacaaaagcaattatgctaatttccttccctgtgggctcaattccttttttgacasgatgacttggaggagtcattatgattactccaaacaggaaagacactcgcccagctgtccgcccgcagaragctggctacggtgcagaaagctgaggaggcgtctggagtttttgggtgttaatgattctgcctgcccacaggtcgggtcttggggtctggagcgtttgggaaggtggttgaaggaacagcctatggattaagccggtcccaacctgtcatgaaagttgcagtgaagatgctaaaacgtaagtgctccttcctggggattttttgagcacggggattttttgagcatggggatattaagggaatttctcaaaatcatgcagctagtaaataagacatttaggactaggtcctgattattttgactccaggttttatgtgtatttagattaggtttatttagattgctcttgctgcctgtatgttggaaaattaagagcttgttatttccagtgacttctttttactagaaagaccaggaattagttattagcactgaggccaagtagctatctgcttcttttagacttctggtaaatagaatgatatccaatcacaggattagtcatattcttggtttttttctgagaacaggaagttggtagctcagctggactgatatgtgatttattctttcaacagccacggccagatccagtgaaaaacaagctctcatgtctgaactgaagataatgactcacctggggccacatttgaacattgtaaacttgctgggagcctgcaccaagtcaggtgggctcactgacctggagtgaggattttcactggacacatgtggttgtgaaaactgttcaatcaggcttaaatcctccactctccatccccacacatggcagggaatagaagtcccttgaatggagctgactggtcccttgaattgatggaagctcattggtttttgagcaaaatctgttgccagtccagtcatagccattcatggctctttattaaaaaaaaaaaaaaaaaaaaaaaaavcttttttggtatcttatttttttctgygccatatggtctgcaggacaattcatggcttttctgttcttcattttcatacccatctcctaacggcttttgtccccataggccccatttacatcatcacagagtattgcttctatggagatttggtcaactatttgcataagaatagggatagcttcctgagccaccacccagagaagccaaagaaagagctggatatctttggattgaaccctgctgatgaaagcacacggaggtgggtgcaaagagagatgttgctgtctatcattatcttacaggcatcacaaatggaaagacccatgtcctgatagatatcatgtctgcagattcagtgcccaaggtagcaagacttagagtcaaaccaccctgtccagtctttccatggtcatgcagagagatgcatgatgtctaaaggtgttttggactggggtgtcacatgggaaggccttgctgataggtttgaatgagagtgagttagaatgactctgggagctcttctgctatttacatgtgatccacttagacctataaaatgcagctctggccagggatgcttgagttctggaaccttgcaagaactgtctgtggatctccaagctcgaggtccttgctgaacctggacctataaatgacgtcaatgatagtgatccctactgcagaaatctacaagtggctataaagaactctgtaggtaagaaattctgtaagatcagaaagtacaatgaattcacttcataataaattacttggtggacaccaaatgggtgctaaattgattgggtagaaggaattgtatgcccaagccacatgrccacacggctcaagttccaaccaaggcttgtgagttgaaaaactgagaaagaataatgacagacttaaygtagtgaattcttcaaactttaagtgtaatggacttacaggtccatgggagcacagccccactgtcttagatgtggctcttcaggatgtgcgggctcctgctaargatgtgcagggaactggctctgaaaacaagtgaacagtagtcatcatggcagctgacatttgtggagtcctttgtatgtgccaggtgccatgacaaatattccgctagtctttcccatctttgtcagtgggatccattctacgtcttctgaaaagtgcttccttgacccccagatcaagtcattttccttacaagctattgaaacctttcttccttcacaacacagctgagtttgagttgatctgtgtatttattttgttttttacatttctttttttccctatttaaaaaatttttttatttccataggtttttggggaacaagtggtatttggttacatgagtaaattcttcagtggtgatttgtgagattttggtgcacccatcactggagcagtatacactgaacccagtttgtagtcttttatccctcacctgcctctcaatttttccccgagtccccaagtccattgtgtcattcttatgcctttgcatcctcatagcttagctctcacttatgagtgagaacgtacgatgtttggtttccatttctgagttacttcacttagaataatagtctctaatcccatccaggttgctgcaaaagccattaattcattcctttttatagctgagttwyatatatatatatatatatgcacacctacacatacatatgtatagatacactgcagtttctttatccactccttgattgatgggcatttggggttggttccacattttttcaatatgtgaattgtgctgctataaacatgtgtgtgcaagtatctttttagtatgacttcctttcctctggtagatacccagtagtggaattgctgtgatgcatgtatttgtgcgactatttgattaatgctcatttccttgactagatcacctcatgtgaaaggtatggattggttttgcttttacccagttagctcccatgcctayctcagtacctggcacattgtaggtcccccagaatcatcatctactgaaagtggaatgaccacttcagaagggcaccctgggtaagatttctctttctgtttttacagctatgttattttatcttttgaaaacaatggtgactacatggacatgaagcaggctgatactacacagtatgtcyccatgctagaaaggaaagaggtttctaaatattccgacatccagagatcactctatgatcgtccagcctcatrtaagaagaaatctatgttaggtaaaagtgtctatactcactctgggtgttgggactttccagtggtttaatatgatacttaaagtatttagrgggaagtgtatagggatggtaagtgaacctggmagcccaygtggtctctaaatgcaggtctgcacaaccagttctgtgacatgtttccaggtttgtggcctgtaaattgaaaagaataaaagctgacaatgtaacaaattttttaaactttaaatttaatagttttaaagaattttcttggtgtgttcctgcagtaaacattttwwaaaaaaaataattatttattctgatataatgaacttccttttttattgctgtctttttcttttttaatgaaaatatggtgattgattttttttaatgcccttacttggcagaattacaagttggctgtcttatgttggttcctcaccttgctttttttcccttaagttttagaagtctctgatgtctatgagttcagtaacccttgcttttacttttcctaacattcaatttgtgataggaactctagagtagataatttgcagttatattttctggaccagtgtttctgttgaatgtattttgaaggtgggtctatctgtttttcaagtacatgaatatgtggcagggttaaattgatttataaactccagggagtccagctgatgcccagaccagatggatcacttcacatctgctcagggtggttcctccagagccctgaactggtcacagacatgaagctggaagtctgacattggcttgtcctgtgagcttgcctttttgggtctgagccttcccattagtcaatgcaaaaaagtgttgagctgccctggacattgttttggaaattattgatgtgctctgaatgttttcaggttcttaagtgaaaggtacaatccatttaaaaaagaatgtgtttgttttgcaaagctcagtacacaatattttccatttctgcggttccaagttccattcacttctcattgccaaatgggtgaacttccaagcgcttttaaaagattagccagtgagagttatcggaaccagtacttcctctcccctcccatattgttaaaaatagtttacattgcttcccaggctgggctggtggagttggcaygagatgtcagaggaacctgagtcatgctcaggcccaagccctgttggcaggcagaccactgctttctggccttccgtgactatctgaaaaaaatcgtgaatggctagagctactcttcacttgctgaacattttcaaaaagaattgagaacttctggattaaattgccttcttcctcgaaaaccctgggacccttccagatgggactaactggggaaagtggacaagttacaaacaaagaaactcaaaggaaagtcattggcactgatctctaagatgctatcacatgtgattggtggttgattttattaacaaattataagcaaagtactacaaaggtggctttaaaaagaaaataaagcaattcacagaaactactttttcatgtagcttgtatgtgtgctccatgtatttcatcatggaagattttagtgtgtgtttatgtgtatgtgtgttttaaaggtagctgagatgatttgctaattatggttgaaaaaaagaaatttaggaggtaaacaaaataattatgtgtaagattggtccttgtggctgtgtgtgtgttttgtgtgtgcgtgtatgtctctgtgtgttttaggctgttcttttattgctataaataaatacttgagactgggtaatttataagggaaagaggtttaattagttcatgattctgcaggctttacaggaatcaagatactggtagatctgctcagtttttggagaggcctcatgaagccatgaagtcatggcagaaggcaaagcagtgcaggcacatcacatggccagagcaagagcaagcgagagagagaaagagagaggtgccacacacttctaaacagtcagatcttacaagaagtcacttactattgcgaggacagcaccagaaggatggtgctaaattgttcgtaagaaatctgtccccatgatccattcatctgccaccagtccccacctccaatactggagattacaattcaacatgagatttgggtggggacacatattcaaactatatcatactgaccctggaccctcccaaatctcatgtccttctcacatttcaaaatacaatcatccctccacaatagtcccctcaagccttaactcattccagcatcaactcaaagtccaaagtcttatctgacacaaggcaggtcccttccacctatgagcctgtaaaataaagaacaagttatttactttcaagatacaatggggttataggcattgggtcaacattcccattcccaaagggagaaatcggccaaaagaaaggggctacaagccccacagaagttcagaacccagcagggctgaaaactccaaataaactccattgactccatatcccatatccagagcacactgatgcaaggggtggagctcttgggagggatggaacaccctgtggctttgcagggtttagcccctgcagctgctctcaggggctgttgtcgagtgcctgtggtttttcctggtgcagagtrcaggctgttggtggatatattattcatggaggatggtggccctcccctcgtagcttcacgaggcagtgccccagtggagactctgtgtggggacttcaaccccacatttcccctctgcagtgccctagtagaggttctctgtgagggctccaatcctgcagcatgcttctgtctggacaccctggttttttaatatatmctccgaaatctaggcagaggctcccaagcctcaactcttaacactctgtrcacccacaggctaacaccacatggaagcggccaaggtttatggctgtcacaagctgaagcagcagcccaagctgcacctgaactcctttgagccacrgctggagctggagtcatagggatgcagggagcagtgtctcgaggctgcacagggcagtggaccctggggctggcccatgagaccattcttccctcctaggcctctgggcctgtgatgggaggggctgccatgaaggtgtctgaaatgccttaaaggcctttttcccattgttttggcaatcagcctttgcctcctttttagttatgcaaatttctctagcaagtggttgcccagcagccctctttaattctctcccaaaaaagcttttactttctctgtcacatggccaagctacaaattttccaaccttttatgctctgcttcccttttactttttttttattttaaagagatggggtctcactatgttgtccaggctagtttgaactcttggactcaagcaatcctctcactcatcctcccaaagtgttgggattataggtgtgagccactgcgcccagcctctgcttctcttttaaatataagtttcaacttcaagtcatttctttgcttctgcatctgactgtaggctattggaagcagccaggccatatcgtgaacactttgctgcttagaaatttcttccaccagatatcctaggtcatcactctcaagttcaaacttccacatattcctagggcatggacataatgtggccaagttctttgctgaagcttaacaagggtgacctttactccagttcccaataagttcttcattttcatccgagaccttggcagcctggatttcattgtccatatcattatcagcattttggtcacaagcatttaaccagtctctaagaagttccaaactttccttcatcttcctgtcttcttctgagccctccaaactcttcttatctctgcctgttacccagttatctttacagcaattccccattccttgataccaattttctctattaggctgtttttgcattgctataaagaaatacctgagactgagtaatttataaagaaaagaggtttcattggcacatggattctgcaggctatacaggcatttgcttctggagaggcctcaggaagcttccaatcatggtggaaggtaaagggggagcaggcatatcacatggccagagcaggagcaagtgagagagagagagagagagagagagagagagagagaggtgccatacagttttaaacaggcagatcttgyaagaagtcactcacttttgcaaggatagcaccaaggggatggtgctaaaccatttgtgagaaattcacccccatgatccagtcacctcccaccaggccccacctccaatactggrgattacacttcaacatgagatttgggtggggacacatatccaaactatatcattgygygtgtgtgtgtgtgtgtataatttttaaaccagatatatgtttctgcatatctctttcctttctttcattctttctwtctttttttttttttttttttttgagacagagtctcactctgtcacccaggctgcagtgcagtggtgtgatctcggctcactgcaactcattgcaacctcctcctccctgattcaagcaattcccctgcctcagcctcctgagtagctgggattacaggcacatgccaccatgcctggctaatttttttgtattattagtagagatagggttttaccatgttggccagactggtctcaaacttctgacctcaggcaatccacccacctcggcctcccaaagtgctgggattataggcataagccaccatgcctggcctatatatctattttctaagatagaatctttgcatagtgatattcatctgtgagatctaaacattctacaaaaaaattaagaaaatatttttggatgtgttctttgggcatgcctctgcaacctgatgatttcctgctgcctgccagcaccaatacatttaatttcttttctgcagactcagaagtcaaaaacctcctttcagatgataactcagaaggccttactttattggatttgttgagcttcacctatcaagttgcccgaggaatggagtttttggcttcaaaaaatgtaagttcaaggaacacagacctttttagacccagatttcagtgagtggagtgtggamggagatgctaggagatagatgttggaaaggccattaataacaggggcctcttacttacctgtctctctccttcatcccctacgcaggtcagggagtctgaaatyatcaggcatctactcttctctagagctttctctctgttgggagtgggtggagtgagaacctgggagaaggccagccctttatatccaggcagacagctccaagtgccaccatggatcagccagtcttgcaggggtgatgctatatcagctacagatggcttgatcctgagtcatttcttccttttccatgcagtgtgtccaccgtgatctggctgctcgcaacgtyctcctggcacaaggaaaaattgtgaagatctgtgactttggcctggccagagacatcatgcatgattcgaactatgtgtcgaaaggcagtgtacgtcctcacttccctcactggtcaggctcatcctccttcactttaatctctaaagtcaggtgttgcttctagagattcggtgcctgttttttaaaacatcaatagatttcaaggggtcagtacactgccttggcagcagattgcccaggtktgagtgccagctccaccacttacttaatttggatttggggctagatacttgactgttctgcccctctgtctccctgattgtagtgggaggtgataatagtacctatttgctgagttgctatggggattaaatcaatgaattcatgtaaagtgcttaggacagtgcctggcatatagaaacagcactcaataatgttagctattttatttatttattwatttatttatttatttatttatttattttctttttttttgagacagagtctcactctgtcacccaggctggagtgcagtggygcaatcttggctcactgcaaacttctgcctcccaggttgaagcaattctcctgccttagcctcccgagtaggtgggattacaggcatgcaccaccatgttcagctaatttttgtatttttagtagagacagsgtttcaccatgttgcccagactggtctcgaactcctggcctcaagtgatctacctgcctcagcctcccaaagtgctgggatgacaggtgtgagccactgcatctggcaagtgttagctattaatatgtcaattgcgtgtatgcatggacaagcatgcattcccaaggatggtgtctttatattttaagcttttatcagattttcaaaagccatctgtgacccctaaaatagattggaaccatttgggtttatgtatcttggaggcacagtttccttaaagatactcattttgttgtctacttgaaccattcttcccatcccttccacttctcagcagatgacatagctccctgtggggatatatctgctccctgtaggtacaattccaaatcacctcactgcactggatgtgagacagcttatggcagctgctgcttccacctagagaaagacatgggcctgcatccatgctgtgtgtgattcatgtactcatgtggccgtgatagctgtaatcggctcatagatcattggatctgttcttagttttgttcccaggaatatctaaaaataggaaactggtccattcagggcttacaccttttgggtgaaaattcaggattaatgtttttggatattattcctttggaggacataaaaggcaatattgaccattcatcattcatctagtatttattgagcacctactatgtgccagggactgagagttcagtaatgaacaaaacacatgtaaaagacactcaaatgggacaagataattagcacaagttattaagagcccaaggggaacccttttctatttccactgctgtggatcatcagtgagtagacatgggtttaactgtctccctccttccttgcagacctttctgcccgtgaagtggatggctcctgagagcatctttgacaacctctacaccacactgagtgatgtctggtcttatggcattctgctctgggagatcttttcccttggtatgggcctgacattgctgcttatttgggctgttctgaaacaccactggaaggaaaatgtgttctttcaagccccaggatgtagacagtgttaagataacctggtgtgaggccagtatgctgcagccgcctcaaaccacatgttgtgccttattgtgtctgagataggcccatgcaggtggagatgggggtttttgttgggggttgcgtctcactcctggcctctgcccctcctctcctttgggctatgccagagtgacttcctcccactggaagtggtcccaatgacattcgcatcccagctgctttttcattttgggctttgggtcacatgggttcacccatggagagtgggccctccctcacctggtggcgattgatgctcaggtgaaaaggggtacgtggcgggaagggcagggctctcattcctggttgtcattggccagtcttgacaacccaggtgctgaacaacccaggtgccctgggctatccggtgaggtccctaagagaaggatgagccataaccctgacatctggatggttcatctggggagatgagacttacacacttagggataaacagtgtgctgctgatttaaaattgtaatttgagtcttgagtaaagagaaaggagtcctggaatagtgtgggaaggcttcagagagggaacttaacttgacctggccttggctttgaaagtgtgaaatgtttcatgaatttatctgtgatcaggatgtaatagtaaagtgtgtcttcctgccccgtctcctttttcatcctagttctccctccatggatgatcacaatggatcatccccgagtggcttaatggagtcctgtactcccttaaaagcagagaggccacaactttgatttttgctttagctatttgaacatacctggtgaaaaagactctctgggttttaatgattcagaatttctccttgcttttctagttcattttgtctgtgttgatccagtagtcatacacattgaaaaacacttgaacgcttatttctaaagatgtagaatttttgtgatggtacttggacttgaccaacctggagtcctaattaaacttaaggtttgagctggtctctgaagtcaaggagatgatgacactgaattttcttgaaaaaaccagtgcttcaasgcyataggatctgaaaggttttctaacagygttctatcatgccaagtgtttcarcaatgcactgagcgtttgttagtcctggtgttttattgtttggcttttaggtggcaccccttaccccggcatgatggtggattctactttctacaataagatcaagagtgggtaccggatggccaagcctgaccacgctaccagtgaagtgtgagctccttccccatcccgggggcctgtgttcacagtctgtgggtctagggggagggaggggccctgagacttccccctgtgcccactcttgagttctgtccccacagctacgagatcatggtgaaatgctggaacagtgagccggagaagagaccctccttttaccacctgagtgagattgtggagaatctgctgcctggacaatataaaaaggtgtgtttggatctgtgggtggaaaggtctggataaagctggaagttataccagtgagctgtgctgttccgcagttctagaggagcattttcaaaagaggcaaaagactgtgtgatccagtggctgggcttcatggcggtgctccacgagaccctagtagcaatgatgaatgaaaaccctccccttcccgtggggctttcctttcatcttatatgtrcagtacctgtaagcactattctccagatgtttgagtatcagaagttagtgtgcagttagaagactcagggcatccatggccattacatcactaatttgagtgcacttaaatccatgcgaaattggcttttaccagcggactggaaggaacaacctcagctgttatctgtggcaccagctggttttttgtggaatrggaagcattgttcaaaggaacaaatgtaatttcttggaaccaggcaggatatgtaaatgaatgaaacaactttctgctgaggtgttgagaggaaaactcagacataacctcagtttcttagattgagattagtccctgtgtagactttttatacttatcatttttcttccttcttctcaaggaggaatagtgttaggagattgtgtgccgaactggaagttaaatgcttctgtctgttaattatctcactgcccactacaactttcacaggtgaggcagtgaggaggcagaaggaaattaaccctcagttggtcaaagatgctctgactggtggaaatgtgttggtgggaagagattgaagttattgttgaaaatagggtcttttcacatccaatgtkagacctctccaatgtttaaggatcatgaaggctttgggtattatccacccaatagaaggcctcactgcctctctrtgggacccatccaagccctggaaaggcaacgtgatggggaccagaaggattctcagttgtagctactgacttggagaaggggctactggtatcttagcacctaatggcagaagctctttaccattggtggcccyttcttcatgttctatgtctctggggatagttgacatgactctccttcaactaagtcccacatcttccaggtagtttggaratatgtacagttaaataatrgtaagttctgagtgtctctattcatttttgaggtttggttgttaacacttgattaaatatgttcaatgaatgtttatagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacaggtagctgtgggggcagcctcggtgtctcacctttcccctcccctataggccctgaaggagaggacccattttcccgataatggtgcactcccggttggtaaatatgtactcagggacaagttgcagaatcctcaggaggtccacgtggttttgaaaatgcttcccagatgattctaatatgttccccctggggctgggagagggatgtgcatgttgtggggagagggacatgcttccctggtggagaatctttgagctaaattctcaggtaatttgatcaaattgatacagaactgtgattactgagatcatataagcctctcctgccattgtcttaaatagtcattgaactggggaaaaagtgaagagaggcgggactgggtcctttgacgctataccctacctgtgaattkgaatcacctgcagagatttaaaaactgctgatctacaagcctcacccaaaacaacaaattagaatccctgggggtggtggccaactgctccctggctgatttgtttcttctttcttttaaattttgtattatggaagatttctaacgtgtgcacaattcacatagtatagtgagctgttcagtattcgtcacccagcttcaatgactatgccctctgccagcctggatgcacacatggccatgtctgtctctcctcagcctcctctggattgtttggaagcaaatcctagacaccttatcatttcacccataaatattccagtgtgtgtctcttaaagataagggctctattttaaagaagaacaacagttattaaaaataactacaatgccgttatctcacccaaaacagggacaataaatcgttaaggcatcaggcagccagttaaagttcaaattatctcacaaatattatcatactccattaaaaagtgggcagaggacataagcagacacttttcaaaagaagacakacctgcagccaacaagcatatgaaaaaatgctcaacatcactgatcactagagaaatgcaaatcagaaccgtgatgagataccatctcacaccagacagaatggttattattaaaaagtcaaaaaataacagatgctggtgaggttgtggagaaaaggggaagcgtatacactgcttgttgaagtgcaaattagttcagctattgtggaaagcagtgtggtgatttctcaaagaacttttaacagaattaccattggatccagcaatcccattactgggtatataaccaaaggaatataaatcattctaccataaagacatgcatacgtatgttcactgcagcactattcaacgatagcaaagacatggaatcatcctaaatgcccattgacagtagactggataaagaacatctggcacatatacaccatggaatactatgtgttgataaaaaagaacaagatctgagataccatctcccaccagtcagaatggctattatttaaaagtcaaaaagcaacagattgtggcgaggttgtggagaaaaagaaacacttttacaatgttggttggagtgtaaattagttcaaccattgtggaagacagtgtggcgattccccaaagacctagaggcagaaatactgtttgacccatcaatcccattactgagtatatacccagagtgatgtaaatcattctattataaaggcacatgaatgtgtatgttcactgctgcactgttcacaatagcaaaatcatggaatcaacctaaatgcccatcaatgatagactggataaagaaaatgtgatacatatacaccatggaatacgatgcagccgtaaaaaggwatgagatcatgtcctttgcagggacatggatggagctggaagccgttaccgtcagcaaactaacacaggaacagaaaaccaaacaccacatgttctcacttataagtgggagctgaacgatgaggacacatggacacatggagggaaacaacacacactggagcctttcaggggttggggattgggtggaacatcaggaagaatagctaatggatactgggcataatacctgggtgatgggatgatctgtgcggcaaaccaccatgacgcatgtttacccatgtaacaaacctgcacatcctgcatatgtacccctgaacttaaaaagtggaaaatacaaaaatgaaattaaaaaaagaacaagatcatgtcctttgcagcaacgtggatggagccggaggtcactatccttagcaaactaatacgggaacagaagaccagataccgcatgttctcacttataagtgggagctaaaacaacgagaacacatggacacaaagaggggaacaacagacaccagggcatagttgagggtgcagggtgggagaaggaagaggatcagaaaaaatacctatcggatactgtgcttattatttgggtgatgaaataatctgtacatcaaaccgccatgacatgtgatttatccatgtaacctgcacacgtgcccttgaacataaaataaaagttaaaaaaaaattatcatacacttgttttgttctgtctgagatccagataagagtcacacattgcacttggttgctatgtctctgtaagttcactatgcctctattttttgccctcttacatattatttgtgaagaaaccatagtgtttgcctgtggagttcccacaatcggcattttgctgattacatccttgaagtgtccttctcaggtgcttctgtcttctctatgtgttgtaaactggtagttagtctaggaacttaacctgactcaggttagatctttggcaaacatgcttcatagatggttctgtgtgcttctgtcaagaggtatgcactgtccagttgtctgccttttgtaacattatcagtcattgggtgatcattacctagaatttcttttttttttttttttttttgagatggagtctcgctctgtcacccaggctggagtgcagtggtgtgatctcagcttactgtaacctccacctcctgagttcaagccattctcatacctccgcctcctgagtagctgggattacaggcacatgccaccatgcccagctaatttttgtatttttagtagaaatggggtttcagcatgttggccaggctggttttgaactcctgacctcaagtgatctgccggtctcggcctcccaaggtgctgggattataggcatgaaccacctcacctggcctagattctttaactcagcaccaaggtggagctaatgcccaggcaggactgagaatcactggttgacgtggtcagatggaggagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgttttcctcttctttcccatcagaacattattttggaggcttatgactgtgacctttgttaaccaatttaggtataatatgtagacagcccttgtttatttgtatggactgggtaattttgaaagtatggcttttctattttgttttagaatatgttatgtgatttgaagatgggacacagtggcccatcagtcttcggttttttattatgctttgctcaggccagtttttataacgtgtttatatctcttgagcatacggtgttcctccaagttttgggggtctgcgatggaacttcacgggggtcggggaaggctgggcagtgaatctagggctctctgtctcagatcctttctcaatttggttactttgtgtttgtgggctctgaataatatttgagttgtaagagggttctgcttttatataaagttagaaagtcacattggaataaataacatgagaaaggtgcccagaagttttctagggctacaacaggctgagctgcagaatttgacacgccaggaattgaactttctcagttgaagttcacgttcaagttaagtaacttgtgtggcatcacacagctagtaagtggggggaccattccagacctaaggctttctgactccagaactcccctttcagccacttctctagtacgtaaggagccgtcacctgggccctcaagttgggggttggtgggggggcatttgatgtcaagagagaggggaagagggcattccaggcaagtggcaggagatcctgagaacacagtttggatgctcaggaggcttccgggagagcacctgatgggcctggctgcagcttgcaccctgatgggcctgacttcaccccctgctctgccttcccaggcctttggatcaggcattgcttatgttctcttccactaggattgagtagggaaagtagaaattcttgcagcttgtcagtaactttgatgaaagacccagcagaaaagcaggaaagctgaagagtaaaaatgatgggtggaccttggttttccacgtggcctaccacagcatgtcaggcctgggggcagaatcttgccatactgtgcagcccaaatttgaatgccaaaggctttcgtttgtctctggggggccacagtctaggtctagttctgtgyaggagttgtaatatttgctcttctctccctcctccagctcgcagacctctgaagagagtgccattgagacgggttccagcagttccaccttcatcaagagagaggacgagaccattgaagacatcgacatgatggacgacatcggcatagactcttcagacctggtggaagacagcttcctgtaactggcggattcgaggggttccttccacttctggggccacctctggatcccgttcagaaaaccactttattgcaatgcggaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccamggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaatyaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagtttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggmattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgggtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagttatactaaggtttcagcatttttgtttttagtttaatcataagaattaaagcaatcctgttctatttactttcttagcaacatttgtaggactctatattaggccttttttttttttttcctgagatggagttttgctcttgtcatccaggctggagtgcagtggcgtgatctcagttcactgcaacttctgcctcccgagttcaagcaattctcctgcctcagcctcccaagtagctgggattataggcgcctgccaccatgcctggctaatttttgtatttttagtagagatgggggtttcatcatgttggccgggctggtctcgaactcctgaccttagatgatctgcctgcctcggcctcccaaagtgctgggattacaggtgtgaaccaccacgcctggcctttattaggcttttgatgaaccaatagaatatctaaggtttaagacattatatgagctagattgttccacgacacagtatttgacttaaagatgattggcacttggctcatctttggtctcatcatttttttgattgttcatctttatcctgtggtgttttcttcccctgcataaggaatacaggactgcagtaactctgtacaacattcaactgtcgtaaaagtgtaggaagtaaaatgttaaattatttttttcaccgtgtcttcttccctgtccctgtcctgtttccaagaggcagagctgcaccacttggtgtgtcttttaaacttccagttccctttgtatgcatctgtgtatatatattcccatacacacatctctacgtttgcttcatatctacctaaatgggttctcactttatgtaatcctttgtaatgttcttttttctttcctttttaaaactatttattaaagcagttttagatttgcagtaaaattgagtagaaggtacagagatttcccctgtgtgccctgcccccacaccaacatagcatctccatcactaacattctccacctttgctacagctgatgaacctacattgccaaatcattacccataacacagtccacagttctgttttttttttaatgctgttttagcgatctctgtgaaaagtatacagaggtattagctccattggatcccattatgtaaatgtaccataatttatgcaatcatggtcttgtaaaatggatttacagtttccagttctttgctattaaaatgatttcatgaacatttttgcaacatacatatttgcatacaaaaatgtgttttgtagaatggatttctacaaatgaaattgctaggccaaagggtgtgcagaaataaattgatgttgagctgaagtcttcagataggattgatacataagttcttgagcatctgcacgtgaatcactggctttgcacattacatgcagttttctagtctctgctccacattgcccaggaatcatggtcttcaaaataggattggaagaaatacaatgtggtaagtgtgagagaatgtgggttttgtgttctgaagcatactgaagcaagtgactttaggaatttaaaaaaatggtacaactcaccttattttgagctcacggataatgaaaattgattatgttgttaataatcagaatatagcaccctattccaatataactccttatccaaattcaagtagcctgcagctggaagcatacttctttggagttaaacctccaaggagggattcagaagatcatggcatatgagaggcaagactagattgcagctcaggacagagcagcatgcagcagcttgcattgtgaattttagctccagatcctgagaggacccacagaccctctgatggaagtggacttctcctgcaggaccggggagacaccccaaatattgtgagttgccccaaatgcggaagtggtacagggagaccctcctctaccgaatgcgcagtcccactggagcagctgaagttttgcttgcgggagaagtttctgactttacctcaagctgagtcaagttagagagctgagcaaaatacaggggtggaggaagcagcagaaaggccctgggagctcgctgagtccccaagcagcccattcctgcctggcaccacagggatccatagggagggtggccagaggagcagggggtaaaactccacagggagaaggaaatctctagctgaactttgtaacaatttgaaaggggcaagaagcttcctggccggaactcgggggagggtgcaaatcgggcgtacagacttcacaggcagaggaagaactaaagcccttttctctcccagctgggaggaggatagccttgggcaagttttcaagcccatcttgccctctgcctggaaacagactcagggctgttgaggtgggcagggtgggagtgagacaagcccttcggtttgtgggggagctgggtgaggcttgtgactgccggctttcccctacttgcctgacaacctgcatgactcagcggagacagccataatcctcctaggtgcacaactccagtgacctgggaatctcactcccatttccccccagcagcctcagcaagacttgcccaaggagagtctgagctcagacatgcctagcctcacccgcacctgatggtcctttcctatccacgctggtagcataagacaaaggacataatcttgggaattctagggctccgccctccactggttcctctccacactactatagctgatgcttcctgggaagtaccaccttctggcaggaggccaaccagcacaaagataaagcattaaaccaccaagactaaggaccctcatggagtccattgcactgtccaccacctccaccagaacaagcactggtatacatggctgagagacccatagatggttcacrtcacaggactctgtgcagacaacccccagtaccagcccagagctgggtagactaattgggtggctagacccagaagagagaaaacaaccactgcagtttagctcataggaagccacatccataggaaaagggggagagtactacatcaaaggaacacccagtgggacaaaagaatctgaacaacagccttcagccctataccttccctctgacagagcctacccaaatgagaagaaaccagaaaaccaaccctggtaataggacaaaacaaggctcttcaacacctcccaaaatcacactagttcaccagcaatggatccaaaccaagaagaaatcctgatttacttgaaaaagaattcaagaagttagttattaagcttatcagggagggaccagaagaaggtgaagctcaatgcaaggaaatctaaaaaatgatataagaagtgaagagagaaatactcatggaaatagatagcttaaggaaaaaacaataaaaaattcaggaaactttggacacacttttagaaatgtgaaatgctctggaaagtctcagcaatagaattgaacaagtagaagaaagaactttagagctcaaagacaaggtcctcagattaacccaatccaacaaagacaaagaaagaagaataagatgcagccataaaaaaggatgagttcatgtcctttgcagagacatggatgaagctggaaaccatcattctaagcaaactattacaaggacagaaaaccaaacaccacatgttctcactcataggtgggagctgaacaacaagaacacatgaacacaggcgggggggaacatcacacatcagagcctgtcagggggtgggggsccgggggagagatagcattaggagaaacacctaatgtaaatgacgagttgatgggtgcagcaaaccaacatggcacatgtatacctatgtaacaaacccgcacattgtgcacatgtaccccagaacttaaagcataataataaaaaaaagaaaaaagaataatatgaacaaagcctccaagaaatctggaattgtgttaaacaaccaaatataagaataattgttgttcctgaggaagaagacaattctaaaagcttagaaaacatacttgggggaataatggaggaaaacatccctggccttgtgagatactagacagccatatacaagaagcataaagaacacctgggaaattcactgcaaaaagatcttcacctaggcacattgtcatcagattatccaaagttaagaccaaggaaagaatcttaatagctgtgagacagaagcacaaaggaaaacctatcagattaatggcagatttctcagcagaaaccctacaagctagaagggattggggcactatcttcagcctcctcaaacaaaacattttatcggccaagaattttgtatccagcaaaactaagcatcatatatgaaggaaagatacagttgttttcagacaaataaatgctgagcgaattcaccattatcaaactaccactataagaactgctaaaaggaaccctaaattttgaaacaaatcctggaaacacattgaaacagaacgtctttaaagaataaatcacatagggcctgtaaaacaaaaatacaatttaaaaagcaaaaacaacaaacaaaaaaccaaaccacagaggcaacaaagagcatgatggaagcaacagtacatcacatttcaatactaacattgaatgtaaatggcctaaatgctctacttaaaagatacagaaccacagagtgggtaagaattcaccaactaactatctactgccttcaagagactcacctaacacataaggacttacacagaattaaagtaaaagaatggaaaggggcattttgtgcaaatggacaccaaaatcgagcaggggtaactattcttatatcagaaaaaaacaaacaaacactttaaagcaacagcagttaaaagagacaaagagggacattatataatggtaaaaggccttgtccaacaggaaaatatcacaatcttaaacatatatgcacctaacactggagatcacaaacttataaaacaattactaatagtcctaagaaatgagatagacagcaacgcaataatagtgggggacttcaatactccactgacagcactagacaggtcatcaagacggaaagtcaacaaagaagcaatggatttaaactatactttggaacaaatggacctaacagatatatacaaaacatttcatccaacaacctcagaatacacattttattcaacagcatatggaactttctccaagatagaccatatgataggccataaaataagcctcaataaatttaagaaaattgaaattatatcaagtactctctcagaccacagtgaaataaaactggaaatcaactctaaaaggaatcttcaaaaccattcaaatacatggaaattaaataacctgctcctgaacgagcattgggtcaaaaacaaaatcaagatggaagtttaaaaattctttgaactgaatgccaataacgacacaaccaatcaaaacctctgggatacaacaaaggcagtgctaagagtaaagttcatagccataaatgcctacatcaaaaagcttgaaaaagcacagacaacctaaagtcacatctcaaggaactagagaaacaagaacaaacaaaacctaaacccagtacaagaagaaaataaccaagagcagaactaaataaaattataaccaaaaaaaagataaatgaaacaaaaagctgatcctttgagaacataaataaaatagaccattagcaagattaaccaagaaaagaagagagaaaatccaaataacctcactaaaaaacaaaacaggagatattacaactgacaccactgaaatacaaaagatcatttaaggctactatgaacacctttatgtacataaactagaaaacctagaagagatggataaattcctggaaaaatacaatcctcgtggcctaaatcaggaagaattagatatgctgaacagaccaataacaagtagtgagattgaaatagtaattaagaaattataaaccaaaaaaagtccaggaccagatggattcacagcagaattctaccagacattcaaagaagatttggtatcaatccttttgacac

SEQ ID NO: 17692 - DNA, 39998 bp, Homo sapiens
  misc_feature (1)...(39998): n = A,T,C or G, or insertion/deletion polymorphism (see Tables 1-2)
aaacacattcaaaagctagcagaaggcaagaaataactaagatcagagcagaactgaaggaaatagagacacaaaaaacccttcaaaaaattaatgaatccaggtgctggttttttgaaaagatcaacaaaattgatagactgctagccagactaataaagaagaaaagagagaagaatcaaatagatgcaataaaaaatgataaaggggatatcaccaccaatcccacagaaatacaaactaccctcagagaatactataaacacctctatgcaaataaactagaaagtctagaagaaatggataaactcctcaacacgtacatcctcccaagactaaaccaggaagaagttgaatctctgaatagaccaataacaggctctgaaattgaggcaataatcaatagcttaccaaacaaaaaaagtccaggaccagatggattcacagctgaattctaccagaggtacaaggaggagctggtaccattccttctgaaactgttcccatcaaaagaaaaacagggaatcctccttaactcattttatgaggccagcatcatcctgataccaaagcctggcagagacagaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatatgcaaatcaataaacgtaatccagcatataaacagaaccaatgacaaaaaccacatgattatctcaatagatgcagaaaaggcctttgacaaaattcaacaacccttcatgctaaaaactctcaataaattaggtattgatgagacgtatctcaaaataataagagctatctatgacaaacccacagccaatatcatactgaatgggcaaaaactggaagcattccctttgaaaactggcacaaaacagggatgccctctgtcaccactcctattcaacatagtgttggaagttctggccagggcaatcaggcaggagaaggaaataaagggtattcaattaggaaaagaggaagtcaaattgtccctgtttgcagatgacatgattgtacatctagaaaaccccatcatctctgcccaaaatcttctcaagctgataagcaacttcagcaaagtctcaggatacaaaatcaatgtacaaaaatcacaagcattcttatacaccaataacagacaaacagagagccaaatcatgagtgaactcccattcacaattgcttcaaagagaatacaatacctaggaatccaacttacaaggatgtgaaggacctcttcaaggagaactacaaaccactgctcaaggaaataaaagaggatacaaacaaatggaagaacattccacgcttatggctaggaagattcaatatcgtgaaaatggccatactgcccaaggtaatttatggattcaatgccatccccatcaagctaccaatgactttcttcacagaattggaaaaaactactttaaagttcatatggaaccaaaaaagagaccgcatcgccaagtcaatcctaagccaaaagaacaaagctggaggcatcacgctacctgacttcaaactatactacaaggctacagtcaccaaaacagcatggtagtggtaccaaaacagagatatagatcaatggaacagaacagaggcctcagaaataatgtcctatatctacaactatctgatctttgacaaacctgacaaaaacaagaaatggggaaagtattccctatttaataaatggtgctgggaaaactggctagccatatgtaaaaagctgaaactggatcccttccttacaccttatacaaaaattaatttaagatggattaaagacttaaatgttagatctaactgcataaaaaccctagaagaaaacctaggcaataccattcaggacataggcatggtcaaggacttcatgactaaaacaccaaaagcaatggcaacagaagccaaaattgacaaatggtatctaattaaactaaagagcttctgcacagcaaaagaaactaccatcagagtgaacaggcaacctacagaatgggagaaaattttcgcaacctactcatctgacaaagggctaatatccagaatctacaatgaactcaaacaaatttacaagaaaaaaacaaacaaacccatcaaaaagtgggcgaaggatatgaacagacacttatcaaaagaagacatttatgcagccaaaagacacatgaaaaaatgctcactggccatcagagaaatgcaaatcaaaaccacaatgagataccatctcacaccagttagaatggcgatcattaaaaactcaggaaacaacaggtgctggagaggatgtggagagataggaacacttttacactgttggtgggactgtaaactagttcaaccattgtggaagtcagtgtggtgattcctcagggatctagaactagaaataccatttgacccagccgtcccattactgggtatatacccgaaggattataaatcatgctgctataaagacacatgcacatgtatgtttattgtggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaactggaaaacatcattctcagcaaactatcacaaggacaaaaaaccaaacaccacatgttctcactcataggtgggaattgaacaatgcgaacacatggacacaggaaggggaacatcacacactggggactgttgtggggtggggggagggggagggatagcattaggagatatacctaatgtaaatgacaagttaataggtgcagcacaccaacatggcacaggtatacatatgtaacaaacctgcacgttgtgcacatttaccctaaaactcaaactataataataataaaatgttttaaaaattcaatagattttacaatatttttaaataattatgactttgtatttatacattttatttgtattagtatgttttcttacattaattatactttttataaggacaagatccgactcagtactgatgttctttagagcctacttacacatttcattgtattttactttagtaagaaagccacaaaataaaaatctacattaaaatatgtgtgtacaaaaaaaatctgattcccagcctattcctgtttgcaattgctgcaacattaaaatatagcacatcaaatacatatttgcttctcggctaggatcgccaaagaaaaaacatcttatgatttgtggttgctgttatttaatcttccctgagcttcatcttccctcatctgtagaaggggaatattattgagtttggagtgcttttgtaatgattaaacacagtagaagatgaaaagtgcccagtgcaattagcaggccttcaatcaaaataagcaagctagctagctagctggctggccagctaaataatgcttccctacatccagaatttccagttgtttcattagatatgcacattcaagtttttacttaggtaattttaaatgtgtcccagtggcaagtgtcctgctaaaggggtactgttagcttcttctcacctaaaacttagtttgttacaaaggaaatgccaattatggaaaaagtcaagccttgagctactgaaggccgagtaacctcgccaaagtttggatgagtcgcttcactaatgcacatgcaatcctgacctagagatcatgtgagtttctgcgttagaaggcgggcacctgatggctcccagtgcagccaatcaggagagaacgttgccgccacacccacctgctccgcgctggccctgggagaggagccaacctgtcttgctttttttttttttttaaccaggctaagctgctgtaaattaagtcttcctggaaatctcagcaactctattggacgtgctaatggcacagttcactccaaactggattcatatttaaatattacatatcctccaactcttgagtgctttaattttgttatctggttagcctgggaaatcattttaaaaatacgctataagtatcagactttcccttagcaattatataaaatctccttgcagttttctgaaaggcacagaagtgcagtttgatttggttgtcttrtcaaaggacatttatgcatgaaaataggctgcaggagtattctatataagatagcaggcagttctgcacgtctgtttatatgccattcacaccatgaacacatccaatgcaattgtattcatcttctgtcattttttaaaattagagtttactacatgatttttggaggacggccatatcatagttattcatcccttgcatggtctgttctgccacttctaaagttctgcgaagtttaatttttggcaggtttcaagattctctacatactttgtaggttagagtgaacgtgcacagtatattgtgtaataattgcaatacaagacggtgtgttgtgttgtggcacggaatgcatcaacttaaagatagaattgttatgcagaatagagacctttgaaatatttgggtattatcaacttttatttcattttttgagaaaaacttaaaaagtgagcccagttttttaaaaagcatttcattgttctaacctacaattgtgcattgtatgtttgtgtgtgtgtgacggagggtgggatgaataaaaggggacattaaaaatattcagaccataaatatagtagattggaggttctgatttgatgagccagtttctcagccataaactgagagggggttggggatacacttcattgtccttcctggctaatgtaaatcccttatatttaaaaagatatttaaaagtattccaagcattttggcagaaaagcatagtatctaatgttatttttttcttattttatgtgcatgcctcttatccatttaaaaatagctttactgacctataatttacacactatataattctcccattgaaagtgcataattctgttgcttttagtatatttacagagttgtgcagcatcagcataatgtaatctagaacattgtcatcaactacccccaaatctctattcttcccttcccctattaattacccagccccaggcaagcactgatctacttttggtctctatggatttgtctatttgtggacactttaaatggaatcatacaatatgtgtcttttgcgactatcttctttcacttatcataactcaatacggctttagattatttgacctcgatgttctgcctytgaacataaaatattatccttgcattccttgatgagtttgaggattgagaataatttgcatgagacaaaaattagaaactagttagagcaagtaggcttttctccatcacataagctgatccatcttgccaatgttaaaacaccagattgtacaagcacaagctgggacgcaatgtgtgtccctctatccctacattgactttgcgggggtggggatggggtgcggggtgagtgagggaggactgcaagtgacaaacaggattcgtcaaaagagaggtgtattaaagtgccgatcaaatgtaatttaacagctaaactttccctccttggaaaacaggtgattgttgagtatttaacgtgaatcgatgtaaacctgtgtttggtgcttagacagggggcccccgggtagagtggaaccccttaagctaagcgaacaggagcctaacaaagcaaatttttccgtctgccctttccccctcttctcgttggcagggttgatcctcattactgtttgctcaaacgtttagaagtgaatttaggkccctccccccaacttatgattttatagccaataggtgatgaggtttatttgcatatttccagtcacataagcagccttggcgtgaaaacagtgtcagactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccgtaagttttgcgcgcaaactccccwccacctgcagacccggcgggtggccactgccacccgaactgaggatgagaagaaggaagttggaaggggcggtggatgcgcccagggactctcccagcctgggctctagccccgaaacggtccccggagtgggatccaggaggggccgggagggaatctcctcccgatcgtgaagcggcggcgcccagttcccgctttttctctctgccgggttcccgcgctatcccttccactctggctgggaccgcgttcccgggctcgcaggctccgccggggaggttccggggtgtgggggccgggacggcggaggcggggagtaagggcccggctggcggtgacctgcagtcacctctctgccggaggggccctggaatgaaaggcgcgcgggccaaggtgacctcgccttggttggcactgcggctcagcccccgcccggggactcgcgggccgactgtggccccttctggggaagccggggcgcggggaggcgttccgggcatctcagccgcacggggtacgctcgccctcggcggggcccctcgctccgctgtgggagtggcagtgggtgtcggggtggagaaagtacgcgtggcgcggagtcctggggacgcggcgtcccacccgctctggggagccccggactctctccagcttccaggctcgcatgcccctcttttcttagtgccctgagaacccagcgaggggctgaccctcccgaaaccgtggcgcagccaccagcaatctgtggtcgccgactcggggggttgccaggtctgcgtttggccaccctttctgtcctgggggctgaggtcagctccgggcgcccggccccgccgcgcggctgcgagcacgtggggttgacgggcgccgcgtggaggcagcgagcacaacggtggtcaccgccgccagggaaccgcccgctcgctggggtccaggcgttcggggccaaatgagaatgtctcagacctgtccgcaatggaggcagcctgcttaattcgaacctcgattcagtaaacatgcaacagcagcatagagagcagctgaagccattcataacacgggacaacatttccttttttcttccatgctggaattgcaattagggcggtgtcgcttggatgtgctctcaggcggcacgtccccagcggttcaagttataatagagtctctccatagctttgatggccgctaaacgtttgttttattttggcattaatttgtgaaacatttttgttaggttaaaaaacaaaaagttggcagggagcagtggctcacccatgtagtcccagcacttcgggaggccgaggccggaagacagcttgagcccagaagttcgaaatcagcctgggcaacatagggagacaccgtctctataaaaaaaaaatacaaaaattagccgggcgtggtggcctgtgcctgtggtcccagatagtcagcaggctgagagatcacttgagccagggagtttcagtagactgcagtgagctgtgattgccccactgcacttcatcctgggtgacagtgagaccctgtctcataaaattaaaacaaaacaaaacaaacactaagtatagattccatcaaagcaaaattggataagaaaaaaagtatcttttctattggatcagtttgaaaacactggagagttgatgagaaagtcttcaacatcttaggtggggtatgtttcgtatgtttcccttcgtactgcttaatgctgacaagaagatggtaggagccaactccaaattcttatttcagaaagcacaccatagaataacgtcattttcattgcaaaacaagcaccgaaatatgtcatcacattcaagtttttcctaggctcccttacaggttcaagatcctaaattcttgggagtcagtgtcacctctctgggtttaggttcctcaactctgcaatgagtttggatgaggccaatgttctctgagcctggtgtaactcttgcctctttaagtggacacttatgtgattaattagtttaattgagttgtagccaacacatgcttttcctagctgtaaatatattaaggaaggattatttccaagtagactggaaacratgccctcccatcccctccactttcactctactcacccaatatatcatgcctctcccatcacagcaactttctccctctttctcctccagatgcattcatctaggaaggtaagaatttcagggagagaaagatgtcaccgtggtagaaagacagggatcacctcctctgggctcttgagtttacttattcattctggattctttctaacaagaatatgaggacaagaggcactgtcctcaggcacttcgtcctgggagccaccaccatctctgcatggccccaattaggaaacgtgaagagctaggagagggagagtatggtcagtgcttagcagctgaagttccacttgcctggccatcgtgaatttccaggctgtcttctgagttgaacatgatggcaaaggasagcaaaatagcagatgtcactgaaggagagctcagcgagggagtgattgattaatagctgtattgaaaggtgggagtcaggtacgggggaagagckgcgatggaaaattttcgctttctttcagcagcttatttttaactcagctttctgttcttgctttattatggaggaaaaattgggccatagagtttactgccttatgccagattgttcaagaaaatgccttgcaacttacaatattttgcagctagtttcttccgtgaccaccacaaagactgcattgacttaaatatgaagatgttccagccatcaaaatgatggttggtgatgattttggatcacaaagtgtaaggaaagtattcaagacatgagtatcatgattttttaaggtctggatgaagagaccatttggatttactaataaggtaaattccaacttttatggcaataaaaacaacaraaacacttatcagtgtaaagctttgggatcatctatccattaaatgagtttgtcaccacagtgaactaaataccttttatcaacagagactttctaacctgggagtaaaattcttgtcacagtgcttttgtcacattctgtctttgcaaaagttgaaggctccaatagtttctgaaggactaataggatagggttccaacttactcagaggctaagagtttgaaatttactctgaacgatgtctgttcactagactgcgtgactgcagtttgctgtcttgtggccattttaagattgtctgtgtgcactgacaccatttgcgtactcaacaacaggtatctactaggaaggaaggaatggattatcttaggtgctatatatatatgtaagttctgccggaagtgagcctattaaacttgtgccaattcattccttttgctcttcccagtctgtgctctcagaatgatcaaatgctatctaagtagtgtggtgattttgactgtttgaatgaataaacgaaaacgtctcccaccattatttgacagtagaatagaacaaagatgacccagttggcgtggccacactgtgtctaatccagccaccttgctcacagcactcaacccactttggtgtgtgcgctcatctgtattttcgtaaatgttgaagtctctttctatgcagtcaggtaggggtaataccattctggcttggattaatttgagtgtagtacaaagtttagagaagcttttaagtagcatgaaaagtcagatgctttcggagggatggtggtgaatgtaggtaaatggatctgcacttagagatcctcaacagcccttcattcaagatacagctatcatgacatcaataatgtacctttgaaaaaaaattggctgcagaattaattacggtgaaaaacagtataggagttagcacttacattttaactaaaaagaatagcgtccccatgtttattcagccctccctccaataaaacaattgttggcaaagtaatcatggactttcattgtgttagtttgagacaactggatgtttccatttgccatcctcagcaacaagaagaaagtagtctcagattaaccaggtaantattttgtatttcacttaaaaaatcttgactgaaatatgcctatgtgatgacactcaaccaaattatttcattaaccagtccacaagatctccttaaataatgatggcttattcacacttgatggtctcattcagtggggcaattttaatacacatctctgaacctattttttaacccctctttttcagtagtgtggaaggttagccctaatattggagaaaattcagggtaaaattcagatgattcatacaggatttatttttcctattccattaataaaacaacttttataaaaataaaaagtaggctggcacagtggctcactcctgtaatcccagcattttgggaggccgaggcgggtggatcatgaggtcgggagttcaagaccagcgtggccaggatggtgaaaccccatctctactaaaaatacaaaaattagccaggcgtggtggcaggcacctgtaatcccggctactcgggaggctgaggcagagaatggcttgaacccaggaggcataggttgcagtgagtcacgatcgtgccactgcactccagcctgggtgacagagcaagactccgtttcaaaaaataataataaaataaaatgaaataaagtaaagctgcatgttagagaagtcaagagcattacttacgttagaatatctgaacagaccaatcaattcagtctgatcatgatattgatgtttttcttcaccaaatcgaccacatcagtaattcactttgttcttcgatatcctacagacactgcctgagtcgataactatgactatcagtctcagagagcaaatgaattactgaggaagccctgtaggagtgagagaaaaggggggagagagagagaaaggggtggggggataacaggagaacagaaattccaaagagaattgcattctcattgagttcttgtacctcatgtcattgcataaatgttcatcttactcacgtgatgactttgatctgcctttaaagcaccatctgctgctttcctgggatgctcaacacttccctctttctagcaacaagaattaccactcttcccctctatacatttatctttctctacgtgctttaacttctcagcctaatttcgtctctgtgagttattatctatgttagaataaattctttgtctttgtttacacactcagatttgtagttatttatttaggaatttaggaataaagattccatagtcaggaaaggcacaatttataacttgcgtgttacccaaaactctcccctaagggcttaatatggacatttctgaygaggcctgatgggcaggtggtacggtgatgctaagttaaattcagaatgaaggcctgcctttccttccctccttccttccccttccccttcttccttccttccttccttccctccatccctccctcctgtactcctcttctttctcaattctaaggtggccttaatttctaagggacatggcaaaagacagtctagttggatgagtgcagtcactaatattatttccatgtatggaaaataactgtttccttagtaacaattgcatcaaatcagttcacctgctgcccaatagcaatcacaggatgcattgggacaaataaatatactgactgccccacagccacatggtctaagtcagttactggagagctgactgaagtttgggaagcatattcatcttacgacactgagacatcctcggggggttgcaaacacaggtagtgtgaaaattatcagaacatccaagaaaaggaaagtttgactaagtgccgataagatttatgatgtcatgtctgacatagaattgaaaccatcacagagcacatagagtggtatattttcctgtcaaatgaaaatcattttctttaaaagtgaaatgaaagtctctaaatacaaatttactagaggatgtgtaaatttcctacttttcattacatactctggacccaacagagggaaattggagctgtcagtgagccatacatgcaatctggtacaggatctatggattgaatagactttttttcatggaactacacaaagccagtcttagtcatttcaaagaaaatttgtggtcatttcaaaaccaccagcaattccagggacaccaagttgcataattctaggggaaagtggactaaaagtgaatggcagcctctggagttatactgagcattattcttaaaatgtcaatttggcaaataggtggtaagcgagatctgtctgccagattgttcacatcatctctgctttaaaaagattgatcatagaatatgttaaaataagacctgtggagaggaggtatgagctatttaaggtggaaaggtgtgggagagggtgaaattagttttaaattttctaaagcactttttaacaggaaaagaagttcttgggcactgaaggcagaattagattaaaagtattcaatactcttccattatcagagaaatagtaaagctactagagtgctttctggttgggaaggaagaaggctaccaacatcttcaaataaagatgagaagtagagcatattcttggtggatgaatggattcacgtgtacttttactatatgcaaatgaaaagagctttaaagatcaatagtttagcaagactcttatttgaataagtgatcttggagtgtttacccattgtaacaaaactccttttctcataattagaatcattaagaaatttctcctacattttagatgacggaggtgtgtgtgcacgtgtgtgtgtatgtgtgtgtgatcaactcattgcatatttcttaaaccacaatattgtttaaggaattttagaaaataattactcaataggaaaatgttggccaatcctcagatatttagataaggctgattcaaatgcctattctttcactgttctcactatgacactcttatttttattattggcctgacttccgcagttattttgaagttacagatttttaaattttgagttgaaaaaaaagagcaaatttagattaaggaatgagaagtagtcctcgcagcctcatgaatctcctgaaatttcgaacggcaaaatctaaaatctacaagttattaccttcttacagtaaataggtgggtgttatgggtcgttttctttaacttctttacttgaaaaggaattaaatgatttccctttaacataacttccctttgattgtgctctgcttcatgaagtctgattttatttgcaatataatttacttcaactattcactgtaccccatgaagattcagcagcatttataactattgtccatagtttcaaaaactaggttgtctttctcttctcaccaagtttgggattaactatgaagaaccaaagtgaaccctttcaacaacaaggtttgctgtggttttcaagttttgcctttgtgtggaacattgtaatgacatagtgggaaaagaaatatttggggagagaattaaccatggctgatacatagcacgggtatttctgaacaacctactaaattatttcttagaacattttgaagtatatcttgccataggagtgggaacagtttcatacaaaagcctcctcatgcttccaacttttctttaaaaaatttttttaaaattattttattaaaaatagaggcccggcccgatggctcacactggtaatcccagcactttaggaggctgaggtgggcaaatcacttgaggccaggagtttgagaacagcctggccaacatggtgaaacctcatctctactaaaaatccaaaaattaaccaggcccggtggctcatgcctgtaatcccagcattttaagaggctgaggcgggtggatcacttgagcccaggagatagcgaccaccctgggcaacatggccaaacttcatctctacaagaaatacaagttagcctggcgtggtggcacgcacctgtggtcccagctactcaggaagctgaggtgggaggatcacttgagttcgagggtgcagtgaaccaagatcgcaccactgcactcctttggcctgggacacagaacaagaccctgtctcaaaaaacaaaacaaaacaaaacaaccccccccccgccccacacacacacaaatagtggaactatagcacacaagagccatgcatgagtcagtgttctccacgaaagcaagcttcaaagtggaactgagagaccgggctctgatcctcaccctcccactaataccagggtagcctcagccaagtcacttaaattcatgtcttgagagaagacagaattaactaaggaatccccaaacagcagttcccttagttgaaatcacaaacgtacacacacataccctgactaaggagagcttcaagaaaggctggaagacttaggagaggtcaatggtgacaatcttaattcagagtkaaggttgtctctctgtcaactttgctcaacgttggagcatstgttgttctcttgcaatccacattcgttttcgaaaacacttcagaaacaaaaatagcatcagcggtggttgcctgtgaacctaaaacatatcattccaatgaataaaatcaagcaaccctccagttaacctcatatccaatttttcctttccagaaagaagagattttatcracatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaagggaggctctttggggaagagtggattggggtggtgaggtatcctgactggcctgcccaattgttggggacccagtgatgggtccgcaccccacatctcacgtggatctccttacacttgaataaagacagttctggctcaggtgggatctgaagccacaggttcatgagaactccccctaggcagtgccagccttcattttaacactgtacctggttggtgcccttgagccagagcttcctgcgaggttggtaaaggatgctctgcccagctactgagcagaagataggtgattgctgtggggaaccggtggaaccctggcatgatcccgcatcacccagcacattgccaggagaacctttctaaagaagacagcatggaagagtgaggagagggctggagtggagtgaggaagtgtggcgtccatgctggctttgccattctccagctctgtgctgtggatcaagtcacttgtcatctctgggcctccatttactgatctgtaaagcagaggttgcactagatgtccctaaaaacactctacttccaaaattttccagttgtaaactttagggagcctttctggaaattaaaaaaaaaaagggctgggcagggaactgacatgctgacatgccagatgattagaaaaagtgaaactgtgattaaatttactttaaaaaattgttaaaagtcccctctctaatatgtcacacagtcactttagattatgtagttcttgcttagtttgttttaaaatgtttcaatcccaagtgagtagactgtgtaatttatttaaaaggatttgtgtaaaatggcttgttaaagatatattatctatccattatgtcagagcttgtgaatattataatactaatttctagtgagaactaactaaaaataacattcatctagtccacatttcttttcctacataatttaagtggctttgttattgactgaagaggacaatcgctacaatttttatagagatgagactactactaacagaattcacacagatgtttaacaaaatatagccatttactatgttaacatagtaaattcaatattttgtgataaaatctcaaattcctaaacataaatcctttaatattttaataggtgtaagtaggaaaaaggaatctttttcttttttgagatggaggctcactctattgcccaggctggagtgcagtggcgcgatctcggctcactgcaacctccgccacctgggcataagagattctcctgcctcagcctcccgagtagctgggactacaggcgcccaccaccacacccagccaatttttatattttcagcacaggcagggtttcaccctgttggccaggctggtctcgaactcctgacctcaagtgatctacccaccttggcctcccaaagtgttgggatgacaggcgagagccactgcatctggcccagaaaaaggaatctttagaggccctttggttatatacagaacttggattttaaaatttttcaaaaaatctgagcttaataaacgcatttatacaacagaaataaattgagtatctcagtcatctcaatcttatccctgagagaattttatactttgggaagttgtgggaaaaaaatggttctttttcatactaagatgacatgaccaacccaatatcaacagacggtgccacttcctatcattggtcctactgcctcactaagcccacctgtatctttcacatcatgtgtcctgacattttgagtgcttgagcacagagactgctgtctggctgtgggactgagttgggtctgtgcaagaactaagccagccacactgatcttgattatctcagtgaactcactggcagggtcaggtggcccacctggtataggcagcagggagggcttcagttcagctgcgtgtctgaaaaccaaagatttaaaacatagtaattattgaacctcagaagaaaaactcagattgaaagaacttagaataagaccctttttgagttgagaaaggtgagtacttagatttttcatttgctttgtttgggattacttacatcagtattttatgttgatcagaaagaaaggattcaattagctattgttcggttaataaaaatgtcagccactgtaggagtaagttggatgtrcagcctttttagattgcttaacttggaaacactgggctgggagcggtggctcatgcctgtgatcccagcactctgggaggccaaggcaggragatcactggaggtcaggagtttgakaccaacctggccaacatggggaaacccaatctctactaaaaaaatacaaaaaaattagccaggtgtggtggtatgtgcttgtagtcccagctactcaggaggctgaggcaggagaatcgcttgaaccaaggaggcggaggttgcactgagctgagatcatgccactgcactccagcctgggcgagacagtaagactctgccaaaagaaaggaaagaaaggagggaaagaaaggaaggaatgaaaggaaggaagggaaggaggaagggaaggagggagggaggaaggaaggaaggaatgaaggaaggaaggaaggaatgaaggaaggaaggaagggagggaggaagaaaggaaggaagaacaaagaaaagagaaacactggtagtacagaaaaacttctgatagaggcctagagtaaacccgattttcttgccttatctgaaataagctgcctggggactcacaggcacagacgaagggaaatgaggaggctctccagctgtgtcatgagacacccaaaggaatgcttagcatgtagcatgcatgtgatacatcccagcaggttgcttagacacagctatcttggagctttgccacttgcttggatgtcactggctttaagtacagggttcccattgtgaagtaggggatcctggctgaaacagggagacattaacattacattctgaagaaatgacatcaacctctcctgatcttgaaagccaactacaaagggtgcccaacaccccaaccttgaagggaggcgaaggtgagtgggactggaccaattcaacagggttctgctcctagccaggtgctcctgctagtttcctcaaagacccactttgcattcagaccaatctttccttttaatagtataaatgatcaaaattttattgaatgtctaaaatatactttttaaatgggaagcatggtgaaccccaatctgccgttcctcaactcaactcaatgccttcctggcttacttagatctgccttggaagggacagacctgtctctgaacactgttctgttatttgatttttctatctgtgccaatgggtttccaatcaagtttgttttttccatttcatgcaggtgtattgggctgatgtatctatgacaagtggtaggtgggtattttaagaaagcttgtgtcatcatcttcaggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtngcccggtttatcaactggatggaggtaagactgggagaaggagacttatgtgtccaaaacagtgtttttgactggagccagaaaaccggctgttctttcttccttttctcttagatttaaatattttctgggggcattcaaatcttcagaatcagcgtggatattattttatatccaaaagcaacattttgataagaatagactataaggccaataaatagtcctgccctgctctatcgtttgatattttcacagtgaatagatctgctgagaccaataactaagtgggcccaacagaaaaaagcttgtgattttcggacagaggaaagatggcatgttcagccagacccttccctaccagttggctggcctgtggacatcttatcctcaccttgacataccaatctctttcatgaaaatattaatagtacttattctttagtgtgaaataggatgaacgtttttgttgagcattgggagagtgatggaattgagctaggaagatgttggaagggaaggtgcataggatagaagggaactgaggtctggagttctgacttagctgcaagagacccactttttcacacgatcccttgagaagtacctctgaaaagtatcttggggttggaaagaagctgatactctgaccaaggcaaattattttaaccaggtaattggaagtaaaaaataagctgtgtttattagactgatcataaaagacaaaagttcttttcttgtcttttttgctgaccaggcaaatgaacatgggcaaacgggatcacctccctggggctcaggcttctcacctgttaaatgaggggctggaccatgtacctctggtcccttccactgaatgtttcctgagtctgtcattgcttggctaaccttcaatgataaagtgatacagatatttagagtaaggaataatgggaaaatatatacccatatactatacattcaaacatacacacatatacatatatgcatgcatataaatgtatacgcatatgtatatgtgtatatgtttgtacgtatagtatatggttatatatgcaaatacatatacatatacaaacatatgcatatattatatacataaataatactatttcagatgcatggaaaaactttgtaatttaaatctgctattaaagaaagagaaaatcaattctggatttgtttacggaaaagtgaaacaaaagaaaaagacaattttaacactagagaatattttctctctcttacctgtaacacaaaattaaaataagtagaattagttttcagtatttcctatatttggaaaacaatatttatattcattttgtttcttttagttttatttttggcagaamtgtmagcaccttcattttctttttcttccaaaggaggartttaactaccctctggacaatgtccatctcttgggatacagccttggagcccatgctgctggcattgcaggaagtctgaccaataagaaagtcaacagaattactggtaagaaagcaatttcgttggtcttatcataagaggtgaaaagactgtcattctgagagagaatcagaacaaaytttgttaaatacccacatgtgtggtgttcttcccggagacatgaccagcacttgattatctcattgtagggctctttattagggataagaaaaaacacagacgctctcactggcttactatccactggcaatagcacagaaataaagcataatyacacacaatgcctgcagatttctctgggaagcctgtttcctcccactctcagctctgtgttttagtagtgtaaatgcacatcagtactaggagaaaagaagaaggaccaattccagaggccacttcgaaagaagaccgtcatctaggcaaaggtgtggcatacacacagagagaaagaacccaccactgtttatacatcttctcgacatattcagaaataatctacaaaaggaaatccagccatcctgagtggaaaytgctgcataaggctagtttaagagactcaaattcattttagaaggagccaagcctccttttatgtctctctaagtaaagataccatgactgtagaataggagctaataagaatctaaatagctgccagtgcattcaaatgatgagcagtgacatgcgaatgtcatacgaatggaaatttacaaatctgtgttcctgcttttttcccttttaaggcctcgatccagctggacctaactttgagtatgcagaagccccgagtcgtctttctcctgatgatgcagattttgtagacgtcttacacacattcaccagagggtcccctggtcgaagcattggaatccagaaaccagttgggcatgttgacatttacccgaatggaggtacttttcagccaggatgtaacattggagaagctatccgcgtgattgcagagagaggacttggaggtaaatattatttagaagcgaattaaatgtgastctyatccttaacccttattgacccaatgtcctactcagtagcttcraagtatgtagttttcatatacayatttggccaaattatgtttctgaagaattctgcaatgttcagcatgaccaccttagagccaggcagacagccattttatcttttatttactatactgtaggctacactgagcagtgcacttacagtagcaagagaaaaaggtgggattttagacaggaagactccactgacctcaataatggcatcataaaatgctatctggccacatgttgtcataccttgaatgtagctgcaaagccaatggaaagattttagatgttmctggaacagaagatgttaattagsataaatcttccaaaatgttcagaacataatgttagcttaatgttttactttaataatgttagcttgtgttaaatttatgatttttgtttgtttgttttttgagatagagtcttattctattgcccaagctggggtgcagtcacacaatcacagggacttgcaatgttgcccaggctggtctcaaactcctggcctcaagtgatcctcctgcctcagcctcccaaagttctgggattgcagctgtgagccaccacgcscagtttacgatttatttttaagagccccttgcatactttatagacattgggacctacctaggatattctcgttatttttgtgcacgtaatagaacttagagcatattgttrctattttcgattgtcctaaaawcttacaaggaattcattcttatggcattgctgattatttctatgttcatttgatataaaagagtgttagtaggggcagaaccctcaattgtacataatatcaatgataaaatacaattcatttaacaattaccctcttaagatgtggtttctagaaatacaaattgtccytaacttacagttttccaactttacaattgggctgtaacaccattttaagttgagaagcacgtgatggtttgacttaaaactttttgacattatgatgggttttgggggtattaagtgcattttgacttacagtatttttgacttatgaagaatttattgtaaggcaaggggcaggtatatgtttctagaagcacctagaagtgttagacactttcaatgtaagagaaggatgagataaacaaggaaatcaacctccaccttggaggcttattacagcttcataaacatactcataaatataagaagcacaaaagtcaaaaattccctgtgaacttgcaactttcactctcttgaaggtgggtgggccrctaccaccaagaatatctcctgaaatagggcctacaatcataaatgcacaggactatatccttgggtgattctactctaacaccacatstcacctattttagacatgccaaatgaaacrctctttgtgaatttctgcygagatacaatcttggtgtctcttttttacccagatgtggaccagctagtgaagtgctcccacgagcgctccattcatctcttcatcgactctctgttgaatgaagaaaatccaagtaaggcctacaggtgcagttccaaggaagcctttgagaaagggctctgcttgagttgtagaaagaaccgctgcaacaatctgggctatgagatcaataaagtcagagccaaaagaagcagcaaaatgtacctgaagactcgttctcagatgccctacaaaggtaggctggagactgytgtaaataaggaaaccaaggagtcctatttcatcatgctcactgcatcacatgtackgattctgtmcattggaacagagatgatgactggtrttactaaaccctgagccctggtgtttctgttgatagggggttgcattgatccatttgtctgaggcttctaattcccattgtcagcaaggtcccagtgctcagtgtgggatttgcagccttgctcgctgccctcccctgtaaatgtggccattagcatgggctaggctatcagcacagagctcagagctcatttggaaccatccacctcgggtcaacaaactataasccttgtgccaaatccagcctacttcctgcttttgtaaatagtttttttaaaacttttaagttcaggggtacgtatgtaggtttgctaaaaaggtaaacttgtgacatgggagtttgttgtccagaatattccatcacccaggtattaagcttagtacccattagttacttttcctgaagctctccctcctcccaccctctgggaggccccagtgtctgttgttcccctctatgtgctcatgcaaagttttattaggacacagccacacacattcattaccatattgtcaaaggctggtttcatgycaccataacagagttgatagcccacagagcctaaaatatttactccctggcccttyacagaatgttcacaacttacataaaggcaaggaccatctgtcttatttatttatttatttaatttgagatgaagtctagctttctcctaggctggaggagaggggcatgatcttggctcaccacaacctctgcctcccgggttcaaatgattcccctgcctcagcctccggagtagctgggataacaggcatgcaccatcatgcccagctaatttttgtatttttagtagagagggggtttcaccgtgttgaccaggctggtctcgaactgctgacctcaggtgatctgccctccttggcctcatctgtctttttaaatgcaactattcctggaaggcaagaatatctcacaccttctaagatactgccattttgccaggagtttgtttcacacttgaatttcaagsttggcctcttgtttagaggcagacctaaaggaatggtcggaaaatgagagaggaggtcttcggataaatccggtgagagggaccaacttcaggaagggtggcttttgtggaatccagatggaaacctgagggaagggatgatattaaagaacagtggccccaggtaaaacatatggcacccatgtrtaaggtgattcttagaatctgtagaggtgtctttcgtggtatagaggttgaggcacctgtgcttcaaggaaaccttaactcttcaaaatcaggcaatgcgtatgaggtaaagagaggactgtgggaccataatcttgaagwcasagacaggcttcactcatccctgcctcctgcaccagtgggttcaaggctctgtcagtgtcccctaggggcacytcaccacycccagcttcttcagctctggcctgtcctgctgcctgcaagggttttgcttaattctcaattcaatgtctcttcatcttttagyagctgtggggttttgttgttgttcttctgtttttgcttagtatctgactactttttaattataaaawgagatgtatctaaacaaaatagagattgttatcagaagttcacaacatttattaaaaattttttcacctggacaagagtctaaagcagcataaaaatatggtctgctatattctaaaccatcagtcttaagagatctgtgtctcagcttaagagaaaatacatttaatagacagtaacacaaataagaaaaaaatctgaccaaggatagtgggatatagaagaaaaaacattccaagaattattttatttatttatttatttatttatttatttatttatttatttttgagacacagtctcgctcagttacccaggctggagtgcagcggcgcaatcttagctcactgcaacctctgctttccggttcaagcgattctcctgcctcagcctcctgagtaactgggattacaggcacccgccaccacgcccaamtaatttctgtatttttcttagtagaaacagggtttcaccatgttggccaagctagtctcaaactcctgacctcaggtgattcacccaccaaggcctcccaaagtgctgggattacaggcatgagccaccatgcctggcctccaagaactcttttttccyccatcatcatggttctattttagtcctgctgcctttccttttaacctctccccaggcccatttgctcagggtttttggtagagaccagaggaggggcagggaggagatatagaagttcaactacctgcttccagaggctgtccctagtatagaatactttaggggctggctttacaaggcagtccttgtggcctcactgatgrctcaatgaaataagttcttttttaaaaaaaattttatttatttccataggttattgggggaacaggtggygtttggttacatgagtaagttctttagtagtgatttgtgagattttggtgtgcccattacggaatggaaaaatcaacgaaataagttctatgatgcacctactagacacctamtctgcrctagatggtgggggaattaagagcatgggcatgatcctgtgaccggaagcccgcttacagtcagggtggaggacagacctactcatgaaacaaacacagtgacatatagtgacacagaagcaaatgycaaatatgcttgctccagatgctaaggcacaagatggccaaggatggcggagttcatggagaaagcatcatgagtgttttggccttctgatttgatctccctagcacccctcaaagatggctacttcctaatgctgcttggcaattcagacacatttgggtttttcctatgcatataaccacacttttctgaaagggagtagaattcaaggtctgcattttctaggtatgaacactgtgcatgatgaagtctttccaagccacaccagtggttccatgtgtgtgcacttccggtttgagtgctagtgagatacttctgtggttctgaattgcctgactatttgggrttgtgatattttcataaagattgatcaacatgttcgaatttcctccccaacagtcttccattaccaagtaaagattcatttttctgggactgagagtgaaacccataccaatcaggcctttgagatttctctgtatggcaccrtggccgagagtgagaacatyccattcrctctgtgagtagcacaggggggcggtcatcatggcaccagtccctcncctgccataacccttggtctgagcagcagaagyagagagcgatgcctagaaaacaagtctttagttaaaaaaatcagaatttcaaaattgaggtctttcctctatttgatattgagaaaaaaatgcttcaaattggccattttattttcacttactagttatatttttttatttatcatcttatatctgtttatttcttttataaagctgctgttaaacaatataattaaactatctcaaaaggtttgacattaaagaaaatgagcaatggtaacaggaaaccactctatagatgtacatataatatgtacagaaaatataagtagtaagaagtccatgacaaastgttagctcttttttttttttttttttttttttttgagatggagtctctctctattgcccaggctggagtgcagtgattcgatctcagctcactgcaacctctacctcccgagttcaarcaattcttctgtctcagcctcccgagtagctggggctgcaggtgcccaccaccrtgcccagctaatttttgtatttttagtagcgacagggtctcaccatgttggccaagctggtcttgaattcctgatctcaggtgatccaccygcctcggcctcccaaagtgctgggattacaggtgtgagccaccatgcccagcctaccctttactactaatcaaagaaataaaagtaaggcaacttgatacttttacaattactagatgaacaaatctttaaaaatagccagtgcagacaaggtggtgaagcagaacatgcgaacctaccatgcatcattcacggctagaaccctccaggtgcggaaggtagtattttaataactttccatagctacaaaatattattacatagaagggagtgatttttttctaatatttatcctaaagaaatagtcaacaaacatttttaaaaacatcaattacagtcgtacctatactagcataaattagaaacccagtatccaacattgaggcagtgggtaaatgaatcgtggtttatcaagtcattaaaatcaatctagcctttaaaaactataattstaggaaacccaggaaaacatagtaaaaartggaatataaaatctraagagaataaagaatagagaatcgtatgtgtgctatgattgtagctaaataaygttcaagtatcaacacaaattgaaaaggaatacatgaaaatgaaaattatatttctgaatgattgacttcaggattttcttttagaattgtattaaatagttcatgtcattaggataaatgctggaatgtggatataatttaaaatatactaaatgccatcgaccttcattttgagttctttgttggacatttttgtgcatttttaaaatatcccctaaataataaagctatttatatttggagaggagaaaaaaaagtrgggggcagggagagctgatctctataactaaccaaatttattgcttttttgtttaggcctgaagtttccacaaataagacmtactccttcctaatttacacagaggtagatattggagaactactcatgttgaagctcaaatggaagagtgattcatactttagctggtcagactggtggagcagtcccggcttcrccattcagaagatcagagtaaaagcaggagagactcagaaaaagtaattaaatgtatttttcttccttcactttagacccccacctgatgtcaggacctaggggctgtatttcaggggccttcacaattcagggagagctttaggaaaccttgtatttattactgtatgatgtagattttctttaggagtcttcttttattttcttatttttggggggcggggggggaagtgacagtatttttgtatttcatgtaaggaaaacataagccctgaatcgctcacagttattcagtgagagctgggattagaagtcaggaatctcagcttctcatttggcactgtttcttgtaagtacaaaatagttagggaacaaacctccgagatgctacctggataatcaaagattcaaaccaasctcttcmagaagggtgagattccaagataatctcaacctgtctccgcagccccacccatgtgtacccataaaatgaattacacagagatcgctataggatttaaagcktttatactaaatgtgctgggattttgcaaactatagtgtgctgttattgttaatttaaaaaaactctaagttaggattgacaaattatttctctttagtcatttgcttstatcaccaaagaagcaaacaaacaaacaaamaaamaaagaaaaagatcttggggatggaaatgttataaagaatcttttttacactagcaatgtctagctgaaggcagatgccctaattccttaatgcagatgctaagagayggcagagttgatcttttatcatctcttggtgaaagcccagtaacataagactgctctaggctgtctgcatgcctgtctatctaaattaactagcttggttgctgaacaccrggttaggctctcaaattaccctctgattctgatgtggcctgagtgtgacagttaattattgggaatatcaaaacaattacccagcatgatcatgtaktatttaaacagtcctgacagaactgtacctttgtgaacagtgcttttgattgttctacatggcatattcacatccattttcttccacagggtgatcttctgttctagggagaaagtgtctcatttgcagaaaggaaaggcacctgcggtatttgtgaaatgccatgacaagtctctgaataagaagtsaggctggtgagcattctgggctaaagctgactgggcatcctgagcttgcaccctaagggaggcagcttcatgcattcctcttcaccccatcaccagcagcttgccctgactcatgtgatcaaagcattcaatcagtctttcttagtccttctgcatatgtatcaaatgggtctgttgctttatgcaatacttcctctttttttctttctcctcttgtttctcccagcccggaccttcaacccaggcacacattttaggttttattttactccttgaactacccctgaatcttcacttctccttttttctctactgcgtctctgctgactttgcagatgccatctgcagagcatgtaacacargtttagtagttgccgttctggctgtgggtgcagctcttcccaggatgtattcagggaagtaaaaagatctcactgcatcacctgcagccacatagttcttgattctccaagtgccagcatactccgggacacacagccaacagggctgccccaagcacccatctcaaaaccytcaaagctgccaagcaaacagaatgagagttataggaaactgttctctcttctatctccaaacaactctgtgcctctttcctacctgacctttagggctaatccatgtggcagctgttagctgcatctttccagagcrtcagtactragaggacactaagcatgtgaccttcactactcctgttctgaattccaggaatatgcccttttcaaccctccacacatcccctgccagacagcaagtgctaatgggttacaggaacaaaggggagaaatattagatcatgtcatacaagccagtgacacaagaaatgaagggaaaggctagacacagtgtcatctggaaacaggaaaagcaattgcttttggtttgttcttttcctagtttgcatttgggacaaatgtatagaataagaattgccttcatgcctgcaatcccagcactttgggaggctgaggcaggtggatcacctgaggtcaggagtttgagaccagcctggccaacgtggcgaaaccacctctctactaaaaatataaaaattagctgggtgtggcggcacatgcctgtaatcccagctactcggcaggctgaggcgggagaattgcttgaaccggggaggcagaggttgcagtgagatgagatcgcgccattatattccagcctgggcaacagagaaagactccatctcaaaaaaaaaaaaaaacatgcctattaggaaaagtatattaaagaccctatgtgtaacatctttaatgtttttaaattctactttataatagattttatacatgtttactataaatagattaggaaaaataagcaaaaataaaataaaatcactgtgaccatatcactcagagacaaccccaattaacgtttttatttatattctttcggactttatatatacataatatttatatgtttttcgtcctttacaaaaatagaattatggtgtatatactctgaatgactagatgagaacatctggatcaaaagcattaatgtaagagcattcaggataaactcaaaatggagaatagttagtggtattgagccaggcaaaataacgcaattcttatctaactggagacttttcttctaagaggttattacgttgtttttcctcatcacaaatctgaggcaatatcatactttcttcagttcttagaaagagacttttagatgaagttttttttgtttgttttggttttttttttcttgagatggagttttgctcttgctgcccaggctggagtgtagtggctcgatctcagctcactgcaacctccacctcctgggttcaagcaattctcctgcctcagcctcccaagtagctgggattacacgtgtccgccaccacacctggctaatttcgtatttttagtaragaaagggtttcaccatgttggtcaggctggtcttgaactcctaacctcaggttatccacctgcctcggcctcccaaagtgctgggattataggtgtgagtcaccacacccggccctagatgcagttttatacatgcatttgtattacacataaatagcatgcatatkctgccagagcatctacaactttaaatctacatgtgaatgtgaaaataaaacctcattaaattagtaaataactctagctgcttgtaaagcacgtccagtcgtattttttatatgttacaagactttatctgagaaagcctaatgaagcattccttgtctgattataggattactgacagaacagttatttagacagagaatgttcagatgcgttttatttttattttttacttttatttatttttgagacagtctcgttctgttgcccaggctagaatgtggtggcgtgatctcggctcaatgcaactctgcctcccgggttcaagtgattcttgtgcctcagcctgacaagtagctgggattataggtgcccgttaccatgcccagctaatttttctgtttttagtagagacggagtttcaccatattggccaggctggtcattgaactcctaacctcaggtgatgtgcctgtctcagcctcccaatgtgctgggattacaggcatgagccacagcacccagccagatgcatttttaaaaacgtacctgaactttatctaggaggtaattataaattagactaataatcttctacagtttctttcttctgtgattaaaatcaatcaaatcaaagattctctttctcacaccttctgctaactcctcagaaacctcatatcacaagaaatgaaatggaacaggcctttcgtttgatacattttagaataagaaatcctctaaatttagaagtcatttggcccagtcctccaaaaatgatgcaccttattgggacggggctaaatagttgctccagtgtcttccattcctacaaacctgccattctctgatccattatacacatctcccctgggtttattctcacaacctttgttctgaaattccatttgaaggctttttccatcctaaaaccagtgggggacaggcgggaattgtaaaacactcagaagataataaattgccctttttcctgtgctttttctcagaaactgggcraatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagataccgtaattttattattagattctcyaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgttatttgttgtttttaacaactaatcaagagtgagtgaacaactatttataaactagatctcctatttttcagaatgctcttctacgtataaatatgaaatgataaagrtgtcaaatatctcagaggctatagctgggaacccgactgtgaaagtatgtgatatctgaacacatactagaaagctctgcatgtgtgttgtccttcagcataattcggaagggaaaacagtcgatcaagggatgtaytggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgytatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactyamtcttatgaaatgggctttaacaaaacaagaaagaaacgtacttaactgtgtgaagaaatggaatcagcttttaataaaattgacaacattttattaccacactaagtcattattttgtatcatttttaaagtaaatttattcttaggtcagattcactcagcatattttgactaagtaaccactgtacttagtaaaccgaagagcttctgagaattatagtgtaccttatagatatttttaacatttatatttgtataaagctaaagaaagccttacatatcctttaaactgactatagaagaaaatgatacagaattttgcctgcataaagtacacaggactattcttgcctacaatatgctttttcacaagcaaaatgttagactaatataaggcatctttggccattttatagtgtacatcatctctatttctgaggcctcattgttagctgtaacgcaagtagcatttgtgcaataaaatgaactatttgggatgggagggtacattttttagaactttgctttgggttgccttgataattaatagcatatagtccatttatgcagctaagtagggattgcttcttagtacagtcaggaagaatttagcccagaaaacaattatttcaatggccactgacccaaacttccaggctgaagagcaatggcgtgatcatggctcactgcacctccacctcccaggctcaagtgattctcctgcctcagcctcccaagtagatggtactacaagcacacgccactgcacccagctaatttttgtattttttgtagagatgggggtttcaccatgttgcccaggctggtcttaaattcctggcctcaagtgtctgccccccttggcctcccaaagtgctggaattacaggcatgagccaccatgtccagccttgacccaaacttttattgtcagttagctattggggcttctggagtttgggtctcccctgacaggagggggctccccagttcacacttggccactgcccatcaattcctgttgatatgatcaacaagatagacaattgcaaatgttgctgaggatgtggagaagtgtgaacctgtgtaagtggctgatgggaatgtaaaatggcacagccactatggagaacaatttggtagtatttccaaagttaagcatagagtttaacccatatgacccagcaattccactcctagatatatacccaagagaaatgaaaacacagatccacaaagatttgcacacacaggttcatagcagcattaatcagattagtcccaaagtggacaacccaaatgtccatgaacttgtgaaagagataagcaaaatgtgacaaattcacataataaaatattattcagaagtaaaaagaacaagcagcagatatatgatacaacacgatgagccttgaaaacgtttagccatatgaaagaaaccagatgcaaaatggaaccatgggcttaggggaggagaacggcacaatggtgtaaaagttgcagagaggaacaaaaaggctacctgcctcgctcccaggccaagtaacacaggaggaaagaaaatatccacatatgcgagggctaaaggaaagaggtgttctcaagctgaagcaggaggtgggactcaactctggaggtgggcctcacacactgtaccaaattgaggactagctaaaacagggatgggggtgaaagcaccttttcataagacatgcccaccattgtcccgttctcctcccttaagcccttgtcttgctcatgtcagcaagcttattgccatctattcttcctagttacagacatctgtggagctctgagttttttgcctaatcattattttagaacctggttcactctctctcccttctacactagttctgtcattattattactgatttcagtacctctgaggtgatagattttattttccaatggcagccacaacactacctcccattctatatgttcccctgcaatgttgccttgacatccctattaagagttggaatctagtcaccccgcttttctagtctccccactcctttgaacttgtgtgggccctaagattgcttctactagtagaatagaactaaaatgaccctggaccagtgtggggtgcagcccttaactggcctggcagcttctgcttttggttccttggggcactcactcttgggaaacttccctttggaactcagcattcatgatgcgggaagttgaagccacatgaaaagagcatatggtggttctctcagctcccagccaacaaccagtctcgactgtcagccatgtgagtgaggcatcttggacctccggccagttgagtgttcagaagactgcagctcgagctggcatctggatgcaaccacatgagagacgctctgcccagccaagcccagccaactcacagtactatgagagatactaataacttgttgttgttgttgttgttgttgtttttattattaaactttaagttttagcatacacgtgcacaacgtgcaggttagttacatatgtatacctgggccatgttggtgtgctgcacccagtaactcgtcatttaacattaggtatatctccaaatgctatccctcccccctccctaagtttttaggagtttgctttgcaacgatagatagttgaaacatctggatgatgcatccagtattctggcttctcactgcctttacctcctctctcccatggccttgtcttctaaatctacctttacatagaaacattcagtcacgtgctatactatatcatgccattactaataactcataaactcaatttcaacttctcccttctttgactaccacatgctatctttttactttaatcagtctagtgctctcagttcaacagctcctcaactgccccaggacctccaatacattgatctattcatccctcatttcctttcttagcctcactttgatccgtactcagcttagatttcaaggcccaaggttattattactccagtgccaaaactctaaagagctgtgcttctctcaccctcaactgagctcttcagggcaaaacataaaccctgaatatatccaaattgccactcaactccataactgcatctgagcagcagaatgtgataggtaacacacccatgcacacacagccctgctgcccctcactttaccgcctcactccatggctcccttacagctgcccagcagtcctcctacatttccctggtccaaacaggcctcactctccaagatgatgatttaatctcagacctctaataacttctcacctctctctacactcacctgattgccttatttactgagaatacaggggcaatcataaagctctatgtgcttcactcttaaatctatccatctccctgctcctgtgtccatacactctgttttcccttctgatataagagacgttttccctctttctacctctgaccaattcttgcataaaaagatcttgaaggagaaggaagtccttttctcctactcaaagacattgctctggagttgttcctgttctctcctgctcctcagttttcacctcctactggatcattctaacagcaaacaaaaatgtatacttcccacttaaaaacaaattaaaacttgcttgaacccacttccatctccaccttcctttttttttttttgtgatagagtcttactcttttgcccaggctggagtgcagtagcacgatctcagctcactgcaacctctacctccctgattcaagcaattctcctgcctcagcctcctgagaaggtgggattgcaggcatgttgccaccacacccggctaatttttttcgtattttaagtagagatggggttttgccatgttggccaggccgggctcgaactcctgacctcaagtgatccatccatcttggcttcccaaagtgctgcgattataggtgtgagccaccacacccggccttatgctcctctttatagcaattgcttaatctctactaatggtttctacttcccctcgcaatccttgaacaaagtctgatcaagccactttcaatctaccagacttattgtttctaagcttactgatgaataccatggcagtaaacccaatggtcgattctcctttgtcttcttacttgacttccctgtgtaatttgagccaggttgcttttcccttgaaacgatttttcactggtctcttaggactccactgtttgctaccctctttctcccattagctattccttctcactctttgttgattcctgctcatcttcctaacccttaacgtgttgagtgctccagtgctgaatcttcagtgtctcaacttcatttatatctattcacaaggtgatactcagttggctttaaacaccacacagctgctgatgaatccaaaatttacatctccatcttgtacctcgcttctaaatttcagactttttaatatatccacttgtctatcaaatatctccacttggctttctaataggttttgggaacctatcatgttataaaacattgttatccaccagttttctcctcccagttaaaagaatttcttccttccagttgctcaggaggaaatcttggaatccatacttgagttctttcttccgcaatacataatcaatcagtcaaaaaaactggcttggtgtcatggctcatgcctgtaatcccagcactttgggaggcctgggcaggagggtcacttgagcccaggaatttgagaccagcccaggcaacatggcaagacgccatctctactaaaaaaaaaaaaaaaaaaaaaaacacttagctgggcatagtgatgcatacttgtattttcaggagactgaggtttgagcatagcttgagcccaggaggttgaggctgcagcgagcttttattagcgaaaaagcactctagcctgggtgacagagaaagaccctgtctcaaaaaaaaaaaaaaaaaaaaaattctatcagcttcacttaaaaatatatccagaatctgactgcattttaccatttttaatgttatgccatcaggtttcactggattatttcaatagtctctcctggtttctctgctactgctcttgcttctcattagtctattaataatgaatcaggtgaactttctagagtagatcgtagcatcccattcctctacccagtacttcaactctctgtatttttcatcctgcctaacaacaaaaaaactataaattattgtttgcatatgcatgtgtgtgtttgtacgcatactgttgttattcaccctgttttacatttagcccatttctagctaatttttgtatatggtactatctgtggttagaggtgttttttgtttttgttgtggtagttgtggcaataatttcttttttacatagtcaaattattccagcaatttgttgaaaaaaatatcctctctccatcgaattacattggcaactctgttctctggtcctcacagatcagttcctcatgatgactgatttttcaggaaatgtgggctttgaacagacttcactcagaaagcctgtgctagagttccagcatagggacctcattcctttatcagggctcagatccttcatcctcttgtaacaggctctggacctacaatggaaatctgctgacatgagattaagagaaggtatctggaatgaaggcacttctccgactccacccattccgctgacagggctccaacaactccagggtcttttaatcaagagattgctaagtcaaagacaatgcctcctcagccaaatgtgaaacacaaaggtttcataatcaaaatgaaattccttcttagcacacaactggagaaagctctaaaggagataagaatcaataataagatttataaaatttggcagcataagctgaggatgatgatatttcccttaatctttatgtttccagatggcactggtgtggcagcagaaatcacatcatggatgagacgctaagaattggcacaagatctgcaccttagatccaaagactatgtgatccaggccctcaaatacatcttttctaatcctcataataattctatgaggttggcaccattgccccattacaaatggggagaggttatgtgcaaagtccaagctcacatc

SEQ ID NO: 17693 - DNA, 35770 bp, Homo sapiens
gaggccagagggtgatgagggagggggagagtgatgggagatgaactcagggaggggagcaagagccaggccacgtgggccatggtggagggtctgtaaactggggggtgaggaggggattaagagtcctagagggtggattaaatgaatggatgcttaaagtacttagcatagcatctgggatttagttagtactcggtgcattttctttttttcttttctttttttttttagatggaatttcgctcttgttgcccaggctggagtgcaatgggaccatcttggctcactgcaacctccgcctcctgggttcaagtgattctcctgcctcagcctcctgagtagctgggactatgggcgtgcgccaccacacccagctaatttttgtatttttttagtagagatagggtttcagaatgttggccaggatggtctcgatctcttgaccttgtgatctgcctgccttagtctcccaaagtgctgggattacagacgtggctaattttgtgggtgtgtgtgtgtgtgtttttagtagagacagagtttcaccattttggccaggctggtctcgaacccctgacctcaagtgatccacctgccttggcttcccaaagtgctaggattacagatgtgagccactgcgcccatcctaatttttgtatttttagtagagatgggatttcgccatgttggccgggctggtctcaaactcctgacctcaggtgatcagcccgcctcagcctcccaaagtgctgagattacaggcgtgagtcactgcgcctggcttgtttgttcattttttgagatggagtctcactgtgtcacaccagctggagtgcagtggtgcaatctcggctcactgcagcttctccagcgattctcgtgcctcagcctcccgagtacctgggattacaggcacctgccaccactccagactaatttttgtatttttagtagagacgaggttttgccatgttggccaggctggtcttgaactcctgaccttagatgatccacccccccctaagcctcctaaagtgctgggattagaggtgtgagccactgcgctcagccttaatttttatattatttgtagagatggggttttgccatgttggtcaggctggtcttgaactcctggactcaagggatctacctgccttggcctcccaaagtgctgagattacaggtgtgagccactgtatcctaccactcagtgcattttagctatcattatcacccctcagtaggatcgaaattgttatgtgtgtttcaggatgcgctcctggagggtacccttggccccatcttaatccttggactaggcttgtaaatatggggtgagaatcgtaataaaatgatattgaagacttatcccgtgctcactatgctcattacccattcatggattaatgggttaatggattagtgggttatcatgggagaggaagtggtggctttataaaatgagagagagagacgtgagtggcatgttagcacactagccttgggactctctgaagagttccagcaagaaggctcttactagatggggctcctccaccttggtcagtctcctataactgtgagatagaaattccttttctttataaattatccagttttggatattatgttaagagtaacagaaaacaaatgaagacaatgaggaatgcattattactcagctcattttatagatggggagaccaaggcagagaaagctaacttgcccaaggttgcagaggcaggaagaggtagtgccaggatttgaacccagatacttggttccagagtccatgcttcgtaacccctaccagtagatgccacagagaaacagtcctatagccacagcggcatccccttcccgatggctgcctcccacccctctatgtcccggctctcactgcaggggcggcatggaagctcctgtcaggcgtgcgggagggccaaacgcaagtggacaccccgcagataggggacatggcttactggtcccaccccatcgacctgcacttygccaccaaaggtcttcaaggtgggtatcacacctggacccggggccaggctgaggggagggggccagtagcctctgaggtccctggggctgggaacaccaagacctgtccctgctccccataccacgtaggtcccttttgcagccaagtctggccctggagaggctgagctaaggccttcccaggcctgctcaataggcgatcccaagtttgtatgattagggcagaggccagggtggagcaggaggtgggaaggtggggggtcagggtgggaggggaggtggcattcaagtaaagagacaaaacgagagtctccaataaagaggaagccgggaggcagggtctgagagaggcaagggctgtttctccaggaagggctcctcggcttgaaagtagagctgctgctcaaaggggaaatcagtactgggggaggagcggcatcagaaagcctttctagtagaaaatgtgggttcctggagatgagttgattctgagaaattgcctaggtaaatgtgccatatatttcaccaatataaagaacgtctacctggtacctgccctgtgtccagcctgtgttgggtgatgccagggagacattgaggatcaaggcagtgtcccttagccttgtcctcacagggttcaccgtcctatggggggacacacctctctccagacagtggcacctcagagtgggcaggactaagataggtgatttggagaggctgtgggagcccagaggaagtggctgactctgtcagggaggtcagagagggcttcctggaggagggggcttctgaactttgctgtgaagggccagcggagctaataaggcagagggatagaagaaggttctaggcagagggagctacgtggaagactcaaaggggaaagtgagccaagggcatctagtggattgagggagagcgggacggcagaggggaaaggcagaaggggacaggccatgcagggccttgagtgccaggctgaggagctgaggccatctcctgaaggcacttgggagccagagcaggtaatggacaagtgagatttcaccttttttttttggagacagagtttcactctgttgcccaggctggagtgtagtggcaagatctcagctcactgcaacctctgcctcccaggttcaagcaattctcctgcctcagcctcacgagtagctgggactacagccacgtgccaccacatctggctaatttttgccttttttttttttaatagagatggcgtttcaccaaggtggtcaggctggtctcgaactcctgacctcaggtgatccacctgcctcggcctcccaaagtgctgggattacaggcatgagccaccgcgcctggctgagatttcacttttaaataatctttctgtcttttaagctggagctggggaaaaaaaaaatctttccggtgctgtgtgggtgaggtgggcagctctaacctttcagctcttggggcctccagtcccccagtggtggcaccagccttgctttctcttttctcaagcccccattttgtccatcaggaaatcttaaactgcctctacttttgaaatatatcctaaatcccacttcttacccttttctcgcccagcaccttgatctgtccaagttcttctctcacatggactatgacaagaatcttgtctctggagtccccttccccaacccccctggtctgcaccccacatgcagctgggaccctgtgaacacctaagtcaggtcccatctctgctctgctcagaaccctccaatggtccccatctcactcagggtgaaagccatagtcttagcatgcatcacaaggctctccacaaccaggctggcacctccttcccgtctccccacctcattctgctctagccatgctgtccccaccaggcacactccgtctgggctccagccatactgtccccaccagacagtccccccccagggccttggcacttgctgttccctctggctaggagcactcttcctctagatggccacatggcctactcccttccttccttttagcatttgctcaaatgtcaccttcttaatgaagcttccttgatccccttcttgctaaagcggtatccccaccctcaccctacccagctctgttttccctcacagcaattaccaccatctaatctaccctataatttgcttatttactacattcgttgtctaggatatcagcttcacgggggcaggaatttttgtctgccatccatgttcatgtctgccgtgtccccagctagctagaacagagtctagcacaggagaagggatcagcatgagatgagatggggctggatctccaagggctttgactaccagactgaggagctgaactgtgttctgaggacatgggcaaagctatggaaggagagaaagatgcttccagatgccaggtggaaggtggattagagaggggcaagaaagaaggccctgggcccaaagggagcagggcagggacatgaggagggaaggcaggaggtgtccctgacaaggcccatgatggttacctggggactggaggagcaatgggctgccctgacatggggtcatggaggaggataacacagagaggaaattcagcagaggtctgattagaagggccttgaatgttgaagaggttggactttatactgagggcactggggagctatggaaggatccttagcaggggagtaacatggatttggaaagatcactttggctgctgtgtggggatagataagacggtgggagcctagaaaggaggctgggttggaaactctgggacagaaacccagagaggaaaagactgggcctggggtctccagtgagtatcagggagtggggaatcagcaggagtctggtccccacccatccctcctttcccctctctctcctttcctgcaggctggccccggctccatttccaggtgtggtcccaggacagctttggccgctgccagcttgcaggctatggattttgccatgtgcccagtagcccgggcacccaccagctggcctgccccacgtggcggcccctgggcagttggmgagaacagttggcacrggctttcgtgggtggtgggccgcagctgctgcatggggacaccatctacagtggggccgaccgctatcgcctgcacacagctgctggtggcaccgtgcacctggagatcggcctgctgctccgcaacttcgaccgctacggcgtggagtgctgagggactctgcctccaacrtcaccaccatccacaccccggacacccagtgatgggggaggatggcacagtggtcaagagcacagactctagagactgtcagagctgaccccagctaaggcatggcaccgcttctgtcctttctaggacctcggggtccctctgggcccagtttccctatctgtaaattggggacagtaaatgtatggggtcgcagggtgttgagtgacaggaggctgcttagccacatgggaggtgctcagtaaaggagagcaattcttacaggtgtctgcctcctgacccttccatccctcaggtgtcctgttgccccctcctcccactgacaccctccggaggcccccatgttgacagaccctcttctcctaccttgtttcccagcctgactctccttccgttctgggtccccctcctctggtcggctcccctgtgtctcatcccccggattaagccttctccgcctggtcctctttctctggtgacccacaccgcccgcaaagccacagcgcatctggatcacccgctttggtggcgcttggccgccaggaggcagcaccctgtttgcggggcggagccggggtgcccgccccctttcccccagggctgaagggacccccctcggagcccgcccacgcgagatgaggacggtggcccagcccccccatgccctccccctgggggccgcccccgctcccgccccgtgcgcttcctgggtggggccgggggcggcttcaaaaccccctgccgacccagccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccgggggrcgccgcctcccccatgccgccctccgggctgcggctgctgcygctgctgctaccgctgctgtggctactggtgctgacgcctggccsgccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgyacaacagcacccgcgaccgggtggccggggagagtgcagaaccggagcccgagcctgaggccgactactacgccaaggaggtcacccgcgtgctaatggtggaaacccacaacggtgagctcggaggggcaggggagccgggaggggggcccccagggggcgccggagtgccggggccacgggtaggaagtgactggcagaagaaactggctggaggaagaggacaccccggggcaaagggaacgtgtgatggtgggaggggggtgtccgaaagaggatggcactgagccccctaccacccaggtgtctggtcttggagaggaggagatagcgaagtggaccgcttctagagtgcgacagaaacatgcggggtcgtgggggcagtcccctagagggagacaagcaatagggggagggtagaaggctccctcttccaggacgcgttgaatggggggggggtcgtggggtgccaggtgcagagaagggagcctggtgtgggagaagcgaagaccccagcatttgggaaaggagaggcgctggagaaagttgacccagagcttgggggtcctgaggtggaaagattcaagaaggacagaaaagctagatgaaggcaaccccagagggtgccaggaaagtgagagcggacccacttccagaggctgccaggaacacgcgggatgcgggggtgggggagagtcgtagaaagagaaacagaggtgcgtgtgataaatgtggggagaaagggacgggaggttattggaaggaggaggcaagcgggagaggagcggagactcgggagggcgcccgggatgcagaggtgtcctcggtgtttcacacagggacgtgagggacagagtggggagcccagcggaggaatcgagcttccagaagacctagagtcctgggtcatgggaagggctttaccgagaggggagacaggcgtgggaaaggtggtgtgagcggggaggaggagagatacccagcgccatccacgctgcgagcagcgagcccccccattccccgcaggatgcaggggaatgggctgagcggagtccagccgcaggggaagtgctgggtggggggtgactctacaagaccgaggtgagaaaaccaagctgggaggagtgagaaagccccacgtgggtgccacgcgcggggggaggagcctgcgcttccaccaaggggcaggaggaccccgctgcgctaaacgctggcagtctggaccccaaagtcccagttcctctcagggtggctggggaaaccccagcgtccggcggcctcatcctcctcccttccctttccttcccatgcccccggcgggggcggggatcgctcgcggagcccggggcgagacggggcaggtctggtccccgccctcctggctgcggcgcctcccgccctcctcaccccagctacgggcggggctcccactcagccggccccgtcggcatccatgcgaggacccaggcgtcccgcgtggttcagagccttggggaagatccctcaggtttcactgactcttgggcggtgtgggcttgcgggttccctgcccatttctgcgccagtttacagctccagcccaatgacgcgcactccgcacccaagtctcagccttaccttatcttccgtggcttcaccttcgttgtagaggttcctttaacactgacacctccaatcctcttctccccaacaaatgcacatgtgtctcgtctcgcacgtgtctccccatctgcctctttcttttcgtctccgttagtctttctgtccacgcatgggtctcctggtttttgtctctccgactattttctctccctttctatttttctcctccacggtcckgttgcctcgtctccgtctctgacatctccccgcctctccctctctgcatcaccctccaacccttcctctccctcctctctgtcttcctccctatctgtcttccccagccaaggctctgcctttcctttggggtttgctgagtaacctccgggccaagaatagggcttactggggctgggtggggagggagactggggaggaggaggaggatcgaagggggccgtaggggaggggtttcctctgcctttctcaccagtctcttttcacacccccactatgggaggctggaagcagttgccccagttgatccagcagttcatggcctgttccctcatccccatccccaaacttttcctaaactagaaaataccttggctgggcgcggtggctcacgcctgtaatcccagcactttgggaggccaaggtgggtggaccacctgaggtcaggagttggagaccagcctggccaacatggtgaaacccggtctctactaaaaatacaaaaattagctgggcggggtggcgggcggcgcctgtaatcccagctacttgggaggctgaggcaggagaatcgcttgaacctgggaggcagaggttgctatgagccaagatcgcgccactgcactccagcctgggcgacagaaactccatctcaaaaaaaaaaaaaaaaaagaaaagaaaacaccttaattccttttctccccactacagccattcctacccagaatgaacttcactttccctaaccagctggggaagggagttaagggtggaaaactaataataaaaataagtagaagaatcacttaggggttaagagcacagtctctagctgggtgggtgtggtggctcatgcctgtgatctcaacatattgggaggctgaggcgtgaggatcccttgagcccaggagttccagcctgccgtgagccatggttgtgctactgcacttccgtctgggggacagagtgagaccctgtctcttgggggaagaaaaaaaaaaagcacagtctctggaatgagacagcttgagtttgaatcccagtctgcagctatgtgaccttggggcaaattacttaatctcggtgcctcagtttctcatctattaaacgggtataataatagtataaggttgtgaggtttaaatgtcttcatctttgtaaagtgctttagatagcatctggtaaatagcgctgttttgtggttttttgttgttgttgtttttgagacagagtcttactctgtcacccaggctggagtgcagtggcgcaatctcggcacactataacctctgcctctcaggttcaagcgattctcatgcctcaacctcccaagtagctgggattagagccgtccggcaccatgcctggctaatttttgtatttttagtagaaacggggtttcaccatgttggccaggctggtctcgaactcccgacctcaagtaatcaatccacctcggcctcccaaagtgctgggattacaggcgtgagccactgcgcccagccagcactcttagacgtatacatgattgagtgaccagtgtatgcagaattggtgccacatggcttgacctgggtcatctaatttcccactataatactggaatgggttctagagtcactctgtcttgtcttacacctggctcagagagaggaattcacttgcccaaggttacacagcgcttaaattaggagagtctgtgtgggaatgcagggagcttaatgttattgctgtttttcaaagaataacaggaaactgacattcagaaagagggtgttaactgcccatggtcacacagccaagaggcagcagaggcactatctgagtccaaagcctgtgcctttgatccttactctgcattttaggggctcttgcatttggggcaaggaaggccagagcaaacagagtggttccccttggtgccagccttagtcgacttgagagatgatgctacatgagagaggaatgtggttaggacctattttacagaggaggaaacaaacctagggggagaaaccacttcctcaaggtcacacagctaaaaagtatcacagtcagggctgggcgtggtggctcacacctgtaatcccagcactttgggaggccgaggcgggtggatcacgaggtcaggagatcgagaccatcctggccaacatggtgaaaccccatctctactaaaaatacaaaaattagctgggcatggtggcatgcgcctttagtcccagctgctcgggaggctgaggcaggagaattgcttgaaccctggaggcggaggttgcagtgagcagagattgcgccactgcactccaagcctgggtgacagagcgagtctccgtctcaaaaaaaaaaaaaaattcatttaaataaataaataaataaataaataaataaataaataaataaaaggtatcagagactgactccaccccagagctgtcagctccaaaactcctagagttgggagcaccagctcccctcacctctgccaaacccctgatckcctcccttcatttctccctgctagaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccaggtgaggacatgagccagaaggaaggtcagggcatgggctggagagggtgagctgtgaccaagggggtggctgtgggtcggctggttacaaggtccacctagatggtccctgaargatagaagaacacaaaccatacaatcctagaackcttttttttttttttgagacagtgtctcactctgttgccaagctggagtgcagtggtatgacctcagctcactgcaatctccgcctcctgggttccagtgattctcctgcctcagcctcccaagtagctgggattacaggtgtgcgccaccacgcccagctaatttttgtatttttggtagagatggggttttaccatgttggccaggatggtctcgatctcctgacctcgtgatccacctgcctcggtctcccaaagtgctcagattacaggcgtgagccactgcgcctggcctcttttttttttttttttttttgagatggagtcttgctctgtcgcccaggctggagtacaatggggtgatctcggctcactgcaacctccgcctcctgggttcaagtgattctcctgcctcagccacccgagtagctgggattacaggcatgtgccaacacgctgggctaatttttgtatttttagtagagacagagttttatcatgttggccaggcttgtctcaaactcctgccctcaagtgattctcctacctgagcctcccagagtgctgggattacaggtgtgagccactgcacccggaacctagagcacttttaaatgttcagactctttgcatcctaggatgttaaacacttagaaggctggaatcttaggagttggactctttaaggacacaggattcttgaaagttggaatctctgaaaaggttgggggctctagaatcattctgtccaatatgacagccactagtcacatttagcttgattaaaatttaaattgtttaaaattaaattaaaaatttagggccaggcatagtggctcacacctctaatcccagaactttgggaagccgaggcaggcagattgcttgagcccaggagtccgagaccagtctgggcaacatgttgaaacttcgtctctacaaaaaatactaaaattagcctgttatggtgatgcgtgcctctagtcccagctactcagtagtctgaggtgggaggattgattgagcccaggaggtcgaggctgtagtgaactgtgattgcaccactgcaytccagcctgggtgatggagcgagaccgtctcaaaaatatatatatataggccaggcgtggtggctcatgcctgcaatcccagcactttgggaggccagggtgggtggatcacttgaggtcaggagttcaagaccagcctggccaacatgacgaaactccatctctactaaaaatacaaaaattagccaggtgtggtggcaggcgcctgtaatcccagctacttgggaggctgaggtgggagaatcgcttgaccccaggaggtggagactgcagtgagcggagatcataccactgcactccagcctgggcaacagagcgagactctgtctcaaaaaaataaaaatgaaaaagaaatcctcattctcactggccatatttctagtactctatagtcacatgtggttagcagctactattttggatgttgcagataaagcacatttccagaaagttctttaggacagcactgctctagaagatagggagcttccaagaggactggggcatctggaagggctggaggctctagcagtttctatgagctagaatccatatcagagggaatgttaactcataggatggtagatttcagactttcacagtgagagaactttgtcctatgttagcttggcttcttggagtctggggaattcagctttattctgcagtccctggagtggactatccagccccagaaaattcttcttttttttgtgtgtktgtgtgatggagttttgctcctgttgcccaggctggagtgcaatggcaccatcttggctcaccacaacctttgcttcctgggttcaagcgattctcctgcctcagccacccgagcagctgggattacaggcatgcaccaccacycctagctaattttgtatttttagtagagacggtgtttctccatattggtcaggctggtctcgaacttctgacctctggtgatccaccctcctcggcctcccaaagtgctgggattacaagcgtgagcgactgtgcctggcccagaaaattattctacacagatgttgggtacctgcagcatctaggtgcggcatggcagactcttgggtttatagaacattagtcttctaaagcttctcaggctctagaagtggaaatcttgggatattatcaaacatttgaatcacaaaatgactttttttttttttgagacagagtctcactctgtcaccctggctagagtgcagtggtgcaatctcggctcactgcaacctctgtgtcttgggttcaagtgattcccctgcctcagcctcctgagtagctgggattacaggcgtgtgccaccacgcctggctaatttttgtatttttagtagagacgaggtttcactttgttggccaggctggtcttgaactcctgacctcaggagatccacccgccttggcctcccaaagtgctgggataacaggcgtgagccaccgtgcccagccggaatcattagaaattacttctaagttactgagaattcagggtgtcaaatttgcagaaccgtatgctcagtaaaccccagaatgtttgcagcagaattttattttatttattattattattttgagacgaagtctcgtcctgtcgcccaggctggagtgcagtggcgtgatcttggctcactgcagtctgtgtctcccgggctcaagcaattctcctgcctcagcctcccaaatagtggcgactacaggcgtgtgccaccatgcctggctaatttttgtatttttagtagagatggggtttcactatgttggccaggctggtcttgaactcctgacctcaagtgatccacccaccttgggctcccaaagtgctgggattacaggcgtgagccactgcgcccggcccagaatgttagcagcagaattttagcattgtgggctgtccacgctgagtggggcttagcatttcaccaatgaggaaacaggcctcgagaaggcaagaaaacaccttcggctgagctgtgtgaaggtgacttgaccgcagcctgagctttttctccacccctcctctcatgggtactgttggggaggatgggtgccacaggaccacacaggtggctgtctgagagggtagtgcctgggaactttctggaagcctgtttggggaagcagatggggtgaaggattcagttagtgtatgtggggtcgtgacaccatctacccactgtctctctcctgccttcatcatcctctagaaatacagcaacaattcctggcgatacctcagcaaccggctgctggcacccagcgactcgccagagtggttatcttttgatgtcaccggagttgtgcggcagtggttgagccgtggaggtgaggattacttgtgtgtcccacccctgtttctccctggggtccaccccattgtttgtcctggggtcactttgcctaggacccctctccgccccatactggtgtgaaagtgctgagacctggctcccctctgtggcatggaaacctgagtgattggctaatctgtttcctgagcacctctctgccctgccctgtgatgggtgatgccaaggacacagcaatgaccaaaacagccccatccttgccctcacagagctcatatagtccattggctaggtagctggggaacagacctgtaaggcagtgatgacccagagtgggtgggactgggatggggagcccaaaggaggtacctgacccagcccagaatcagggagggcttcctggaggaggggcaccatagctgatgttgaagggatgagtagaatggtcaggaaaaggagaggtgtaagagtattctggggctgggcatggtggcttatgcctataatcccagcacttttgaaggccaaggaggatggatcactggagctcaggagtttgagagcagcctgggcaacatggcgaaacccggtctctacacaaaaatacaaaaattagccatgcatgctgttacgtgcctgtagttccagctgcttgggagactgaggtgggagaatcacctgagcctgggaggtcgaggctgcagtgagycataatcacactactgcaatccagcctacatgaaagagtgagatcccatctcaaaaaaaaaaaaaaaaaaaaaagattccaggcaaagggaacagcctgtgcaaaggcctggaggccagggagagcctaachcatttgatctgtccaggagatgattgtctctgtctggtttctggcagggcccatggtgcccctatctctctccctcacctccctctcatttatgcttttattcaataattgcccacaggttcctgctgtgtgcctggccatgtgctgggtggtgtgggggacatagtgataaccaagacagccctcagttctgccctcatggggcccacagtcacttctggacacctaagagatcttgtcaaggccccaccaggcaggaatgacctagaatgatcaagaatgggatggggaggcaccagcagggaggacaaggctgggacagggaggcatgcaggatgggggaacgccctaagtgctgttgggagcccagagaaggcacctggacccatctggggagtctaggagggcttgctgggtgagggtgattgtgtggagactcacaggataaatagtagtttggccacatgaaaaaaaagggattagggggcctggcatggtggctcacgcctgtaatcccagcactttgagaggccgaggtgggtggatcacctgagatcgggagttcgagaccagcctgaccaacatggagaaaccccgtctctactaaaaatacataattagctgggcgtggtgatgcatgcctgtaatcccagctactcgggaggctgaggcaggagaattgcttgaacccaggaggtggaggtttcagtgagccaagatcgtgccattgcactccagcctgggcaacaacagtgaaactccgtctcaaaaaaaaaaaaagaaaagaaaaagaaaaaatagggattagggagcaggtgggcactgggaggagtgtcmtgggctgttcgacaaaggcctagaaggagctcatctgtcttggtcaatgctgagtcccaagcacacagcacaggcttcggcacattgtaggagcctagaaaacatcattcactcattcattcaagagattgatgctggccgggtgcagtggctcatgcctgtaatcccagcacttcgggaggccagggcaggaggattgcttgagcccagcctgggcaacatagtgagacctctgtctctacagagaatttaaaaagtagccgtgtaggccggatgcagtggctcaagcctgtaatcccagcactttgggatgccaaggcaggcggatcacctgaggtcaggagtttgagaccagcctggccagcatggtgaaaccccatctctactaaaaatacaaaaaattagccgggtgtggtggcgcatgcctgttatcccagctacttgggaggctgaggcaggagaatcgtttgaacctgggaggtggaggttgcagtgagctgatatcacgccactgaactccagcctgggcaacagagccagactccatctcaaaaaaaaaaaaaattagccatgcgtggtagcacgcgcctgtggtcccagctactcgggaggctgagatgggaggattgcttgggcctgggagattgaggctgcgagaccttgtctcaaaaaaaaaaaaaaaaaaaaagagagagctgcagtgagagggcagagtggggtgggtgggggaggcaggaaggaagcccctggggtttgctccttccttcctcttcctccaggggctgggtgagctgcactctcagactggcttccctctcgccactcctacaggggaaattgagggctttyrccttagcgcccactgctcctgtgacagcagggataacacactgcaagtggacatcaacggtgaggcctgcttccccggccatgcccagttgtgacgtgtgtgcgtgtgtgtgttcccatctgccccacgccccacttatctatccctctgagagtgtgtgtgtatgtcccctatcccctractcccacaccaaagcagggttcactacmggccgccgaggtgacctggccaccattcatggcatgaaccggcctttcctgcttctcatggccaycccgctggagagggcccagcatctgcaaagctcccggcaccgccgagccctggacaccaactattgcttcaggtgagccttgtagcctggatggaggccttccaggctgggggcatgactgcyatctgctgaccaggtgctccaggttggacacctggctgctgctgtgcttgggctgagcatctgtctcctttagcttggagggctcaggggatgaggtctgggtgtaagaaccaggagtcttgtgccaggtgcggtggctcacgcctgtaatcccaacactttgggaggctgaggcaggtggatcacctgaagtgaggagtttgagacctgtctggccaacatggtgaaacccgtctctactaaaaatccaaaaattagccaggcgtggtgggcgcctataatcccagccacaaaaaacaaaaaaagaactgggagtcttgtaatgttgggatcaggttcctttttttttttttttttttttttttgagacagagtctcgctctgtcacctgggctggagtgcagtggcgctatcttgattcactgcaagctccacctcccgggttcacacgattctcctgtctcagcctcccgagtagctaggactacaggcacgtgccaccacgcccagctaatttttttgtatttttagtagagatggggtttcactgtgttagccaggatggtctccatctcctgacctcgtgatacacccacctcagcctcccaaagtgctgggattacaggcgtgagccaacgcgcccggcctaattttttgtatctttagtagagactgggtttcaccatgttagccaggatggtcttgatctcctgacctcgtgatccgcctgcctcagcctcccgaagtgctgggattacaggtgtgagccaccacgcccagccttgctttcttgctggagtgttggaatcacagaatgttagaaagttgaaccctgtgattgttggaattcaaagttggaaggtcaccatcttgaatccctaaattgttggcaggttgaggttctagaatgctgggattctagaatgctagaatttggtgttaattactgaaatggaaaatgtcggactcaaggaaagctgaaacattggaatcctagaatttggggattcaaaatgggaagatggcccatgtggaattcctgcaccactggccaattgtggataccagtgttggcagattggagtccttgaatattgggctcacagtggtagaattctgttttgaaatattcacatccacaaatgttggagttggagaaagcagaatattggtatctcagcatgttggaactcagtgttggaatgttagaatattagaatgctgggattttattaatagaaagtggcagcaggctgggcgcggtggctcacgcctataattccagcactttgggaggctgaggtgggcggatccctgaggtctggagttcaagaccagcctggccaacatggtgaaaccccatctctattaaaaatacaaaaattagccaggtgtggtggctggcacctgtaatcccagctactcggctgggattacggctatccaggtacccaggctggggcaggagaatcactggaacctcgggggtggaggttgcagtgaaccgagatcgcgccactgcactccggcctgggcaatgatgcgagactccatctaaaaaaaaaaaaaaaaaaaaagaaagaaagtgtcagtttgaacctcttgagtgatggctcagaactttggaatgttgggatgcaatactggcatactggaattcaggaatgccaagatcctcaaaggttggaaagggggaatcctagagagttgaagatgctgtcagaatgttagaatcataagatgctggaatgctaatactgcaatctaagaaagctgaaatgttggattcctagaaagttgaaatggagagttagaatgttgtaaatttagagtgatcatctgaccttattcctcccttgcttaaaatattttggtcctgtctctgggctttgttaccggctgtttccctgccagaaaatcagccctgctcccaggctccttcaccaccagatcttagcgccatcagcccagcaacsctgtcaatgaacaaattgaggtcttttttgagacagagtctcgctctgttgcccaggctggagtgcagtggcgtgatctcggctcactgcaacctccgcctcccaggttcaagtgattctcctgcctcagcctcctgagtagctgggattacaggcgtgtgccaccacacccggctaatttttggtttttttagtagacactgggtttcaccatgttggtcaggctggtctcgaactcctgacctcgtgatccacccgcctcggcctcccaaagtgctgggattacaggcatgaaccactgcgcccggccacaaattgaggtcttgagtgccaacagctcctgacattacaaagggagatagccagccatgtcagcctccgtagggagggacccaatgttgcctaggaagtcttggcaaaaaatcaaacctgaaggccaggtgcggtggctcatgcctgtaatcccagcactttgggaggccaaggcaggcagatcgcttgagcttaggagttcaagaccagcttgtgcaacatgttaaaaccctgcctctgtacaagaaatacaaaaaaactagctggctgggtggtgtgtgcctgtagtcccagctacttgggaggctgaggcaggagtgcttgagcctaggaggttgtggctgcagtcagccaggatcacgccactgcatttcaggacagagcaggaccttgtctcaggaaaaaaaaaaaaaaatcaaacctgaatctgatcaggactgtagatcctaacagttttctagaaagacaggaacagaggaaatggtcagcaaaactcagactgcaagaaacctcacccagtttcttcatcaaatacaatgcaaagaaggggaaagcacacacacacacacacacacacgtaccccccatgcaaccaaaaattcacatacaagttttgactccccaaaaacttaactattaatagcctactgtggactggaattctgctttatccacaacataaacagttgattaatacttttttttttttttggagacagagtctctgtcattcaggctggagtgcagtggtgcggtctcggctcactgcagcttctgcctcccgggttcaagtgattctcttgcttcagcctcccgagtagctgggaccacaggtgcccaccgccacgcccagctaattttttgtattttagtagagatggggtttcaccgtgttgcccaggctggtcttgaactcctgaggtcaggcaatccgcccacctcagcctcccaaagtgctaggattacaggcatgagccactgctcccggccgaataatacatattttgcatgttttatgtattatgtcctatatcccctttttttttttttgagacggagtttcgctgttgtcactcaggctggagtgtaatggcacaatctcagctcacggcaacctccacctcccgggggttcaagcaattctcctgcttcagcctcctgagtagttgggattataggcacctgccaccatgcccggctaacttttgtatttttagtagaggtggggtttcaccatgttggccaggctggtcttgaactcctgacctcaagtgatctacccgcctcagcctcccaaagtgctgggattgcaggggtgagccacgcacccggccgtattctttgtttttttttttgagacagagtctagctgtgtcacccaggctggagtgcagtgaagtgatctcagctcactgcaacctccgcctcccaggttcaagcaattctcctgcctcagtctcccaaatagctgtgatttcaggcatccgccatcgcacccgggtaatttttgtatttttagtagagacggggtttcaccatgttggccaggctggtcttgaactcctgacctcaggtgatccatcagcctcggcctcccaaagtgctggccttacaggcttgaaccactgctcccggcctatgcctgcattttaaaaataagatagagaaaagaaaatgtccttaagaaaatcataaggaagaggaagtatattttccattcattgagtggaagtggcttatcataaaggtcttcatgttgagtaggctgaggaggaggaagaaaaggtgttggtcttgctgtctcagggcagaggtggaagaaaaattcacctgtaagtggtgaattttgtaagaggacccatgtagttcaaacccatgtccaagggtcagtctatatatagttgaccctgaatatatatacagagagagagagagatgattttgtagattttgaaaaaagtcctaagagaggccaggtatggtagctcacgcccgtaatcccagcactttgggaggctgaggcaggtggatcacttgaggtcaggagttggagaccagcctggccaacatggtgaaaccctgtctgtactaaaaatacaaaaatcaggccagctgtcgtggctcacacctgtaatcccagcactttgggaggccaaggtgggtggaccacctgaggtcaggagttcgagaccagtctggccaacgtggtgaaacctcctctctactaaaaattcaaaaatgagccaggcgtggtggcgggccctgtaatcccagctactcttgaggctgaggcaggagaactgcttgaacccaggaagtggaggttgcagtgagccgaggtcgcgccattgcactccagcctgggcaacaagagtgagactcccgtctcaaaaaaataaataaataattaaaaatacaaaaattagcagggtatggtggcaggcgcctgtagtcttagctacttgggagactgaggcaggagaatcacttgaacctgggaggcacaggttgcagtgacccgagattgcaccacttcactgcatcctgggtgacagagtgagactccatctcaaaaattaaaaaaaaaaaaaaatcctaagagacatatcaaccaattgcaatgtgtagaccttacttgaatccttatttacacaggcttaaaaaaaaaagatatttatgagacagttgggtaaatgtgaactctgtctagatattcctctagatatcaaggaattgttaattttcttacatggtattgtgactgtgttttaaagtagtcttaattagagatacatttgaaatatttatggatgaagcaacacggtggattgcatgtgctttgagataaaccattgtcggctggctgcagtggctcacagctataatcccaccactttgggaggccaaggcaggaggattgcttgagcctaagagttggagaccagcctgggcaatatggtgaaaccccatctcccaaaaaaaaaaatatgaaaagtagctgggcctggtggtgtgtaccttttgtcccagctactcaggaggctgaggtgggaggttggcttgagccccaggagctggaggccacagtgagctgtgattgcaccactgcactccagcctgggtgacagagtgagatcctgtctcaaaaaaaaaaaaaaaagagatagtggataggggtagagatgcaatggaaattggccatgagttggtcattgttgaagctgcttttgtgtacatctgaaactttccagctggacgcggtggctcacacctgtaatcccagcactttggaaggctgaggcgggtggatcacatgaggtcaggagttcgagaccagcctgtccaacatggtgaaaccctgtctctactaaaaatacagaaaaattagctgggtatggtggtgtgtgcctgtaatcccagctacttgggaggctgagccaggagaattgcttgaacttgggacatggaggttgcagtgagccaagattgcaccactgcactccagcctggggcaacagagcaagactccatctcaaaaaaaaaaaaaaaaaactttcataggaaaatttgttcttaaggcagctcgaacactacctccttcctaacccctttctccaacatccaagatggatgtgaggcctctgggcctcccctggggccctaagtagatctttgactcaacaaacagtctctgttgggtcttttatttataaaaagttttgtagcgacagggtctcactatgctccccaggctggtcttaaacyccttgggctcaagcgattcaccggtcttggcttcccaaagtgctgagattacaggcgtgagtcactgcacctggcctaggtcttgagagactggacggaagaggcttggcaagggcaagggctgtgggtatcccaaggcccggtgcagggtaggccccgaatgtgtgctgaaaaaatgagtcagaggatcacctagacggcttgttcaacacggactgttgttcccagtcctgcacacaatttctgatttcagtggcctggggtgccacctgagaatctgcatttcccatagttcccaggtgatgctgccgctggtcctgggagctcacgtggagagctgctgacttggataacagtatcacagattgttcaaatcctaggatctcagaaccccagctagggttgaactgcatattaaagatgattctgagccgggtgcggtggctcatgcctgtaatcccagcactttgggaggccgaggtgggtgggtcacctgaggtcaggagtttgagaccagcctgaccaacatggtgaaacccagcctctactaaaaatacaaaaaattagccaggcatggtggcacatgcctgtaatcccaggtacttgagaggctgaggcaggagaattgcttgaacccgggagacggaggttgcagtgagctgagatcacaccatcgcactccagcctgggcaacaggagggaaactccatctcaaaaaaaaaaaaagattccggacactagttcttccccttttgtgagttcagaacttcctgtgagaaagtgaaagccaggactctttttcccagaaatacatgcatacatacacacatgtgcatatgatctcaggcactcatggccctccctaagcctgcccatgatggccccttggccctcagcttaacaccttattttatctagtagctcctacctctgaacagatgaggaaactgaggtccaaccaaattgggtggtacgggctgagttcacagggatctcagtttcttgacttccttctcaggcttctgtggctcttggaaaggctttatcttgcctctaggttatccggtgccacttgaagttgggttcaagcgattctcctgcctcagactccccagtagctgggattacaggtgcccgccaccaggtccagctaatttttgaatttttagtaaagacagggtcctcaagtctgcctgccctagcctcccaaagtgccgggatgacaggcgtgagccaccgtgcctggctggccccaccaatctatgagcagaggttgcagtgagccaagattgcaccactgcactccagcctgggtgacggagcaagactctgtctcaaaaaaaaaaaaaaaaaaaaaaggcattgtcaactttttcttttcttttctttcttttttcttttcttttcaagacagagtctcaccctgttgccctgggtggagtgcagtggcacgatcttggctcactgcaacctctgcttcttgggttcaagcagattcttgtgcctcagcctcctgagtagctgggattacagacaagcaccgccacacccagctaatttttgtatttttagtagagacggggtttcgccatgttggtcaggctggtctcaatctcctgatctcaggtgatccacccgccttggcctcccaaagtgctgggattacaggcgtgagccactgcacccggcctctttgacagttctaagaagtaaaataaaccagaagaaggcaggcagagagtaatagatattgggaactgttatttttcctattctgatttaaattcctttattatggaaaatttcaaatgtatacaaaagcaatgaagataatgaatgcccgtaaactctcatccagcgtcatcggtaattaagattttgccccatttcaaatgcagacatttttatattttcttgcataactgcaataccgtattgcactaaatggaactaacagtcacttggatattttggaaaggatggctcagaaaggtatctctgaggaggtgatgttcagtcatgtaactgatatttactagtacctactgcattccaggcactgctttaggagttaagggtccctgagtgaaggacatttgagctaaggtttaaatgaagtgaaggggccaggtgtggtggctcatgccagtaatcccaatgctttgggaggccgaggcgtgcggatcgtttgagcccaagttcgacaccagcctcagcaacatagtgagaccgtgtctctaaaaagaataacaaattaaaaagaataaataggccagatgcagtggctcaggtctgtaataccagcactttgggaggctgaggtgggcggatcacaaggtcaggagttcgagaccagcctggccaacatggtgaaaccctgtctctactaaaaagacaaaaaaattagccgggcatggtggcacacgcctgtaatcccagctactcggaaggctgaggcaggagaatcgcttgaacctgggaggcggaggttgcagtgagccgagatcatgccactgcactccagcctggcagacagagtgagactctgtctcaaaaaaaaaaaaaaaaaaaaaatagaaaaaaaaagaagaaatgaagtgaaggaacaagctggagtgggtatctgtgggactagcaaggcaggcagagggaacagcagatgcaggagccccgaaataagactgtctgaggaacagacaggacgccagtgtggctggagtggagtaggcgtgagagagggagttgagatcagccagatttgatagcaccttgtggctcacggtgaggacttgggcatttgccgtgagatggagccaggttcagagcagaggagtgacaagacaatttatagcatgcccatggagggcagagatttctgtctcttttttaaaaaaattgaaaaaaaattttgtagagacagggtcttgcactttgttgtccaggctggcatgcagtggtgttatcatagttcactgcaacctcgaactcctcgactccagcgatcctcccacttcatcctcccaaagtgctgggattaaaggtgtgagccaccatgcctagcctatttctatctgtttcatttgtcctcagtccacagtagatcccagcccagcacacagtagtagttcaataaacatttgttgcacaaatagagcagatcagtttacatggagctgtgttattttgtatgttccagggtgtggcatgccatgatttatttagcccccccgtggatggtcatctggcttcttacaggcttgtcttaagcattgcgtgaaattaattattacattgctcttagcactggaggaagtgcttaatctgtgttagtgattatcatgactatttgtgttgttattaacacagtgggtgcaagggagacccagatggagatagggctgggggggcaacctagggtgacacacgcacctggggaggaggggcatgtggcttctatggtggtagcccctccctgcccctgaygcgtctctcctgcctgcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtacgtctggcccaccgggctacgagatgcgcttggggggagccaggacggaggaagaggagagagaaagagaagtaaagtcagagaggtgagttggcaggatggggagaaagagagggatggggtggggaggggaatgaataaagagatggggagagaggcaggaagctagagaggggctctgagcaggggccagagggagatgagctatgaagacccacagagtgaagtaacagagggatgggggtgaaggggagaagagagacagggagatggaaggaaaaaygcagaaatggagagacaaaatgagagagacagatacagacacagagttaggccaaggagagacaaagacagatacacaacaaggcaagaggcgaagatgaggagggacagagactgagaaagaaaatcaggcgggcgcggcggctcacgatggtaataccaacactttgggacgctgaagcaggaggatcgcttgagcccaggagttcgagagtagcccaggcagcagactgagatcccatctctaccaaaaaaaaaaaaaaaaaaaaaaaaagctaggagtggtggcgcttgcctgtggttggagctactccggaggctgaggcgggaggatggcttgcgctcaggaggttgaggctgcagcgagccatgatcgtgccactatactccagcctgggtggcagagcgagacccagtctcaaaacaaaaagaaaatcagacaggtggggagagacagaataagataggatgttagaagataagagagaccgaattggagatgggaagaggggatgcggggagagacgaagtgagagaggctggcgcggtagcgggtgggggatggggcagtggagggccgttttcctccctccacgagccctgagccctgaccccgcccgccgcccgcaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcggatctctgtgtcattgggcgcctgcctggggtctccatccctgacgttcccccactcccactccctctctctccctctctgcctcctcctgcctgtctgcactattcctttgcccggcatcaaggcacaggggaccagtggggaacactactgtagttagatctatttattgagcaccttgggcactgttgaagtgccttacattaatgaactcattcagtcaccatagcaacactctgagatgcagggactctgataacacccattttaaaggtgaggaaacaagcccagagaggttaagggaggagttcctgcccaccaggaacctgctttagtgggggatagtgaagaagacaataaaagatagtagttcaggccaggcggggtggctcacgcctgtaatcctagcacttttgggaggcagagatgggaggattacttgaatccaggcatttgagaccagcctgggtaacatagtgagaccctatctctacaaaacacttttaaaaaatgtacacctgtggtcccagctactctggaggctaaggtgggaggatcacttgatcctgggaggtcaaggctgcagtgagccctgactgtgccactgtatgccagcctgggtgacaaagcaagactccatcttttttttatgttttttttttgagacggattttcactcttgttgcccaggctggagtgcaatgtcgagatcttggctcaccacaacctctgcctcccgggtttaagcgattctcctgcctcagcctcccaagtagctgggtagctgggattacaggcatgcgccaccatgctcggctaattttgtatttttttttagtagagacgaagtttcaccatgttgttcaggctggtctcgaacttctgacctgaggtgatccgcccgcctcggcctcccaaaatgctgagattacaagcatgagccagcgcacccagccaagactgcatctttaaaaaaaaaaaaaaaaaaagactgggcacggtggctcacacctgcaatcccagcactttgggaggctgaggcagggggatcacttgaggtcaggagtttgagaccagcctggaccacatggtgaaaccctgtctctactaaaatacaaaaaaaggctgggcgcagtggctcacgcctgtaatcccagcactttgggaggccaaggcgggcagatcacgaggtcaggagtttgagaccagcctgaccaacatggtgaaacccagtctctactaaaaatacaaaaattagccatggtggcgcacgcctgtaatctcagctactcaggaggctgaggcaggagaatcgcttgaacctgggaggtggaggttgcagtgagccgagatcacgccacttcactccagcctgggagacagagtgagactccatctcaaataaataaataaaaataaaaaatacaaaaaaaaattagtctggcattgtggtgcacacctgtagtcccagctactcaggggcctgaggcaggagaatcgcatgaacaggggaggcagaggttgcagtgagctaaagtcgcaccactgcactccagcctgggcaacagagtgagactccatctcaaaaaaaaaaaaaaaaagaacttgcactcaaggaagacaggagccatggcagggtttgacctaggcgctcagagggtccgccgtcttgctcatggttgggagtggacagaagtgtcagggtgagggtgagcacagacagaccagctgtccaggcaagaaatggcagcagccacaggtgggtctccctctgctgtctccatttcttcccatctgctatggtcctgcttgtgaattctctcctgcttcctctttctcctgcctctcagtttctgctctttctcctaggtttcacttccccacacccagtgattgtcctgggaggaaggacagtatgagtgctgcggttcctttgcctgtgggcatgagagctgttggcagcactgggtctgggtgccagggacctggggccctcccagctcagcataggggtagaaatgtggttactcctctggcctcaggtcccaaagcacacagggctgagggaggagtggggaggcaggagttcactatgcaaggacatgccaacaaatggataggtatagagatgctgaggtctggccccaagaggcagagtcacaagctaggacacagtgactcggctgtaatcgctgcagccctatgaggatgtggtgcgtgtacacatgcagacacactcacacggcgggaaacacggacggtgccccacactacacaaatattcacctctcagagccgccgtggacacacagagactcctgcagggcccgtaacacatgggctgtgtcatttggcagcagctgcagcccacatatacacagatacaaatagagaaagtgtcagcccatcacgtaaacaccacccagcctcggagcctcactgggacacaacacgagcagagacttcaatagggacctggcacaacacagtcatatacaaatatattccacagggtcatggtcgcaaccaccgcacaccagacactgattcaaacagtgtcatgcacgcacacgcatcacggcatcagagcccggacaggaaatggatccctcaacagccacctcctcctccatgggttcacagtcacaaacaggtccagggtgcatgtccacagtcggacctgtcacagtcccaccagacacaccccacacagaggtctgacacgtcacaacctcacagacagcaggtcggtcttacccactcagtctgacatcccacaccctccgccacacacgcacaattccagcctggggagtcccacagggccccacagattgcagcgaccccgtcacgtcacgcccagacacactgtcacacccagggtcccagacggagcagacacacccccagggtggcagacgcggccctcacatgcccagccccagctcgtgcctcggcctgaggacaagtgctggctgcacattcgcggtgtggtcggcctgcccaacacgccctcatgacacaccccgcccacctgcccagggctgccggctgagctggcacagccccacagggcggggaggggaaactgtgggctcagcaccttcctctggccgcgtgcgcactgcccctgccctgccaccctggcacccaggcccgatgggtggctcagccccgtcgggacaagtctgcccccgcctgtggccgaccgcaggggcagggcagggggtttggggctccccgcttcctccccctgccccgcccctgcctctgcaggcggcccggggccacagagggaagtcgtggggggagcctgggttccggctggagccccagcttcctgtccagcccccgtggggcaggaagctgctgggggaggccagctcaggccttcctgccccctcccccgcccccaagacgggcctgggacccgggtcagcaagggggagtggggagattggtgggtgagagaaagccccttcccccttagtctctggacatgcagagtatttgaggttccagtgtggattcggatttgtgtgttcaggaacttattgtgtgcgtgattccaagctttgtggcgtgagctgcgtctggcatgggtgttctgggggcctgtgtgctgtttggtatggatggtcttgtctgtgtgtgtccccagcacgtgttagctccgtgtgtttgtggctgcgctgcatttctggggtgtgcgtctgcattttgtatttctgctgggcaagctgttgtattttctgtgggttttatgctctggcactgtttgattctgcaagtcggccatgtatctggggcatattgtgtgtctgatatttttctcaacatcttcactgttcttctgagtgtaaatttgtgcatttttaagtgtaagtttgacttgaaatgtggtgttttctgcatatgttaatcatctgtgggaatggtgtttctccaggagaggggagtgagtgtgtgtgtatatgtgtaagacggggtcttgctctgtcgcctgggctggagtgcaatggcgcgatcttgtctcactgcaagctccgcctcccaggctcaagcgattctcctgcctcagcctcccgagtagatgggattacaggcacccaccaccacacccgtctaatttttgtatttttagtagagatgggatttcaccatgttggccaggctggtctcgaactcctgaccttgtaatccacccaccttggtctcccaaagtgctgagacacaggcatgagccaccgcgcccggccgtgtgtgtttcttacatatgaggcagatgagttgagttgtttctgggttgcactgtgatcagtgcatgtgtcgctggtattctgagcatgtttgtctacgtggtgtgcatccagcatgcttcctgtggttctcagtgtttgtctgtgtgagggagggctgtacttcggggctgtgtgtccatctcagggactggtgttcccagcctgtgggtgctgtgagcaggtgctaaggtggtgtctgcatgctgtgttcccacatgtaggctggtgactgcagtgtgtggagttgtgtgggtctgttttgcatcatcgttgaggggattttgcgttctcagcaggggtggatgtgtgtttgtgagcagctgcgagtgtgggtccacattgtgtgctggtgttttcaggggagggggacagggtgcgtccatgaagccgcctgcatcatgagcggccagtgcctgttggcctccatacccagcgcaggctgtgtctgcggcgcgtccccttgccggctggtgccacgctggctcggagctggctgtggcagcaggcaaggcagggcagggcaggggctgtggtgggcactggacccacgcccagcctcggtataaatatcccaggctgccggcggctgtgtttgctgtgtttactcggcctcagccccggccgggggcggcagcagcccagcaggtcctgggggcgggggtgaccaggccacagcacagacatttccttctggccagacaggccccgcaaccttgctgccccctcctgcgccctttctgggtgggcgagaggcgatgacccctcattctgggtttccagtggccgccagtgaggctccaacctggatatcccagccgggcttcccagagtgtgggagacagaggagatggggggcacggggggcgggccaagacacacagcagcgagagggaaagggcaaagtgaggagaggacagagccccccagagggagactccagcagagaaagggatggggaaacgaggtgacaggagctgagaacagagatggagaatggctggggacacggagtggaaaaggtggggaggagagggagggagggagggagggagaggcatgggaaaaacaagggaggagagagaggggagacggaaagtcacggggagacaccgacagccagaggtgtggagacagaacgagaagacagagcagtggcggtgagggaggaaggcagagggctggaaagaaacgcacagaagcagggagaagggacgggggacagagggacagagtgactggagctggagggggaagagtgcagggaggcagcttgctttggcaggacgcatggaggtgtcagacgtggggggcggggtgtcggccaggccagcgagccaggccagggccaggacggacaggagacacgggggtgggggccggatgcccacctaggggttgtctcccagcggggcccgccctccctgactcagcctttccacctaccccgaccccgggagaactgggagggggatgggaggcacccgccctggggcccaccacccccaggtctcagaggcagtgaccagggggtgtgtctcccgtcatccctaccccactctgtctccacctctcttcctgtctccccatctaatccctgtccctgggactggctccacctctgtctgtcagctagatgctcacgtcttgaccatctgactaaccctaattctgactcaatttctgtgtctctcatcgctttttaaaaacctacacaacaaatttacgtatagcaaagtatattgtaaacaaatttaatgaccaaatgatagactggtaaaaaatgtgcctatcaccaagggctgatacctttcctgtggcccaggccctctgctctttaaaaatggggcacaaatacaggcaggtaagagacagacagctctcatcctgcactcttggctttctgagagatatgaccccaaggtcctggagtctagctgctgcttcctcctctgggaaatagaggagtgatattggtagtacctagggcatagcactgctgggacaattcagtgatttggggactgatctccatatcaagatgacctgatcctgtctgtgtgcgggacagtggctagcacggagcccttgttaggcccgcctaccatctgacccttctcaaaccttcccgtctgaggacatctgcatgcacacttgtccctccaatgctgtctcactctggatggccctgacacctgagaggccagacagccaagtggtttctaggacctttgtgattctaggcctgggttcctgtttcatttctgcctctgatggccgagtggccttgaggaagcaacatctttccaggcctcctttgacccacttcactagttcatggggccatctgaggatccaacccggtgtcaggcacttcgctcgggcctgacagaggacagaagcgctccgtagcagaggctttcgttctttaatag

SEQ ID NO: 17694 - DNA, 20678 bp, Homo sapiens
tatctgcaccccagcaaggagggttaggtcatcaaagctgggaagtgttcttgcaggggagctgccttgtgcccactgggagatggcaagccctgaatgcctcagaccaacttgaatggctctgggacccagcagcggggatgatagattggcataaagatgcatggacaattgaccacatggtgctgaaaccttcgggcaacaccttgataccaggatcccatggcaggtagggaaagctctcagtgctcaggtcctggtgctgggcatgaaaacacacacatgccaccctgagccctacacatgttgcctggattcttggattagagccactgtctctctcctctgatgatgtctctccagcagcctttcttctctgtgtgcaggtggggtctatccagcattgcttcatctctgggtctttgcaagggtgcggggacctaggacatgctagacatttcttccttctggagggttcctggtgacttccctgccagagaatcacctagggcaaaaataataaccataatcattagaactgttattcagtaaatgtgagattgtattcataccactaatcgtggaaccacagacttaccacctactatgccaagcgctttactgagtcatctcatttaatcctcatgcctctgtggatgtgacaccatttacatgtaaggaaactgaagcccagagaggaacggtgtttgcccaggggcacgtggctagtaagtggcacattttgactagtggttgaaactacagaagataggggctattattcccatcttgtgctaagtcagtggagcttggggatgcccactgagatgcggcaaggcaaaggcagcagtcctggccttgggagactgggctgagacccagcgcttcctcctgctcctggacagtctccctggttgcaaaccctcatcccaagggttcctgggtgtggacctaaatacacctagcactggagggttctcaaccagtgcttgtgaggtcttcctttccagttgtagtctatactcctcaggaatcttcagaattccccagtcagcttcccaaaggaaattaaattttcccggaaaagcaggcttatctattcaaattaaatgacttcttttcaaacaactgtgatgtcattgttctcatttttctgaagaattagatcttgacaagttaggctaaatagatcatttttatttctatcaaattatattgtctaaatatggctaaattgttacgacaacttactggaatcactgaggatgctgttaatgtcaaatggaacctgaaatcatccacaccagctgtgtgagcataatttagagacttgtatttcatgctcagagctgtccctggagatcaaatgtgtgaacccgatcctgctgaaaactctgtttccctccatgatttatctctttccaaaggctggtgagtagcctttgcttatcacggccagtgtcaagaggtgagcacaagttaacctcaaaaacaacattcagcccagccaagttttctataaatatggtacatgattaattatgtcagaagactatttactaaatgtggaaaaatcaataacactctaagaagaatgtttacccagcctaggatccaaacaaacactctaaagccagggaagtttttgaaaaatacaagctccgtgtctccagcaaacataagggaggttttactccttttcatttttgccttggcagggatgggccctgggggtgtgggctctgtctctgctcattgcaatcagattgacatgactgttgtccactgatgtcggccacgtgtcagcccctgcaggaagcacttaccactaggacctcttttaatttaatcccactgacaggacagcggcatcatgactcttatcctccctgttttgtaaactaagaaaccaaggccccaagaagtgaaagtgttggtcccaatcccaaagccagcaactggctgaggccccagttccagttgcgggagtagagtcagggtggtctcaggccaccgtgtcctggtgtgataggaattcactgttcctgccaggtgcttttctgagcttcttttaggtatgcactctcttagccctcacaaagccctgtgagagtcggagacagctgagggtgtggagtcacagatagctgtaccatataacagtggacagagtggctcagacgtgaccttagtcacacagctgtaagtcacagagtgggattgtaacccagtgcagacaggttccagcctttctctctctctttttttttttttttgagacagggcctggctccatcttccaggctggagtgcagtggcttgatcactacaacctctgccttcctggttcaagcaatcctcctcccacctcagtcctccgagtagctaggactacaggcacacaccaccacactccactcatcttttctctttttttttaagtagagatgaggtctcgaactcctgggctcaagtgatccactcactttggcctcccaaattgttgggattataggcaagagccactgcccccagcctctatccctctcaatgcaggacagatggtcaatcgatgagcctcccccaagggcagacgggtgtcctcgagtggggttgcctgcagcaatcctggcatctttgtgcccagggtgaaccttgtagcacccctcacctctgtacaacacaatgactttcagaaatcatcatgtcataatcaatattagtgattttcctagttttttaagttttaaagcaaacgattaataaaggacaaatttcaattttacaaaaatgttattcaaattctgttaagcgcctcatgtatgaactaaaatctgtactgacaaacaaaaatatcaggtctcacagttttcactctgtttctgttttaaactttgaacacaaaatccctaagtggtcccatagaatgacaggtcacagtgactccagttctgtttcatttcctccaccatttctgtgccactgttgctcattgtgagtctaccatataccatgttatgccaggaaatacgcagtgtgctttgtttccctttttaatttaatttttagttacaaaaaaaaaaaaaaaggaaaaagacaggccggatgcctgaatgatccacaaaccaattagtctgctcccaaataactgagattaaactcgccccatatttgagatcagaacattccattccagcatcgtgcaaagtaaatttttaaggcaatttaaaaagaaagctcagagtactcataaagactgcagaatacacacaaatggtgaggagccttttgctcagggtacatgccatgctgttaggctcgccatggttctagaacacctaacgtggcttccgtccaaagatctgccgagaaaaactttttccatctccttctgctgattcctgctgtttaagtatcggtccttggagaggtctggtataatctgctctctaaataaaatgggatgaaacaccatccatggggaatttagtatgtgaggtgcagaattccctcaaagtttgcattcagactatcttaaattctttgtaaaactccaccaaatccctcccaggaaaagcaagctcttcatcctcccctgaggtcgaagcaccatgccctcagcctctacgaatcccctgaacagcctctaaggagcgtcccctataggtgggagcggacacagaagggcggggctggagctagagaacctagctgtaagtgtcccaggtgaattaacccacctgagcccagcagggatcagccaaagggtgaagggacacagtggaagtcagatgtgggggacaaggaataggaaactaccctgtgtcttggcagtcagcgggtcaatttgggatgaaattgggtgtgtgcagtttagacagaggtttgcttacatgtgcagtatgtcgagggctcagcaatggtctcagtgtccactctcttcccaacttgctttctccctaattccagaggggagagttaagcatgatttcacttttattaatgttagagcaagaaagtttccagaggccctgttcccacctctgcatttatagatgagaagtggggctgagttaaccaagttactgaaaataataaagtaaaatccaaggacccccagggcaaggcagtttctgcattttacatagtctttctcactgttggtgctttacaaatacttccaaggttaatggataaaaaacagagtatatgtcttgctagttcattttcttctttaagatgtcatcacttggctaagtgaacagtaattggtttgaaagttcccacatggaagatgaataacttacagctaaagaagatatcttgacaaagatctgggggtcagagtggctaacatgctgaaagtcactcatttagcccatatccttaagcaccaactaagtagaatgctgagcgaatgctgcagatcacaatctacctctgaggaatctacctccgagctgcacaaacaggggcctagaccacgagaacggctccctgctatgagtggatgctagggctgcagaattgattttacagaatgttaagaagttacctgcttgtaaataaacccttagaaatgaagcttctcccaagcagagaacaagactgacccttgccaaactcaaatgcatggccagctatattgactgggagccagggacaccagccttccctggacccctcacagctggctgcttacccagctctggtggcacacttagcgtcccgaggaggcaggtcacaaggacagggggtctgggagaccctgagccccaagaggcaatcccctgtgttctcagaaccaggtacctccagcggacacagccttccaggaccccagctcccggcaggagccatgcagtccttctgcgtgcccggtgcccttccccccacctccacccagccccgagaacatctgacctggactccacagcctggaaacctgcggccacctgctgagggcccccccacccactgcttgggtccactgaccagtccccttccacatgtaggcctcatgccagccctcagtgtttccccgtggatttcaagacgaagcctcaagccttcattactggggttcacagggctccatcttcccctgcatcctccctcccactgcctgggctttggtctccctgcccttcactcactctctgtccccagggcttctgtacatgctgttcccccatcccgacaccattccacatctgagctgcttctcctttagattccggcttgactgcctgtcttctccagaggagtctctcctaattgcccatcccccagtcaggatgccacccctgtatcaaccacgacctccccgctcccctgtgctgcctgcaataaagccatcagtgccgtgacttgttcaaagttgtccactctaacaggactccaggatcacagaggcagggatcccctcctggaatccagtgcctcactcagtgcatagcagggtcttaatcaacaaatgttagatgggtggatggacaaacagatggatgaatgaaggggcacagggagggtctggtggcttctatggagagttcccaaaatgtctcaaatatctttgctaaaatgcaaggacttaaggcacattcttaggaggtatccagctggagtcagagatgcctccttgtcccttggggagccagcgagctcctagcccccgggacaactcaacatctccatggaggccactgtggtggtcgctggtgccgggtccacaggcgttcactgtgttctccaccgtggcgcttcttcccctggggccctcacggtcagtgcagagcaccaaagagttgccgctgtgtagagaattcttataattgtgcattgcatccattttgaatctaatttggaccctctcctaccagaagcagggtttattgctcttgacacggtgtctagggctccaccccctcccagttcctcaatgcggccaacccagatatctgccttgtacacccacctcctggtgaccatttccctgtgggacaggcagatacagcccatttgatggtctcagtgactccacaccccacagggacttcccagacatgcygccatgcccacctctcagccacagggaccccacggagcccgtgtctgtttgctctaaacccaccagtgagaagtccccttgggaaacctgcttgggaaacgtcctggaccccaataaaggcttaggacccaggtctctctctctcccttcacccccctccaggtgagtgtttgtgacccagacagctccccactttttgctggccccgtggggtgcactgccctctccctgggatctgtaagtgacacggtgcttgtgttgyttcctgtgtcttcttgtgctgcctcctgcatctcccctgacccacaccccaacccaactctcctcccatcagggatctcttaggaagtggctgtcttgataggaataaactggacatgggtcagacgagagccacaagggtgtctgtccatagaaacaagttttatgtgagagagacccctggtcactgggcagggctagaatttatagtcagtctctcaaagtgagagatacagcctgctaccaatgacaggggacttggagagcagtggagcctctccctcagctgagatggtgctgaggtgtggtcccctcaggcccccagagtttcctggcactggctccagcagcccagggtcaccttctcagcaagtcatcatgggttggcttcctccttgtctgtttcacttcccctcccacataaactagtctccccaaatcctgtctcagggtcccctcctgggggatcccaaccaatgagcaaaggtctgtggctgcaggaaaagcacactgtgagtccctggcttttgccgagtcgcggtgtcgcrggagggcctgcccgggcttcgattcccgctccctgcccagatttccggcccttgctaggaatcctgagccgggggaagtgagcctgcaagccctgcgccacgaggccggacacattttcattttctttctgatgctttttgtgaccctgacacctcacaatgcaatatttccactatgaaacccccagaactgccaaatttcacccaatttggattaacattatcgaggagcttggcattatgttgaaaacccagacattcccacgacccgtatcctatttaaaaaatgcctgtctatttaaggttcacgatgggaggataaaagaaaaaaggctcccaaagtcaacagagaacatgagctaggcaaaaggaaagtccagtttgcttctaaaaaaggctgaaaattataaccatccatggccttgtgtcttaagtctcagaattttttttttctcttttggtggtttgcaaaccaaagtggaattttattatgggttactaagggagcttcctcgagttcctagcccccaaagcccctgctcactccatggcatgcctccgaggctcctcatgccatgagaaagagaatggagccaaaatcaagccggcagtatctcggggctgtaacgtcttccccccgtcgctgtttccacagtgctgagccagggacccggcagagctgcctgactccttttatgaacaacagcaccgtgatgaaggcagcaggagtcagagaactattcattgcaggaagccccaacatccggtgagaaataagaagtacaacagtacaggatgcgccttgggtcaggggracgtggaaagccctcagcctttgtgtccttctctgcgccggagtggctgcagctcacccctcagctccccttggggcccagctgggagccgagatagaagctcctgtcgccgctgggcttctcgcctcccrcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcrggggggaggacacgccttactctaactggcacaaggagctccggaactcgtgcatctccaagcgctgtgtgtctctgctgctggacctgtcccagccgctccttcccagccgcctccccaagtggtctgagggcccstgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggccacgtgygtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgygctgcaacagccagtcccacaaggggccccgagggcacccccaaggctacacccaccacaagtagaccttcgctgtcatctgacgcccccatcacatctgccccactcaagatgctggcccccagtgggtccycaggcgtctggagggagcccagcatccatcacgccacagctgcctctggcccccaggagcctgcaggtggggactcctccgtggccrcacaaaacaacratggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacaggtaaagggggccctgagtgaccgggggaggggatgggcaggcatgggggcactgactacagtacaaagaggtggcagcaagagcargcccaggtttcctgtgggcagacacaccctggtccttgcagctgacccctcaacctccccccacgccaggcactcgggcccccttagagcatactgcccatctgcagcacggccgcacgtggggctctctcccaaggtggggacgtgcaggcacagaggcgccatggcttccaacgctgtctgttttgtttcccatagtccgacacctgggacagactgctgaaagtgaggkggccctagagacactagagwcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggcyggggctaaggggctcccctgaatatcttctctgctcacttccaccatctaagaggaaaaggtgagttgctcatgctgattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcctcagacaccctgcctgtggccccgcctccacttcatcctgcccggaatgccagtgctccgagctcagacagaggaagccctgcagaaagttccatcaggctgtttcctaaaggatgtgtgaacgggagatgatgcactgtgttttgaaagttgtcattttaaagcattttagcacagttcatagtccacagttgatgcagcatcctgagattttaaatcctgaagtgtgggtggcgcacacaccaagtagggagctagtcaggcagtttgcttaaggaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgtagtcgatagtgtgcactctttctctctctctctctctctcacacacacacacacacacacacacacacagacacggcaccattctgcctggggcactggaacacattcctgggggtcaccgatggtcagagtcactagaagttacctgagtatctctgggaggcctcatgtctcctgtgggctttttaccaccactgtgcaggagaacagacagaggaaatgtgtctccctccaaggccccaaagcctcagagaargggtgtttctggttttgccttagcaatgcatcggtctctgaggtgacactctggagyggttgaagggccacaaggtgcagggttaatactcttgccagttttgaaatatagatgctatggttcagattgtttttaatagaaaactaaaggggcaggggaagtgaaaggaaagatggaggttttgtgcggctcgatggggcatttggaacttctttttaaagtcatctcatggtctccagttttcagttggaactctggtgtttaacacttaagggagacaaaggctgtgtccatttggcaaaacttccttggccacgagactctaggtgatgtgtgaagctgggcagtctgtggtgtggagagcagccatctgtctggccattcagaggattctaaagacatggctggatgcgctgctgaccaacatcagcacttaaataaatgcaaatgcaacatttctccctctgggccttgaaaatccttgcccttatcatttggggtgaaggagacatttctgtccttggcttcccacagccccaacgcagtctgtgtatgattcctgggatccaacgagccctcctattttcacagtgttctgattgctctcacagcccaggcccatcgtctgttctctgaatgcagccctgttctcaacaacagggaggtcatggaacccctctgtggaacccacaaggggagaaatgggtgataaagaatccagttcctcaaaaccttccctggcaggctgggtccctctcctgctgggtggtgctttctcttgcacaccactcccaccacggggggagagccagcaacccaaccagacagctcaggttgtgcatctgatggaaaccactgggctcaaacacgtgctttattctcctgtttatttttgctgttactttgaagcatggaaattcttgtttgggggatcttggggctacagtagtgggtaaacaaatgcccaccggccaagaggccattaacaaatcgtccttgtcctgaggggccccagcttgctcgggcgtggcacagtggggaatccaagggtcacagtatggggagaggtgcaccctgccacctgctaacttctcgctagacacagtgtttctgcccaggtgacctgttcagcagcagaacaagccagggccatggggacgggggaagttttcacttggagatggacaccaagacaatgaagatttgttgtccaaataggtcaataattctgggagactcttggaaaaaactgaatatattcaggaccaactctctccctcccctcatcccacatctcaaagcagacaatgtaaagagagaacatctcacacacccagctcgccatgcctactcattcctgaatttcaggtgccatcactgctctttctttcttctttgtcatttgagaaaggatgcaggaggacaattcccacagataatctgaggaatgcagaaaaaccagggcaggacagttatcgacaatgcattagaacttggtgagcatcctctgtagagggactccacccctgctcaacagcttggcttccaggcaagaccaaccacatctggtctctgccttcggtggcccacacacctaagcgtcatcgtcattgccatagcatcatgatgcaacacatctacgtgtagcactacgacgttatgtttgggtaatgtggggatgaactgcatgaggctctgattaaggatgtggggaagtgggctgcggtcactgtcggccttgcaaggccacctggaggcctgtctgttagccagtggtggaggagcaaggcttcaggaagggccagccacatgccatcttccctgcgatcaggcaaaaaagtggaattaaaaagtcaaacctttatatgcatgtgttatgtccattttgcaggatgaactgagtttaaaagaatttttttttctcttcaagttgctttgtcttttccatcctcatcacaagcccttgtttgagtgtcttatccctgagcaatctttcgatggatggagatgatcattaggtacttttgtttcaacctttattcctgtaaatatttctgtgaaaactaggagaacagagatgagatttgacaaaaaaaaattgaattaaaaataacacagtctttttaaaactaacataggaaagcctttcctattatttctcttcttagcttctccattgtctaaatcaggaaaacaggaaaacacagctttctagcagctgcaaaatggtttaatgccccctacatatttccatcaccttgaacaatagctttagcttgggaatctgagatatgatcccagaaaacatctgtctctacttcggctgcaaaacccatggtttaaatctatatggtttgtgcattttctcaactaaaaatagagatgataatccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaaygctaaatgagaatgtaagtatttttaaatgtgtgtatttcaaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttgagctttctgttatgtgcctatcctaataaactcttaaacacattgattgtgaacttgttttaatatatttcacgacaactcgaaatacctggcagaacttgctttcaaggtcattacatttatccatctcccctttcaaagagttgctaaaaagaaggtaccttgtggctgagtttctgcacctgcacctgctggaggcgacagggggcgctgggctctgccttccttcattacctcagcaaatgtgtaccctgcccctcagcgtgctgcccttggggacatggaatacagagggctgggctgcactgcgcccagtgtccatggcagctgagtccactcatccatggccccctcatcactctttaattctctgcatcttgtaaattacatgggtgatgcctggcgcagaattaaacatgtccaatggatgcgatgtgaaaacactgttctataattatcattggagcatttatcactactttgtcagcaaagccctttcagtttatttaactaattggacaggcagatcagatcgctggttgtttggctgcacaaatctcatggtgattccaagtcaggaacagcagatggtggtcaattctgagtcagcctgcttttaagattgtgcaaaaggctgtggcaaaggcacaggacttaagaagaacaaagggttctgctctgttatgctaatggtacaggacacttgcaataaatatccattatttagggttaaatgcagctgatcctgttagaagtctattcattaacaacatacacttggaagttattcctcgatatgaacaaccatggctgttcccccaacacacacacccacacacataaacacacacatgcatgacacagagatatgcatccacaaacacacacaacacacacccacaagacacacacccacaagcacacacagttctaacatccttctgtgtcgtactggaacacctgaggccagtgtttctcaatttaggaaaagcctatgaaagaaaacaccaacttgtgatggttacattttttggtgacttttgctatctcactaaaatttcttaaatgctaggtaaatcattcgcaaacaaataatttgccaagaaaaattaatttgcacacatatctattgcacaatgcagagtacatttgtgttgctatcatcagacaaaatgcagattacaatgagagactcagacatgtactatgtaccttctgtgggattgaacatgcattgagtgagcctatcaagttctcagctgactcttgtgtatattcagcaagaggagatacagagagcagagatgataaacttgaaaaccagagaagtcggagtcagcctttccctgaattatatttgacattacaggtgcttagaaacagaatgactaatgggtttacccttcagatcctctgaatgcctcctaactctcccttttcagaggaaattatgaacagctcaacagtgaaaaagtgaagaaagaggcagagagagtaaaaggtatagatcaagtgcaatcatttttccggaactgtgattgacttaagggtgctcagcatgcagctcaggcacaggccctctcctgagtccccaggagaaccaccaccaaactctccatgagcggttgtccctctctgagttctggtagttgggttctatttgaggtttgtcgtgattaacttggatgatgatgttctcttgtggttaaaattggttcatagaattcaactgagtggaagaaaggatggaagggaggaaaagaggaagggaggaagggagggagagggaggaagggagggagagggaggagggagggagagggagggagggagggaggaaagaagggaatgaatgggaaggaatgaatggtagggagggaatgaataaatgggaaagagaaggaaggagagatgagggagagaagagagagagagaacacaaaagggggtagaggaatgtcccaggtgtggtggtcacaatcaggtctcacaaagctgggcttggagcctgagaaggaagggctgagtttctcagggcgtgccggtgcgaatttcaggccacttcgttctgctggccttggtgaggcccagcaccctcctgtcaccttcctgcaaagcctgcttgcctctgccactggccttacgcctgtccacatagttcatattgtaaggtctgaagccaagcctgtgacctgtctctgtggggctcctactgtgttcaagtatcatgaaataatgaaatttgtgaggtggaagaaaataattgggacgtctaccttctttctccagggtctggctttcccaaaaacgttatatcacaaatgttttacttcattgttgaaatcgctgcctcctgtcccgcgtgtgtttgtcggggtgtcacgcccttgtctgctttccttctcatccgtcctgcaagtcctcatgccctggcctccatccaggccctcatcccccatggctgtggcttcgtcagcttctcctcggatttccaccagttttgtcttctatttacagccgcgtggtgaagggactaatatgtgtttggcagatttcgtccttcaccaataaaaaatatacctttttgaaccttttcacttcaaattatattatatatgactttacaactgatatacccgattcattctgctgcatctgatgaatatctggtattttttccctaaattcagctttctggtgacacttcatgtttgtctcttgtaaacaacaaagctggatttcactttttttttcttttattcaatcaaaagtctttgtcttttaatgggagaattcaatctattcacattcattaaggttactaataaatttgtactgacttattttatatgttccatttataatgattcattgggatttctagcctctctctcgtcaattattagattgattaagttttctttgatctactttttcccttaatattttggaattgatatagactatttgtattcttcaaatagtcttactttttcacctcacatactaaagcctatatcttctattaatgtcttgtgttaattaatagctatctcctccctctattccccaaaatacccagcaatctgttatttctatttcctgtcctctcaggttacccagattcccacaccactgcccacctggattgcatctgaattttatttttttattgttatacatttttacaaccaaaacctacttggatgccatgagtttttgttgattttttctcatcttcacctctgattcccagtactgttggattcagttatcacgggagtgttttgttttgagttgtgtctttttctgagaaggtcatgcttgcatgaccagaaatgcctttcccttccgcaagttgaatgatgcctcacctagacatagatttctaggctctaaactgttgtcctgtagaactctggagatatccagcctttgctttcttgcatacgttgttactgatgagaaggctgatgtcaaataatgtgttttctttcatggaccatttctttcttttttcctttttttttttttttttttttgagatagagtctcgctctgtcacccaggctggagtgcagtggtgtgatctcggctcactgcaacctccgtctcccgggttgaagcgattctcctgcctcagccctcctgagtagctgggattacaggcacacgccaccatgcccgactaatttttttttgtatttttagtagagacggggtttcaccacattggtcaggctggtctcgaactcctgacctcatgatccacccacctcggcctcccaaagtgctgggattcgcccggccttctttttcttttccatttttccccgagtgctttggcaattttcttattctctgttgagttctgaggtttcgcttcaggttgcaggtgtggttcctttctggtcccgcctgcactaggtgagctcttcccagcacaggagggcatttccttctagctgtatttgaacctgagcatgtgtctgaatcctctggaacctcctgcagggctccttaaaacggaacccctccctcagagcttctgacttggccgatctggggtggagcccaagactgcatttctgctgatgctgctggtccaggaaccgcccttggagaaccgctgcttcatttggtcttgagtgatcttctcttattcttgttagtataccttcttgttcattgtcttgactctcttattttggaaacaattttagatggttctttccttcctcactttgtacctatcttctcccagtgggctataaggctgggccttctctccagcactcccagcgatccttgctctgctctactgtttttccaaaacaccaatcaccttccaccctggtttatgatttctgtttgtacactatgattgattatttagtatctgtatttatttactagaatgtaagagccaacaggggcacttttttgtcttttggtttctgatataccctaggcctctagaccagggcctggcatactgtggtgctcagtaaacacatgtggaatgcatgactgagctgggggttggagcagtgtaccaggtagggtgggctagcacaccctcctggtgggcctgtgtgagcctcgatgctgtccagggcctcttcctccaccatctgccacctgtcccctgtctccagctcatggcacggcctgcactcaagtcttcactattgctgctctgaattgtggccgccatatccagctggtctggggctctttgcactccagctcccagaaacagagcctgagagaaggactcaccatcctgtggttcactgggaagcacagggaacagtggtaatggcatcaagtggtgacatcactgtagaaatcctgggaaatggtgcaaaacatgccagggtcatcacatctgaaagccaagggagtggtgtgtagatacccattggtaatgagtagagggctgccctgggtggagttggcgggtaattcccagcacttccagatgaccacacatgtgggcaaagtggccttccacacttaggatggggaaaccttcaggtacagatgcaggccctggcaggtgtacttcacctgagcacagtgaaaagtgcaagcacgatttgttgagcactggcagcctccagcacacagctgtcctctaaactcagtgcagacagtcctccctgcctctagaggtcatgcctccatttccccaggaggagctgtatccatggggatggatttctctctcaggagttttctgctggcttttatcactttattccttgcatgataggtcagtggctacatgacttgtgtcttcctgagagactgtaaggcactcaagagcaacgggtacatctgtattgtgccttgctcacagtcaagcctcaaaagattttttaaatacaagaccccggatatgttattttataccacatatgttattaaagcaatgaagaggaaaaaaatcactgaccttttactatgtaccaaatgggaaaatagtatttgctattgagaaataggtagtattaatatctccattttatagttaaggaaattgaggcagagagaagatgagtggtgaattagatgaatgaaatcttacactctcactcttaatcactaggcttccctgcctcccattagacatgaataggaactgcaattgaaaaagtgtcaaccagcaaagagtggggagatgagtgggcctctcagccagtttcagataggaaaagcagagtgttaagcaatatgggtatttttaataatatgttcaaacaaacttacttgggcttgtgtatgtaccccccaaacacacacacacacacacacacacacacgcacacacacactggggtagaactactcaaaagccctctgatcagaaagattgtgcatcctgagacctgccttgcctgctctgagggcagatcccagggaacgcaccctcacagtccccccacgtggctatccccagtctgccttggtgagagcaatgtgtttgaatgcagtaggagaggaagggaagtgggaatgtgcaaatcgccccatggtccc
